United States Patent 6,812,339 (POLYMORPHISMS IN KNOWN GENES ASSOCIATED WITH HUMAN DISEASE, METHODS OF DETECTION AND USES THEREOF) - sequence listing, part 16

SEQ ID NO: 12315 - DNA, 50518 bp, Human
ttcaaatcattctaggcctcccagtaaaactgtgaaagccatactttcttctttgcctttaacgcattactgtcaaaaagagtacctccgggtactccttgcttaggagccagagcggcagccaaacaggagggcctggagagcaaattcaaggacatgcgcaggagcctagccacctgggaaatcaaatagataacatagttcattcattcatttattaacccagcaaacatttattaactgtctatgtgagccctgcactgcggggatacagtagtgaacaaagctcttgtgacgcttacattctagtgggagtgctgacagcaaacaaatgacaccgggaatggacaatatcactgggaagcatgttccaggcagggagaacaggagttgcaaaagctgtgaggcgggagcatgcttgctgtgcggccaccgcagggaagccagtgaagctggagtggagtggggaagacagcagggaggcccatgcagacaaggacagcttctctctttctaggacctcccttacgacttggacccgactccagagtgcaattaaggggccggcaagttgggtagcaggctgagagtgtctaaaggacactaaaatatctttggaataattcaggtatttggtgccagtgtactatgatttctgtgtcttggtgaaatatgagttggctttcatccagtgacatagacttattgacaactccttacctggactgcttgtgtctggagtaattttccaacagacaggtgcaaattgcaggatgtagccctggggccagccagctgacagttgcttaaaggcgttagtcacagttgtaattccaaaaattcctgatgcattgtgaatgctgctccctgagggcaagagatttatactattatccacattttaagtggtttactatgcttaccaagaagttgtttgcttcagaagattgcatgtgatgaagatatgtaataatttttttcttttttttttttggactggagtgctcactgcaacctccgcctcccgggttcaagcgattctcctgcctcagcctcccaagtagctgggattacaggcgcccgccaccacgcctgctaatttttgtaaatttagtagagacggggtttcactatgttggccagactggtctcgaactcctgaccttgtgatctgcccgactcggcctcccaaagtgctgggattacaggcgtgagccaccgtgcccggctgatgtgtaataatttctaattttaaatataaagaggcttacacaatttgtattccaggaaaattgatatttcccccacctctgctaagtaaacgttcgacggatgtttaaataaaactggttcgaagggatgccaactcattagtctgcccagggtgccatggcccagttggctcttacctggcgacatatatcgatatcacctgaaccaattagagatctcagctgtgagtgagcttgcttggtgtttaaatgtgtgcttggctgtccccctataagtggtcttccttggcttgcattacctccccttggcttgctttaggggctgaaatggcactgacactcttgagatgggactgcagagtttccttcccctaaccatgggatcgtatcccctctgcagaactaaggatagtacatgagtgggagatgagtaggaaatgggatgagtggagttgcaagaggcatcagaggtcactgtcaatggaggggaaagcttaagtgctcagtaaatgtagggcaacaaggaaggggggggtgaggctgaggtagggaggagaaggagctgagactcaggtatttggtgccagtgtagtagagaaggtgcctggaggcgggcaggcactgaggtcctctgggtctgaccaggcagtcccagctccagcccgtcccctggcccctccccgctgccggccagagtcacacatgtgttttcctgttttccatttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcactggacaggtaagaggtgggagaggagggacaatgggcgagaggggaagtgcaggaggaggatggagtcctaaaaattggctgaatggagacccaagagcctcctgtttcttgatcccagccctgtccctccctgggctgaaccttctgcccagagacttcagcccttccttaatggaagccctggccacaggagtaaacaatttcttttttgtttcactttttttttttttttttaaagagactgtcttagccacagtggaatatagaaaaacaaacagagaactggggagggaggagctgagcttctagcttggagtgatggggaaatctagtcataccagagtgtatctgttttctgtttctgttgttaggggaggcagcacagactgattggagccaggaaggcaggacatggggtctctgggagagaaagtgtgttcttacagtagttccctgagcttggctgaggagccaagaccccgaattatgtgctagttcctggagaaattgtgttttggtgttgtcattcgagggtgaggttagggtgaggggctccattggctgtcctgcccagcactgcatactggaggccctgctgccagtttctgaatcaaatttcttccacaagctgtaggatgagtgtgttgtcctgtaatcttcactgggtgttcagagatgaatgcatctcagacagggaaaggcaacaagggctgctgttatcttatggggtttctcatgtaaaacctggggtgggtcaggcacggtggctcacacctttaatcccagcactttgggaggctgaggtgggaggatcacgaggtcaggagttcgagaccagcctggacaacatggtgaaaccccatctctactaaaaatacaaaaattagctgggcgcggtggcgggcacctgtaatcccagctacttgggaggctgaggcaggagaacccgggaggcagaggttgcagtgagcagagattgtgccactgcactccagcctgggggacaaagcaaaactccatctcgggtaaaaaaaacccaaaaaccaaaaaaaaaaaaaaaccaaaaacctggggtagaagagcccctttgggagagcctaggggtgttgctggtcccaggctgcctgaatggtggggctgcctgaatggtggaagcattaccctaagacccagggtctcagggagaaatgtgagctgccaaagatggtgccttcttgtccagggtgctaggtagtggttgagaaaagagggggtcttcatgttctcaatgcatggcagcctcccttgcctagtgcgcacgggcagactgaagtaggttagagtccactagcacttcctggtgctaccactagggcgtgctgtttgctggagtgtgggttttacccccagcagatttctgtctcaaaattccacggataggacttcacttttcagatgctaccagtcaggaatgaaaccctgtacacttctctctccattccccctcacagttttcccttcctttgtccctccttccttcctttcttttacgtcatattaggacacatgcccaccccttggtgccagtgaatttggtcttaaaagggcaggcgtgatgatgtgtttgtgtttttttttttgtttgctttagaagtgggcaccctagcaatagcagcactgccaagaggacttgtaatcacctcttatccctgcaaagaatgagaaaggggaggggcagccaggaaggagattaacaaactttgttggagcctttcgtctaggctatagactgaaggatgacagaggctttctttctttttaatctagtctgcttacatcttcccccaggtaattcatgtagataattcctgtccaaaagcaaggtctaaggtggcaccggtggctcacgcctgtaatcccatcactttgggaggcagaagcaggtggatcagttgaggccaggagttcaagaccggcctggccaacatggcaaaacctcgtctctactagaaatacaaaaattaggctgggcacaatggctcatgcctgtaatcctagcactttgggaggccgaggtgggcggattgcctgagtttaggagtttaagaccatcctggtcaatgtggtgaaaccccgactctactaaaaacaaaaaagattagctgggcgtggtggtgtgcacctgtaatcccagctactcgggaggctgaggcaggagaattgcttgaacccagtaggtggaggttgcagtgagccgagattgcaccactgcactccagcctgggcgacagagtaagtgtctgtctcaaaataaataaataaaataaaataaaataaaataaaaataccgaaataaaaacacaaaaattagccaggtgtaatcctagttactcaggaggctgatgcatgagaattgcttgaaccaggaggtggtggaggttgcagtgagtcaagatcgtgccactgcactccagcctgggggacagagtgagactctgtctcaaaaaaagaaaataaataaaaaaaaaaaaaaataaaaggaaggcctagagactaaggcaggccagggggatggggagatggagagatagtatacttgtgtgattaagagtatatgagctctggaggttccatgagataatgtgcttaagtccttagcagtgtgtctggcccagtaagtgctcaataagtgatagcaattattattacaggagcattttggagaaaaggagagtctcctccagaaggatttcagatcattgtgagcctgtcttgggagaagcatgatctctgggaacgctcacaccagaatcctcctcctagattaaattaaaagtttaaagagctagaatgggaggatgtatggtagagatgtctcccagagatatttagatctctattctctggttgtagaataaccaaagagggttagaacagataggagaagaaacagacagttggatttcagaatggatagggtctatttctgttggtaaaagagactcagaataccagatttaaagtaaataataaagatagcataaactatgtgatttccaaaaagtgctcagcttcctctgcctgttctgggcctgtctgtccaacagaattcagtgaaatctgatttcctcatattcttttttaattttttttttttttgagatggagtcttgctgtgttgcccaggctggagtgcagtggcctaatgtgggttcactgcaagctccgcctcccgggttcatgccattctcctcattctcctgcctcagcctcccgaatagctgggactacaggtgcccgccaccacgcccggctaatttttatttttttgtgtttttagtagagacggggtttcaccgtgttagccaggatggtcttgatctcctgaccttgtgatccgcctgcctcagcctcccaaagtgctgggattacaggcgtgagccaccgcgtctggcctgatttcctcatattttttaggaaagtggagtcaacttatatttgaggaaggcgtttataggaatttatgcttatcccagagatcttggtatgttttgtcaagaatgaaaaggcacgtgggtctggtggggatgcagtcagatatttgatctcttgactgtgtttcttttgaagtagtctgaggctcagactttggggcagtggcccaggcttggaggcaaccccccagtctctctttgcatggggaagtgtgcagagttctcttagaacacccagtcacatggtgtagagactgctcttacacttcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggagtgagtgtgcgttccaccctcttctcatctccacttaccttgctaaccctcctctttgctgctgtgcagtgtctaatcgcttcttctcccgagtgcctctcaccctaacatctctccattgcttgactagcctctcccattttcctctcagctgtctcctgttcggtgttttccagcatgtgctgcctggctgcagctgtctccctgccttggctcggggtgatatctctccagcagcaactctggggtagggagtggccatcagctgcctccaatcatccctaggttttatggtacattggatcgcccttctctcattcatacttttttgggtgattcaacgatgctgatgtgagggatcgatagcaggaggcttagaataccagagaatgggaaaggaaaagcaaggaaaagataatagcctgtcttctttcagggtgaagtgggtctacttgggctttgccagggctgaagactccagctaagggttaagggatgctctttgggcaggaggatggttgtgggtttccagcaggtttctgaagcctttagttttggcagacgtagagtccttggggaaaagagcagtgtcatgagacgctcccacagattagctgctggtagggtcagttcctaatgttgtacctcagcacaggtgatccctgaagctgaaattggagggaagacgggttttggataaggctgaaaactcggggtcaagccattatagttattttctgggagccgccacactgcccccatgcctgtcttgtattatagcaggctcagagagaaccaacatttagtgttttgtttttgattttgttttttttttgagacagagttttgctcttgttgcccaggctggagtgcaatggcccagtcttagcttaccgcaacctctgcctcccgggctcaagtgattctcctgcctcagcctcccaagcagctgggattacaggcatgtgccaccacgcatggctaatttttgtatttttagtagagactgggtttctaaatgttggtcaggctggtctcgaactcccgactttaggtgatctgcccgccttggcctcccaaagtgctgggtttacagatgtgagccacagcgcccggcccaagatttagttctctatttggtgagtcgggtgggcagcaatgtcctaatgatgagagacagatcctttctctctggcgaatgagtgccttctcttaaaaattcaagttggaggctgggcaaggtggctcacgcctgtaatcccagcactttgggaggccgaggcgggcggataacctgaggtcgggagtttgagaccatcctgaccaacatggagaaaccccatctctactaaaaatacaaaattagctgggtgtggtggtgcatgcctataatcccagctacttgggaggctgaggcaggagaatcacttgaacccgggaggcggaggttgcagtgagctgagatcgcgccattgcactccagcctgggcaacaagagcaaaactccatctcaaaaaaaaaaaaaaaaaattagccacgcgtggtggcaggtgcctgtaatcccagctacttgggaggctgaggcaagagaagcgcttgaacccgggaggctgaggttgcagtgagccgagccgagattgcaccactgcactccagcctgggctacagagcgagactctgtcaataaataaataaatacatagatagatagacaaatattcaagttggggttgttttgatgagtgagctggagaaaaggttatttggaggtctccgcattggttggtgagctgcccgtattaccctgtgttggaggcgggtagaggttctatgtaattgccaaccacctaatctatagcatcatctttcttccttaaagggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtaagtggggctggggtaggaggtggtgggtggagggctggacagaggctgggatgtgagtgcagtctgggagtaagaaggagatagagaggaatgtctctgacaacatatatatatatatatatagttaaagtatgctttgtgtgaaaattcaaacagtaccacagtgtatcgcaaaaacactcaccttttccccagcttctcacagtaagcactattagcagtttgcatattcttcctgatttttttttttttttttaaagagacaggtattttgctctgtcacccagactggagtgcagtggtgtgattataccttacttcagcctcgaacttctaggctcaagctatcctcctgcctcagcctcctgagtagcagggaccacaggcacactgatttttttttcttgttccttcaagagatgtagttttggcagggtgtggtggcttatgcctgtaatcccagcactttgggaggctgaagtgggcagatcacctgaggtcaggagttcgagactagcctggccaacatggtgaaaccccatctctactaaaaatacaaaaattagctgggtgtggtggcaggtgcctgtaatcccagctactcaggaggctgaggcaggagaatcgcttgaacccaggaggcagaggttgcggtgagccaagatcgcaccactgcactccagcctgggcaacagagtgagactctatctcaaaaaaataaaaataaaaaaaaaagaggtgtagttttgttcttttacaaaaatgaggtcatactagtctacatgtaattctacagtgtgcttttcctctagcattatcagtgacattcttttctacttacagatctactttttaaaaaatgcttcatattatttcatgtgaattttaaggatgcatagtagtttatttatctagctggtcctctgttaatggccatgtacgttggtttcagtttctcagtcttacagataatgctccagtgaatatctttttgcagctgcatgagtatttctgtaggctggattcttcctttttttttttttttttttttgagatagagtcactctgtcgcccaggcttgagtggtgcaatctcagctcactgcaacctccatcttctgggttcaagtgattctcctgcctcagcctccctagtagctgggattacaggcatgtgccaccatgcctagctaatttttttgtatttttggtggagacggggtttcactgtgttggccaggctggactcgaactcctgagctcaagtgatctacctgccttggcttcccaaagtgttgggatcacaggcgtgagccactgcacccggcctctgtgggctagatttttaatactgtcatttcagtccaccttggctttttctccatctcataaataaaacattatttaaatctgtacattcagtaaagccattggaggtgctgagatgatgattctccatagccccatccctcagatgccactattcttgaaaaatgcccttccaacctgggagagcctaggaccttagagatgccttccaccctgcaactgtgaagaagctcagacattctgtcaatttgaggggcagctgctctagcagttggggcacaggaattttgcaccaggtgcaattgctcattggctcaccgctctccaatcagtttgtgtccttttttctttcaatttctgtattgccccattcactcctcaacttcctttccagcttctctgattttactgttgtgtagagaactggctgtcttctgtggggtccttctgtgttttgtgtgtccttgtgtctggcctggactcatctctgcatatgggatgtttgtcatacatggcaacagtcagggaggggtggaaggcactgctttgtgttgcaagaagggggttttcactgaggttttttttttccgagacggagtttcactcttgttgcccaggctggagtgcaatggcacaatctcggctcaccacaacctctgcctcccgggttcaagtgattctcctgcctcagcctctcaagtagctgggattacaggcatgtgccaccacgcctggctaatttttgtatttttattagagacagggtttctccatgttggtcaggctggtcttgaactcccgacctcaggtgatccgcccgccttggcctcccaaagtgctgggattacaggcatgagccactgtgcccagccttcactgaggtcttaaatatgatctgtgatttctcttgcattacttgcagatgatctggtaggttgcttactggcaaaactaattttaggatctattggtcttggagcaccctcaaatgtgggcatatggttaattatatcatgtgcagagaaggatcatttcatctaagtaatatttctaagatggctgcattcctttaaaataccagaagtctatttttttttttttttttgagatggagtttcgctcttgttgcccaggctggaatgcaatggcgtgatcttggctcaccgcaacctctgcctcccaggttcaagtgattctcctgcctcagcctcccgagtagctgggattacagatgtgctaccatgcccggctaattttgtatttttagtagagatggggtttctccatgttggtcaggctagtctcgaactccggacctcaggtaatccgcctacctcggcctcccaaagtgctgggattacaggcatgggccaccttcccggccttagaattctattattttaactatctttgtctgtgtcatttctgacagctcttgttcctcgattctggccttgtgcctacctctgccagtcaaccctttttaattttctgctgttgctgcttttttttttttttttttttttttgagacagtgtttccctcttgttgcccaggctggagtgcaatggtgcgatctcagctcactgcaacctccgcctcccgagttccagcgattctcttgcctcagcctcccaagtagctgggattacaggcgcccgccaccacgccaagctaattttttgtatttttagaagagatgggatttcacagccactgcacctggccaattttctgcttctaatttgggtatagagacatacatgtttaaatcctcattcacccatgtacacattcacgtgcctgtacatccttgtaagaatacatgcaaaggccgggtgcagtcgctcatgcctgtaatcctagcactttgggaagctaagatgggcggatcgtgaaaccccctctctactaaaaatacaaaaaaggccgggcatggtggctcacgcctggaatcccagcactttgggaggccgagatgggtggatcacgaggtcaagagatcaagatcatcctggccaacatggtgaaaccccgtctctatgaaaaacgcaaaaaaattagctgggtgtggtggtgcgtgcctatagtcccagctacttgggaggctgaggcaggggaatcgcttgaacccgggaggcagaggttgcagtgagcagagatcgcgccattgcacgccagcctgggtgacagagccagactctgtctcaaaaaaaaaaaaaaaagctgggcgtggtggtgggtgcctataatcccagctactagggaggctgacacaggaggaacgcttgaacccgggaagcagaggttgcagtagccgagatcatgctactgcactccagcctgggccacagagcgagactctgtctcaaaagacaaaacaaaacaaaacaaaaagaatacatgcaaagtagccgcagttatggttcgtatgcagagctcttcagtgagtaaaatgcatagagttttgtacacacatgtgtgacacacatttgagatttctctgatagagtgaaaggtgcacaccacttgtgcacacacttgtgtttgaggttgggctcaatagctatgtgaccttgagccaggtgcactgactgtttaattccaggctgttgtgagaatggaatgagattcagtgaaaaccatgaattatgaattatgtttcaaattactgtctttcttggtcacttatagtcctgttcctcttcctgcttcttggcttcatctgagtagttatggttagataaatgaaatattactgcatagataatatctggactttgttctatctttgataacttcagaggagcatagagatctaaagaaggttcagaagggcaaccaagactaagaatttagtgacatatgattcatgggtttattccttcagccactgttttggttttgttttttaattttctttaatagagatggggtctcgctatgttgcccaggctggtctcaaactcctgggctcaagctatctgcctgccttggcctcccaaagtgctaggattacgggcgtgagccattgtgcctggccttcaggcactgttgaataagcacctgacacaagtcagatgctgggacctatgaagacattctgattagcctaagtgagaacttaggcagaatcttcagatttagcaagagaagggctttaatttagagctttcatacattccctcccttagaaaaaatttaattagggcatgctatgtgtgtgctagatattttacttagtgctgaaaaacaaagaagaatgatgtctggcccttgccattcaataatttatagtccagaaaggagactgacatgttaacaaataattgtcatgcaatataatttgtacactgatagaggcaccataagagcaaatggggcaacttctttttttttttttgagatgaagtttcactcttgttgcccaggctggagtgcagtggtgtgatctcgcctcactcacgcaacctccatgtcccaagttaagcgattctcctgccccagcctcctgagcagctgggattacagctgtgcaccaccacacccggctaatttttgtgtttttagtagagacggggtttcaccacgttggccaggctggtctcgaactcctaacctcaggcgaactgcccgcctcagcttcccaaattgctgggactacaggcatgagctaccacgcccgacctaaatgggacaactttatttttgtaggggaggatagcttaggaaggtatcgcagagaacatggtgtctgagctgaattttgaaaataaatatagctgtctcctgtgacctttcacacaggagactgcatgtgcaaaggtgtggaggtgcaaggtacagaatgttcagagaattccaggtcgttggtttggtatggttggaatgtggggtgggagaagggcgaggagacagccctgggtgagatgggttttataatcaggttggactttatctaaaagataaggggaagctattgtttatttttatatttttagagatgggggttcttgctctgtcgcccaggcaggagtgcagtggtgcagtcatagctcactgcggcctccaactcctggcctcaagtaatcctcctacctcctgagtagctaggattacaggtgggagctacaaagctacacagctactgattattaagcaggggtatggggactagtgaaataatgagacttagttaaaaggagaactctggtggccacatggagaatgtttttggaaagagcaagagacagaaggtggggagactggtttagggagctgaaacctgaatccatgtgaagggtgatgaatatctgcactgtggagtggccttaggaacagagatgagggtatgaataaagaaatagttggcccggcgcggtggctcacgcctgtaatcccagcactttgggaggccgaggctggtggatctcgaggtcaggagattgagaccatcctggctaacacagtgaaatcccgtctttactaaaaatacagaaaaaattagccgggcatggtggcaggagcctgtagtcccagctacttgggaggctgaggcaggagaatggcatgaacccgggaagcggagcttgcagtgagcccagatcgcgccactgcactctagcctgggcgacagagcgagactccgtctcaaaaaaaaaaaaaaaaaaaagttaacagtggactttcaaggactttttgccgggggtcggggagctctcacaggtaaagccctgcctccagccttgcccataggtttccaccccagtatgttgctccctgtttaaaatcctccagtggctcctcatatgctttaggataaaatctaaatccctaggaaggtgtgccttgtgcttttgccgctttggccttctcatatcccataatccttcatgcacaccccattacccatatattctaggtatggggaatatggaagctctcagagttcatgaagctagagatttgagcttggacaggtgtgggtgatggggctgccatctaaaatagggaaggtgggctgagtgtgaggtagacagggcatccaagtcttctgccaggctgcttatgtggcccttccatgagcagcgccttctttgggtgtcatgacacagatttgggtcattttcccagcagttgagtcacgcttacctaaaaaaagaggtcgatatggtgaaaccctgtctctactaaaacacaaaaaaattagccgggcatgatggcgggcacctgtaatcccagctacttgggaggctgaggcaggagaatcgcttgaacctgggaggtggaggttgcagtgagccgagattgcaccattgcactctagcctgggcgacagagcaagactctgtctcaaaaaaaaaaaaaaaaaaaaaaaaaagagattgatgtgtgaatgataatgtcagtttactgatgtatgtacagttttttttttttttttttttttgagacagagtctcgctatgtcagtaggcggaggttgcagtgagccgagatcccagcttcaagcgattctcctgcctcagcctcccgagtggctgggattacaggctcctgccaccacacccagctaatttttgtatttttagtagagacgaggtttcaccatgttggccaggatggtctcaatctcctgacctcgtgatctgcccgcctcagcctcccaaagtgctgggattacaggcgtgagccaccgccctcggcctttgatgtatgtacagtttattgatgagcatacatgggtaatttctttttttaaaatttttatttatttaatttttcttccacttttattttaagttccagggcacatgtgcaggatgtgcagctttgttacataggtaaacatgtgccatgattgtttgctgtacagatcaacccatcacctgggtattaagcctagcatccattagctatgattcctgatgccctccctctaccaacctctaccgacaggccccagtgtgtgttgttcttcccccgcatttgtctatgtgttctcaccgttcagctcccacttataagtgagaacatttggtgtttggttttctgttcctacattagtttgctgaggataatggcttccagtttcatccatgtccctgcaaaggacatgatctcattcctttttatggctgcatactatttcatggtatatatgtaccacattttcttacttgccgtacctttctttttcttttgagactgagtcttgctctgtcacctaggctggaatgcagtggcatgatcttggctaactgcaacctctgcctccttgttttgagtggttctctgcctcagccttctgagtagctaggattacaggagcccaccaccacacctggctaatttttgtatttttagtagatatggagtttccccatcttggccaggctggtcttgaactcctgaccttgtggtccacctgccttggcctcccaaagtgctgggattacaggcatgagccactgcacctggccaggtgttcctttttctctgcaaacttgtcagcatctgttgtttcttgcctttttttgtttgtttgttttttgttttttgagacgaagtttcactcttgttgcccaggctggagtgcaatggcacaatctcggctcaatgcaacctccgcctcccaagttcaaggaattctcctgccttagcctcctgagtagctgggataacaggcgtacacacccccatgcccagctaattttgtatttggctaattttgtattgttagagacggggtttctccatgttggtcaggctggtcttgaactactgacctcaggtgatccacctgcctcagcctcccgaagtgctgggattacagatgtgaaccaccatgcctgactgtttcttgactttttaattattgacattctgactgacgtgagatgatttctcattgtggttttgatttgcatttctctaatgatcagtgctgttgagctttttttcatgtttgttggccgcatgaatgtcctcttttgagaagtgtttgttcatgtccttttctcactttttaatgggattgtttgtttctttcttgtaaatttgtttaaattccttgtagactctggttattagacctttttcagatggatagattgcaaaaattttctcccattctgtagaggttgtctcttccctctgatgataatttattttgctgtgcagaagctctttagtttaataagatcccatttgtcaatttttgcttttttggcaattgcttttggtatttttgccatgaaatctttgcccgtgcctatgtcctgaatggtattgctataaaaccctagatttttttctagggtttttatagttttgggttttacatttaagtcttgaatccatcgtgagttaatttttgtataagatataaggaagggctccagtttcaattttctgcatatggctaggcagttctcacagcaccatttattaaatacggaatcctttcccacatgagtaatttctaatgaccagaaggtgtgtgttcactatcaaggcatcccctccctgataccctagtaactgggaaaccaatctagtaatcaggaagttgcttgcagggtgtggaattggaacaaaagaagaaagtttgaataatttgagaaattttttctgaacatgttgggctctataaagcatggaactgaaaggtggagcccctgcctgtagggaacgcacagtgtggtgggaagcgaggtagacatagtcacttaaacatgtatatgtggcaggtgcttgcaggggtggagagtggcttgttcaggggatgatgtctgcatcagcactgaaggatgaaaggagtcaggctgggctgaagcacccacatttctaccgtggcctatgtggccctactccacctgacttctttgattcaccttggacttcttgccctcactttgtctgctccagctacactggccttcttgcctctcctgcattttcctggcacatacatgtctcagggattttgtatttgtttcttctgcaaggaaggcacgtctccagatgcctgcagagcttattcccttactccattcacctctttgcaaaaatagtaccttactagagacctatcgtatctaaaatggtcactctcagttccccatcctgttttctttttctttttttttgagatggtgtctcgctctgttgcccaggctggagtgcaatggcacgatctcagctcactgcaacctccgccttccgggttcaagcgattctccttcctcagcctcctgtgtagatgggattacaggcgctgccactgtgcctggctaattttggtattttagcagagatagggtttcaccatgttagtcaggctggtctcaaactcctgacctcaggcgatctgcccgccttggtctcccaaggtgctgggattacaggcatgagccaccgtgcctggcctctttttctttataacagtgttcaacacatcatttacttgtctctctttccctctagaatataaacatatgtgaataaggactttgttttactcactgctgaatcaccagcacatagaacagtgcctggtatctgctaggtgctcaataattgtatgttgaatgaagaagggggcaggacgttttaggcacagggaaagccaatgtaaaggcacaagatgaaaaaaatgtatggggtgtgggggtgcatgggggattgtgggatatgaggggaccaagatgggcaaggggctagaacacaaagtatatctttgtagggttttagaatttattcaaagcatatgaggaaccattaaaggactttaaacaggggagtgatatagctggggtggaacttaggggacaaggctggaggcagagacactattaggaagctcttgtagcaatccaggcaggaaatgacaaaaacctgaactacggtgatggcagttggggtggacaaggaaggatagatctgagcacaatttagaaggtataatcaatacaaccaatgagacctattaagatgtcaagtataagggagagggaagtgtcaaggaaaacatctaccatcttgtaagttttgtgccagaagagctgtgcctatctataatccactgtatccccagcaaggaaacagagaagcttgataaatatttttttgtttgtttgtttggttgttgttgttgttgttttgagacagagtcttgctctgtcgcccaggctggagtacagtagcaggatcttggctcactgcaacctctgcctcccgggttcaagggattctcctgcctcagtgtcctgagtagctgggactacaggtgcatgtcaccccgccctgctaatttttgtatttttagtacagatgggatttcaccatgttggccaggctggtctcgaactcctgaactcaagtgatctgcctgcctcggcctcccaaagtgctgggattgcaggcgtgagccacctaccgtgcccggccctcaataaatagtctttgaatgaagagatgatgtttctggtttagacaatttgtaggcagtgatatcatttactgtgaggaggaggatgggggcatgttgaatttggaatttatttttagcatagtaggcagatatgctctttggaatttaggaaagagatagggttggagattaaacattcaacaagtatttgcgaagaggttgccacgttccctgcactgtcactgtctttttggagcactttatgtgtgtgcgtgggtgtgtgtgactgcatgcatgggtgcatgccggggtcaggatgggcaacccaatacagggatttttgttttgttttgtttttttgagacggagtctcgctctgtcaccaggctggagtgcagtggcgcaatctcagctcactgcaacctctgcttcccaggttcaagagattctcctgtctcctcctgagtagctgggactacaggcacgcaccaccatgctcagctaatttttgtattttttagacggggtttcaccatgttggccaggatggtcttgatctcttgacctcatgatccgcctgcctcggcctcccaaagtgctgggattacaggcgtgagccaccgtgcctggcctctgatacagagttttaatggattgtgatggtgttgtgatttgcaaggtagaacaaggcacaggaggagaccagtcctaacctaggcatttagaaaccattcctgtagaagtttaagctgatacctgaatggcgaagaagaattaatcaagagtagaagaggagtgttccaagcagcaagaacagaatgtatgaaaacctaaatgccagaagtgctcctttcaggcactgaaaggagttcagggtgggctgcagtgttgaatttcaggaagaaaaggttgagagttggcttgcagaggtaaatagagtcaaggcgtaggttgttcaaagctttataagctgtgctagttattattgtgctataacaaatagtctaaaacgtagtgtcttaaaacagtagtcattttttttatgatttctgtggcttagaaatttgggaagggcttagtgggacagttctaggtcagggtccctcatgtggttgcagcagatggtgacaggagctggaaaaacggttgctgaggaagttgcagacaatctgggcttcttttttttctttttttgaggtggagtcttgctccggttgtgcaggttggagtgcagtggcgcgatctcggctcactgcaacctccacctctcagattcaagcaattctccttcctcagcctcctgagtagctgggattacaggcgtgccccaccacgcccggctaatttttatatttttagtagagacggggtttcaccgtgttggccaggttagtcttgaactcctgacctcaggtgatctacccgcctcggcctcccaaagtgttaggattacgggtgtgagccaccgcacccggccttctttatcaaattgtgtcagtctttccatgtggtctttccgtatggactgtgttgagctttctcacagcgtggtgactcgtgggcagtcagactgcttatgcaggcagctgaaagcgtccagaatgagtgttgtagcacccaaagtggaagttgcattgccttttatgacctagtctctgaagttgcatggtgtcaattctgtcatactctataggtagaggcattcacagaagaccatccagtttcgagaagaggggtacagaccctgcctcttgatgggtagagtgtcaaagtcacattgtaagaaaggaatatgggatgggagacgttgaggcatattggaaaactccaatctattgcaccaactatattaaggagtttggtgggctgtcttctaaggcaatgagaaaactcttaaggcctttaaaagcagaagagtggcatttgtgatttagattttagaatttgtgagtttaagaaagattagtttttctatgtaggattgaaagctgggagacaggtgggaagctgctgctatgatcctagtgagaaatgatggtggcttggactagagtcatgttttggggacagggagacttaagacttggactatgagtagatatgagtggaagttgttgatgacaataacatgcccaggtctttggcttgcataaatgggtggatggtgacgccagttacttgtatggggaacaccgaaggtgcagtaggtttgggagaaattgatggaatcagttttggacatgttgagtttgatgtgcctggtaatgtccagtaggtggttgaatattcatatatatctagaatcatgacagttgggctgatgatatacttttgggagtcatcattgtatatatggttattgaaaccataggaacaggccagggcggtggctcacacctgtaatcccaacactttgggaggctgaggtgggctgatcacttgaggccaggagttcgagaccagcctggccaacatggcgaaaccctgtctctactaaaaatacaaaaactagccgggcatggtggtgtgcacctgtagtcccagctgctctggaggctgaggcaggagaatcgcttgaaccctggaggaagaggttgcagtgagccgagacagctccactgcactccatcttgggtgacagagcaagattctgtctcaaaaaaaaaaaaaaaaaaaaaaaagaaagaaaaaaataaaaagaaaaagaaaccacaggaacagatgagatgaccttgggacaagatgtagaaagggaggacaaaggggcttagaagcattctgaggaatacccacccacatttgagggataggtattttgtgaaaagatggagaaggagcatctagagagataggtggaaacctggaagatggtgagtggaagggagtgaattgagaaggaatgaatgactacctgtgtccaatctgctaagaggtcaagctaggtaaagattgagtatagttgattggatttattgatatgaaggtcactggtggcttttcatgtgggctttctcctaaggcaatgaaatttcagggcagtgagggtgaaatcaggtttcagaaatatcatttattcacccagcaaaatgtattaagtgttactgtgtgtctagttcaggactatgcccatgggtacaaggataactgttatccactctctgccctcacacagctctcgtgggtgggagagacatatgtacactgttctaatgcagtgtagttaattggggaggtgagagcacagagcaagggcagcataccagaggtggcaggtttacactcaaaaacagcctttctggaggagctattaagtttaaaataaggaataaaatgtcatttggaattggcaactcagagggtcaaaggaaaacttttgcagggtgaaagaggaaggagttgcaacatctcagactgcattgtagagacccaggaacgggaaggaatgtagacatgctcttcagatgaatgattctgaaagcatggagggtgattgttagaggaaaggaccaaggttgagggacgattttatgaaaaagagttaagcctgccttaggttggttgaggtatgtttctggaaaagttggatgaaatatctctaccctacaatgatgccttctccatggctgtaatgattgggtgccctgagtcagacttctttttcttgaacagtgtaggggatacccttatccctttggaaggcactggtgcatggtggtgaacagcgtggaatcaggcaggattcaatcaatgctaggtcaaatttattagcctcagtttcctcttgttctccttctccttctccttttcctccttctccttcttcttcttctttttttttgacagagtttcactcttgttgcccagtctggagtgcaatggcgtaatctcagtttactgcaacctccgcctcctgggttcaagcgattctcctgcctcagcctcccgagtagctgggattacaggtgcccaccactatgcccggctaattttttgtatttttagtagagatggggtttcaccatgttggccaggctagtctgaaactcctgacctcaggtgatctacctgcctcggcctctcaaattgctgggattacaggcatgagccaccgtgcccagccctcagttctctcttctataaaatggggtccctacctcatagaaatgtgatctatatttgtaccatattttcatctttttctattcaaatcatgacagtttccaaagagcaaacacagagtctctgctcctgccagttgtttgcagtcttttggcaggcatagtctacctttagagctgttgaactacagccctagatagtctggtattactaatagaccttgaaatcatttactggttattgcttaagtaggtttttttatacgggtggttgacttcattcattgctgatttcattgtcagggtaataacgttttgccctctctgtcaggaatattgcttcccctcccccaccccagcagcagcctccatgcactcagtccagataacagtgatcctggtgcttgcctgcaccccattcactcctccagtgacgtgtgggtagataggttgcctctcagtgactttcatagcaactgattcttgtaattgtcaatgtccacttttgagtgaaggctggagactggatcttaatctcagagcctgcacagggcctggaacacagtgggtactcaatataagcttaatgaatgaatgaatgagtgagtgagtgaaggaattctgagttttgaaggagcctcactgtcctgtctagggtagtagaaatggttgcttttcccaaacagagaggtgtgcaggtggcacctcctgaagctgcttattctgacttcttggagaaattcgtggactgccccagtgctctgaagttctaggcatctccattaccacagggggagataatcccactccccgtctcacattcttgcatacagttagggaggtatgtggtgtggtggaatggatataggctttggagctagtcactgcctgacctcagttttctcaagtgtaaaataaagataataaaacttactctctgtcagattaaattagaagataggtgtaagtacatagtgacctggcacacagttgtcagttaaaaatagtatctattactgcaagttatattcatatcatatgcatcttattgatttctaaaagctttaccttccgcatgctgtctttggatgacttaaaagcagtttacattttacttcacaatagctcagggatcagaaaggagggctgagccttttctttctgttttgcaagagaggtggaactttcctctcagcaagaggataggtgtccagaagtccagctccacccgactgtcctttcctcagagccaaggtgttttggcccactgttcacaggtggacatgactgttcttgccttacctacacttgcccacactgagacctagttgttttgccattcaggacactaccaggacatttttaccatctatgccttcagtatgtcccctgtaccagtgagtcagcagtacctggcagttcagggctctttgtttacagagtactgttcttcagggatcaggcaaagattcttcgtgtcatacacatgtggccacagtgaattgcatgtagtgggttcttcaataaatgttggctggatgaatgaacagaagatatgattccaggttcaacttggctgagaagggtatttcgtgcttttgcctttcagggtgctggtgggggctgagggttgctgtgggaagggggcagacagcttaccctgagtctgccagagccgctgtgggctgtgaaggactttggatctctgtgtgtctgagagctttggccaggtgtcctcgtgcagcttctcctggtaccagaatgactgatctcatgtacttgtggctaatgaggtggaacagtcagatgctgggccccccaacggacttttgccctttgaaccttctacttggaagctagttgcctttttcagagggcttttcccaagagccatctgagggtggaggtgaagaaacttaccttttctggcccatattcacctcaagaaataggctttcatcagagccttgggttctagtgtgggtttgttgtgaactttggaacaaactcttgaccagcagtgaaggggtagacctttatgctgctttgatcatcaagtccctttgggggctcatccttgctctcttcctttctatgttctatgtttctatgttcctttctttttctctctgcctcagaagaagctgggcaggtagcctagaggaggttgcggaagacgctgggcagcagtgggtcctaactctggctgtggattggaatcatctggagaattaagaaaacaagaccgggcacggtggctcacgcctgtaatcccagcactttgggaggccgaggcgggcagatcacgaggtcaggagattgagaccatcctggctaacatggtgaaacccgtctctactaaaaatacaaaaaattagctgggtgtggtggcaggcacctgtggtcccagctactcgggaggctgaggcaggagaatggcgtgaacccgggaggcggagcttgcagtgagccgagattgcaccactgcactccagcctgggcgacagagtgagactctgtctcaattaaaaaagaaaagaaaagaaaagaatagaaaagaaagaaagaaagaaagaaagaaagaaagaaagaaagaaagaaagaaaaagcaagcaagcaagcaagcaagcaatactcagattgggcacggtggctcacacctgtaatcctagcattttgggagactgaggtaggaggatggcttaagctcaggagaccagtctggagaacttggtctctacaaaaaaaaaaaaaaaattaattgggcatggtggtgcatgcctgtagtcccagctactcaggtggctgaggtgggaggattgtttaagcccatttggtccaagctgcagtgagccaagattgtgccactgcattccagcatgggcaacagagtgagatgctgtctcaaaaaaaaaaaaaaaaaaaaaagaaagaaagaaaacaatactcatcactcccactccctgactacataaatctgaaccactggggagaagaatgagatgagaattggcttggagaacgagaattaaggaagcagaaaaattgcttttgaggagaattgatgagggtcttgtgtcactagaggtgggaaaagccgttctcaattgtcaccatgcttcagagtcacctggggagttttaaaaacatgccgatgcctgggttccaccccagaatttctgacttcattggtctgggtggggcctgagcactggactgttaaagctcgtcaagtgatgctagtttgcagccaggatagaggagccttgagttagcaaagggttgcgactgttctgatacagctgctctgtgtgtggttatttccgtaggtgattacctaaggaaacacacccagagaagcagatcctcagattagcctgcgaaactgtctcaggtctcctgcatcagaacctctggggtgtggggccctgaagttgtgggtcgacaaattcctcaggtggtactgatgctcactcaggcttgagatctggtacctgaggacttgaactgacccctagctaagcaaaccaataaggattggatttacacggcttggagaagggactcacggggttgttactataagaccctcctggtacaaactgcctgcttgctccctcagagtggtcagagccacagggaccaaagtgctgactgagttccaggaaggagagcgggaggactctgatccagtgacccacagggattgcatttggtgtgtcttcttgccagaggtgtaactgcccaaggggttcaccttgcccactgcctagacagagccaattcttcaagacagggatattgcaataatgagtaattcacacagagctggctgtgcgggagaccgcagttttattattactcaaatcagtctccccgaacattctgggagcagagtttttaaggataacttggtgggtcaggggaagccagtgagccaggagtgctgattagttagagatgaaaccacagggaatcagagctgtcttcttgctctcagtcagttcctgggtgggggccacaagatcagctaagccagtttattgatctgggtgggggccagctgatccaccaagagcagggtctacaaaatacctcaagcactgatcttaggagcagtttagggaaggtcagaatcttgtagcttccagctgcgtgactcctaaaccataatttctttttttttttcgagatggagtcttgctctgtcacccaggctggagtgcagtggtgtgatattggctcactgccacctccacctcccgagttgaagtaattctcctgcctcagcctccctagtagctggggttacaggtgcacgccaccacacccagctaattttattttttatttttagtagagacaggttttcaccatgttgcccaggctggtcttgaactcctgacctcaggtgatccgccctcctatggctcccaaagtgctgggattacaggcatgagccaccgtgcccagccctaaaccataatttctaatcttgtggctaatgttagtcctacaaaggcaatctagtccccaggcaagaaggaggtctgctttgggaaagggctgttatcctctttgtctaaattataaactaagtttctcccaaagttagttcagcctatgcctgggaatgaataaaggcagcttggaggttagaagcaagatggagtcagttaagttagatctctttcactgtctcagtcaaaattttgcaattacagaggctctcacccatgacacctgagtaagtgaattggttgtttctttaaaatttttattttaattggctgggcgtggtggtttacgcctgtaatcccagcactttgggaagccgaggcgggcggattacgaggtcaggagatcgagaccatcctggctaacacggtgaaaccctgtctctactaaagaatacaaaaaattagctgggcttggtggcgggcgcctgtagtctcagctacttgggaggctgaggcaggagaacggcatgaacccgggaggcggaggttgcagtgagccaagatcgcaccactgcactccagcctgggcgacagagcgagactctgtctttaaaaaaaaaaaaaagatatttttcttttcttttcctttctctctctctctctctctctctctctctttctttctttgagacggggcctcacactatcatccaggctggagtgcagtggtgcaatctcggctcactgcaacctccgcctcctgggttcaaaatgattctcctctctcagactcccaggtagctaggattacaggcgtgcgccaccacggctggctaatttttgtatttttagtagagacggggttttgccatgttggtcaggctggtcatgaacgcttgacctcaggtgatccgcccacttcggcttcccaaaatgctgggattacaggtgtgagccaccaccacgcctggtcaaaaatgttattttattttctgagacgaagtcttgctttgttgcccaggctggtgtgcagtagcatggttatgggctcaatcctgcactcaagtgaccttcccacctcagccttccaagtagctaggaccatcagtgtgcaccaccaagtccagctaatttgtaatttttttgtagagaaagggtcttgctatgctgcccaggctggtctccaactcctggcctcaagtgatcctcacgtcttggccttccaaagtgctgggattataggcatgagccactgcacctggagtaaaaggtttctgtagtctgaaaggtaaaataatttgaaggccatctgctatctgagagaaataacagcacctagggagagtggaagaaataatgtatcaaagaagccagggtgaaattgtgatttcaaggtgtagagagtttccaggccgggcgcggtggctcaagcctgtaatcccagcactttgggaggccaaggcgggtggatcacggggtcaggaaattgagaccatcctggctaacatggtgaaaccccgtctgtactaagagtacaaaaaaattagccggacgtggtggcggacgcccgtagtcccagctactcgggaggctgaggcaggagaatggcgtgagcccaggaggcggagcttgcagtgagccgagatggcgccactgcactccagcctgggcgacagagcgagactccatctcaatttaaaaaaaaaaaaaaaaaaggtgtagagattttcccaaaccaacattagacaaaacaaatggggatgcagcaaagaaaaggaagaagagacttgaaatctctgggtttaggtaacagatatgaggcgtttccagagagcttatatctggaccttctgaggaaacagcagtggtagagtattttggagacaccagggtattagcaggcctgagtatgccagttgtggggtttggccttcccccaggaatagtgtgcatctgactatacacagacccagcctaacctagaaatgtgcagtttttctgagcaacatgtgaccaagagcttgctcacaccaattaagcctagggactgctatccttctgctgattgctgtgggatgaatgatgtcaccagtcagaagatagctgagatgtctcactggtgacgtgaagtttaaagtagcaaactgagtggcaggtggaattttcgtctctttgtcagctgaaggctgtgtatgtgaaagaaaaaagaacacagaacagagttcctgaccgtaaattctaagattctaagataccagaaagataaactcctggtaagggatagaggaggtttatagggattgggagagatgcgtataataaggctttagaatggaaattttagaggcaaggagaaaaatgcctagataaaagtataaatctgggtattttggagactacatagcagagaataaaggcagagaggagttgctcagtaacgcatttggagaaaatgggatggaagatcagaaatgatgcttttgaactcttatctacaaatattacaagtaaggctaataaacgtatttgacctttttttttttttttttgtgagacggagtctcgctctgtcaccaggctggagtgcaatggcgcgatcttagctcactgcaacctccgcctcctgggttcaagtgattctcctgcctcagcctcccgagtagctgggactagaggcgcacaccaccacacccagctaatttttgtatttttagtagagacggggtttcaccatgttggccaggatggtctcaatctcttgaactcgtgattcgtctgcctccgcctcccaaagtgctgggattacaggcatgagccactgtgcccggcccgtatttgaccttttactgaaaggaggaaacaatttcataggcatcagcgatatttgattagaatatgataatgaaagagtatactttgttcaaaaatgatgatttgctagaagagctgggattcatgtagtacattaaagagagaggtacatacttgtttgaggatctgctatcataagggatgcctgccttctttgcataaggtcacatttagattcttttgattgcagtgagagggaaatttcagtacaccaagatccagtgagctgtcaagggtttcacttcccctttctccatttttcaacaaatgtaatgaatagtaccacccagtgctacttccagttttctgcctgcagttaggtttttttttttttttttttttgagacagtcttgctctgtcacccaggctggaatgcagtggtgcaatcaaggatcactgcagccttgacctccccaggctcaagcaattctcccaccttagcctcctgagtagttgagactacaggtgcacgccaccaggcccagctaatttttgtattttttgtagaatcagggtttctctatgttgcccaggctggtttcaaactcctgagctcaagggatcagcccaccctggcctcccaaagtgctggaattacaggagcgagccactgtgcccagccaacatatgagttttctattgcttctctaacaagttaccaccaattgagtggctgaaaacaacacaaatttatcatctcataattctggaggtcagaagtctgaaatgggtctcactgggctaatatgaagtagcactgtgtttctttctggaggcttaaggagaggatccatcttcttgcctttcccagcttctagagtctcatggacccttccattttcaaagtcagcagtaactgggagagtctttctcatattgtactactctgacattgacctttctgcctccctctttcatctttaagaacttttgtgattacattgggcccacccagataatacagaatgatttccctgttttgtcacttgattagcaatcttcattctgtctgcaacttttttctttttttttttttttttgagccagagtcttgctctgttgcccaggctgaagtgcagtggtgtgatcttggctcactgcaacctccgcctcctgggttcaagcaattctcctgcctcagcctcctgagtagctgggattataggcacccaccaccacacccagctattttttgtatttttagtagagacggggtttcaccgtgttggttaggctgactcatgttggttagaattcctgacctcaggtgatctgcccgccttggcctcctaaagtgctgggattacaggcatgagccactgcgcctggcctctatctgcaactttaattctcccttgccatgcaatataacatggctcacaggttccagggattagggggtggacatctttggggggccattagtctacctaccacaagtgatagcccagctttccaccggaggtggatgagcagcactctgaagtgataacttaaggtggattcttgcccaaattctaggcttgtaagttaaatctggttagtgaagtacgagcagaagggtgggaaatcattagtaacgtgtatgaattcactaagaacaagccatactctgctaacctcactttttggttcaattttaatttttttattcaaatataatatacagaaggaacagtgcaatctcataagtttatggcttaatgaattgtcactagttgagcacatgtgtaactagcacccttgagcccttcctatgctcttcccagtccctgcctctccaccccacacaaagggaaatcactattctgacttccagtagcattgattagttttctctgattttatgtaaatggatataatctatatgtacacttttgcatctggcttgcttattatgtttgagattcttctgtatttttgtctgtagtcgtagattgttcactttttttttttttttttcccagacagagtctcactctgtcgcccgggctggagtgcagtggtaggatcttggctcactgcaacctccacctcccgggttcaagcaattctcctgcctcagcctcctgagtagctgggattacaggtgcccaccaccacgcccagctaatttttgtatttttagtagagacgggggtttcaccatgttggccaggctgatctcaaactcctgactttgtgatctgcccgccttggcctcccaacgtgctaggattacagattgtttattcttagtgctgtttagtatttattcaatctactgttgctgggcatttgggttgtttctagtttttgactactgcaagggtgtaactatgaatattctacataaatatatactaatttgatttgaattgtttgatagcatcattagattgttagagcagaggcatgtgtatgcagatttcggagaggttcgtggcaaattctcatgatattcttgttgacaaggtagactagataaaaataaagtttggtagattcttagttggctgaataacattgtggaataatgacaaatacagaaaggtctacagtgatagactatacagctctgctgatcttagtcaacattttaatttttttttttttgagacgaactctcgctctgtcacccaggctggagtgcggtggcgcgatctcggctcactgcaacctccgcctcccgggttcacgccattctcctgcctcagcctcccgagtagctgggactacaggcacccgccaccatgcccggctaactttttgtatttttagtagagatggggtttcattgtgttagccaggatggtctcgatctcctgaccttgtgatctgcctgcctcggcctcccaaagtgctgggattacaggcgtgagccaccgtgcccggcctaacattttaatttttttattaaaaaaattttttttgagacagagtgttgctctgtcacctaggctggagtgcagtggcacaatcttggctcagtgcaacctctgcctcctaggctcaaacaattcccatgtctcagcctcctgagtagctgggaccacaggcgtgtgccatcacaccctgctaatttttgcattttccttttagtagagatggggttttgccatattgccaggctggtctcgaactcctggcctcaagtgatctgcctgcctcagcctcccaaagtgttgggattacaggtgtgagccactgctgccagcccatgtcaacatttatttatttatttatttatttattttgagacggagtctcactctgttgtccaggctggagtgtagtggtgtaatcttggctcactgcaacctccgcctcctgggttcaagcgattctcctgcctcagcctcccgagtagctgggactacaggtgcccaccaccacacccggataatttttgttcttttagtagagacggggtttcactatgttggccaacctggtctcaaactcctgacctcaggtgatcctccctcctcggtctcccaaagtactggtattacaggcgtgagccactgcgcccggccctagtcaacatttttagggtgacttcagtgaagactcaggaggtatgctgatcaaatttgcagatttcacaaaattaaagaagggatttgaactaataaaatcaagaaggaaaaatcccatatcatataagaataatgcataaaaactcagaggaaagtcactaagactaaatatgaagtcctgtatctggggggaaaaaatcactttttttgttttggagaaaggatcttactgtgttgcccaggctgcagtgcagtggtgcgatcacagctccctgcagccttgaccacttgggctcaagcgatccccctgcctcaacctcccaagtagctgggaccacaggtgtgtgccaccatgtctggctaactaaaaaaaatgttttgtggagatgtgttctcacaatgttgcccaggctggtcttgaactcctggactcaagcgatcctcccacctcggcctcccaaagtgctgggattataggcatgagccatcgcacccagctaaaaaaatcatttttataggtccagaaagaggggaggaaagatctcatcactttgaggtgggaaagaaaggagttgtagtaaacaatgatttcaggttgagactccgtagtcggcaacactgtctggagttttctgtgtggggtcttgcatttctggggaaatactgacacagtgaagtatatgcagtaaatgacaaagtgaaataaatgacagtcctgggatggtgaggggtctggaagccacatttgctccacaaggggttgtaaaatctgggttttagcctgaaggagtaaagactcaaggggacaggatgttcatcctttttgtttgtttgtttttagatggagtcttgctctgtggccaggctggagtgcagtgccgtgatctcggcccactgcaacctctgcctcccgggttcaagcaattcccctgcctcagcctcccgagtagctgggactacaggcttgtgccaccatgcctggctaatttttgtattttagtagagacaggttttcaccatgttgggcaggctggtctcaatttcctgacctcgtgatccacccgccttggcctttcaaagtgctgagattacaggcgtgagccattgcacctggcttttttttttttttttttgagacagagtctcgctctgttgcccaggctggagtgcagtggcgcaatctcggttcactgcaagctccgcctcccgggttcacgtcattctcctgcctcagcctcctgagtgtctgggactataggcgcccgccaccacacccggctaattttttgtatttttagtagagatggggtttcaccgtgttagccaggatggtcttgatctcctgacctcatgatccgcctgcctcagcttcccaaagtgctgggattacagcgtgagccaccgcgcctggcttttttttttttttttgagatggagttttgcttttgttgcctaggctggtgcaatggcgagatctcagttcaccgcaacctccacctcccgagttcaagtgattcttctgcctcagcttcccgactagctgggattacaggcatgtgccaccacgcctggccaatttttgtatttttagtagagacggagtttctccatgttggtcaggctggtctcgaactcccaacctcagatgatctgcccgccttggcctcccaaagtgctgggattacaggcgtgagccagcgcctggccgtgatattcatctttaatgttaagaagggccattgggtggaagaggatttagcttcattctgtgtggagacagaggaggggtctggcactactggtagaagctgggaggaagacgctgttggcttagtaaaaggaagagctatagatcactttattttattttattttttgagatggagtctcactgtgtcacccaggctggagtgcagtggcgtgatcttggctcactgcaatttctgcctcccgggttcaaatgattctcctacctctgcctccaagtagctgggattacaggcatgcgccaccacactcagctaatatttatatttttagtagagacggggtttcgccatggtggccagactggtctcaaactcctggcctcaagtgatctgcccgcctcagtctctcaaggtgctgggattacaggcgcgaaccaccgcgcctggctctatagatcacttttaaaatggaatgacgccgggcatggtggttcacgcctgtaatcataagttttgtgtgttacattgtgtgtatttaaaggtaatagtgcttacagaattgtgggtttaatgttctttttcaggaaatgtttcatttaggtgtctaaactaaacctgagcatctgatccagagtgggcctgcaagctttgttctgttctggatccacctggtctggtgctttctggcttttagttctagcgctgatgctgggccttaccactagaactagtctcctactcccggggaccgtatgtaggctgggtttgatgatccattcaggaacatctttttagatggttataggagtgacttctcttttttttttttgagatggagtcttgctctgtcaccaggctggagtgcagtggtgtgatcttggctcactgcatcctccgcctcctgggttcaagtgattctcctgcctcagcctcccaagtagatgggactacaggcacacaccaccatgcccagctaatttttgtatttttagtagagacagggtttcaccatgttggccaggatggtctcgatctcttgacctcgtgatctgtccacctcggcctcccaaagtgctgggattacaggcgtgagccactgcacccggccacgagtgacttctttgcagattctttttttctccccctggggtcaaagcaggagtgctgctgcaccgagtcaagggtcaaaggtgatttcaggttatcctcttatagacttggcccagtgttgggtggggattgaattgcccctagaggtagaaggggagggcatctctgcccttgaggttaacttgcagttgcctccatattatcctaaccccatggtcccctcctgtccttggccctgaagcaggaggttgggctccacttcaagagcagtgcacttagctgggctctggggccagtggtcagctgtatccgctgaggtggggacaaaaagccctgtcagcactgctgcctgccatacccatttcctgctcccacagtcaagaggccctggaggaagctaggctttgaggaagaggagggctagctctcttcaggcagttccctctgctccctggtttctttctgtaggattcccttcctcattcaaactgagccttctgtgctcagtacagagagcagatcagggctagaaggtgggtcagagaaatcaggctcaggagtgggggaggtgggatactggtggacaaagagagggatacaaatggatggatagagaagtagagaagagactgggcacgccacgccggtgactcacacctgtaatcccagcactttgggaggctgaggcaggcggatcacctgaggtcaggagtttgagactagtctggctaacatggcgaaaccctgtctctactaaaaatacaaaaattagctgggcatggtgttgaatgtctgtaattctagctactcgggaggctgaggcaggagaaccgcttgaacccaggaggcggaggttgcagtgagctgagatcgcaccactgtactccagcctgggggacggagcaagactgtctcgaaaaaaaaaaaaaaagaagtagagaagcaatagggattaaaatgtaaacaagccacccaggtgccatggctcttccctataatcccagttactcctcagatagctgaggtggaaggattgcctgaggccaggagttcgagaccagcctgggccacatagcaagaccccgtctctaaaaaaattaaaacagccaggcacggtggctcacacctgtaatcccagcactttgggaggctgaggagggcagatcacaaggtcaggagttcgagaccagcctgaccaacatggtgaaaccctgtctctactaaaaatacaaaaattagccaggtgtggtggtgggcacttgtagtcctagctactcaagaggctgaggcaggagaactgcttgaaccctggaggcagaggttgcagtgagctgagatcgcaccactgcactccaggctgggtgacagcaagactccatctcaaaaaaaaaaaaaattaaaacaaattagctgggcatggtggtgcacacctttgatcccagctactagggtggctgagctgggaggatcccttgagctcaggagttcgatgctgcagtgagctatgatttctccactgtactctggcttgggtgaaagagtgagatccccatctccaaaaaaaaaacaaaaagggacgggtgtggtggctcacgcctgtaatctcagcattttgggaggccgaggtgggcggatcacctgagctcaggagttcgagattagcctggccagtatggtgaaaccccatctctactaaaaatacaaaaattagccaggcatggtggcacacacctgtagtcccagctactcgggaggctgaggcaggagaattgcttgaacctgggaagtgggggttgcagtgagccaagatcatgccattgcacttcagcctgggtgacagagcaagactgtgtctcaaaaaataaataaaataaataaataaataaataaataagtcaataaataagtaaataaaaaaaaataataaaatataggccgggcgcggtggctcatgcttgtaatcccagcactttgggaggctgaggtgggtggatcacctcaggtcaggagtttgcgacaagcctggccaacatggtgaaacctcatctctactaaaaatataaaaattagctgggcatagtggcgcacacctgtaatcccagctacttgggaggttgaggcaggagaatggcttgaacccgggaggcagatgttgccatgagccgagaccacgccattgcactccagcctgggcaacaagggtgaaactctgtctcaaaaagaaaaagaaaaataaataaaataaaatataaacaagccatgtatttccatttcagaatctgctgtggtagcaggtggtgaattggttgcttatccctccttttccctgcctacatccctggacagaactgagaagaaccttgtggcacacagctcagactctgagtctgaactagagctagtcctgtaagcttattccagtttggtgttatgactcatggttaccctgcagggaatcataaatttgtatttggggatcccattttcctgacaatgtggcagcatcctttgtgtctggtgtttctacttggaaacctggctatgttgtggttatgagccagccacagagcctaggataagggcagaggttacaagctggggagaaggggcactaagctgttgagtggctggaggctggagtccagtggggagtaaaggatgggtgactggctgaggaggagtgacagatttgaaagatttgtggagggcaagatacagccactttggtcattttgtggggtgctgcacacttgtgtcttaaattattaacttagcactggggtggcctggagctgtgggtacatttttgcccagccctgtgataaggtttgttgtttattaggcagaaaggcaagcatttatataggacaggaatgtgccttctcaggaagagcagaaaggaacttgggcagtcagtagaatgagggtggtggtggaagggagggtgagagagagaagatggggcagctgttctgagaggccagacttccctgcttctcaggatgaagtagccagaatgtggtgaggccaggacaccacaaaataggaggactagcgacaccaaggccacaccactgccaggagaactcagagggtgtttctgactgtgttggtggcctgaagtaggcaagaactgtactaggcctcattctcttgactggtaaggcagggtgatgttgaccttgcccttggagcccttgggagaagggctttaaagttaagccctccttatagtgttccagttgctgagctgggaaggagggagcaatgaagcgattcgctatgctaccagtgggaagatctgtatttttttttccaactttcttctcggccacattctggggctactggtcaacctcacagcatgcgtgagcctcccttgttgaacttcttcaagtaattcaaattcaagtcgtagattgtaacttttttgttgggggagggataatggacttgagattctgataaaagctatgatccctttctaagaaaagatatgaaactttttcttaggtatgtctgtattcatatggacataacactttgaaagagaatttcgagcctcatggaggccctagttaagaaccctgataaaaggtacttttaaaacctgtacttctgagtagaaggactgggggaatgtgtgtggctcttacttctctattgtcccatcaggaaaaatgccctgtccccattctacaggaaccactcttagctgcaagaatctttccaagcacaaaagcaggcagctgagctgccaggcagtgggcaggaagtctggccttcatcctaatccttggccacacagcctgacctgctggctcagcattggataagtcacagcagaactcctcaaggttaacagtaataccacagagtcagagtgctgtgtcctggagcccatggggaatgggaggtaggagggagagaccatgacttttcagagccaagagccggaacaatcactaatcctgtacagttcccagttgcctcccactgctgtgattggacatttggatgtattttttatgtaagcagatctgcagtcactttgttttgtgtctcccatataaggtgctgggggtggggagtatagaggcctttgtatgataatggtgaggacattctggggccccgagggttccagtgcagagcaggtcagagggtctgtctttggctgaagggtatatatatcttggtgactggtactggaaaaattgcttgggagtctaaggccctagggtggtaagggtaagtcaccaatcagtattatttttctttcaggtctcttaaccttcattaactgtgcctatgtcaaatggggaaccctggtacaagatattttcacctatgctaaagtattggcactgatcgcggtcatcgttgcaggcattgttagacttggccagggtaagaaataatattagtagcaactaatcttttttaagcattttctgtgagccgcactcctctaagtgctctttgtgcattatctcatttcttactataaccttattcggtgggcactattattattctcattttatggatgaggaaacagcctgcagaattaagtaccttgggccgggcgcagtggctcgtgcttgtaatcccagcactttgggaggccatcgcgggtggatccatgaggtcaggagttcaagatcagcctggccaagatggtgaaaccccatctcgactaaaaatacaaaaattagccgggcatggtggcaggcgcctgtaatcccagctactcgggaggctgaggcaggagaatcgcttgaatccaggaggcggtggttgcagtgagctgagatcacgccactgcactccagcctgggcgacagagcgagactctgtcccccccccaaaaaaaaaaaagaattaaatatcttgcccaagttgctaccggtaagtagaggagttgaaatttgtatccaggacaactgacccaaaagtctatcctttaacttccatgcacgctgcctcccagaggaggctgatcttggcaaagggttgacagccatgccctgggagctgcctttggcagattgtgataggaggcaggaatcaggcagcctgcagagcagaacagaactgcattgtttctattctccagcttttctgctctatggtggtttcttatcctagaaagctaccctggacccttcctgtcaagatccccatctatgtcattaggatgcagggcattctggtctatctctatagacgtctctcttctgtttcctgttcccttactggtactcttgctgccaaaggtgttgtaggccacttacctgctattatattaccatattctgtcagtcctttacttgaccatcttgaagtgggagaatgagccactaatcccctgccttccaatgttcttgggttccaggagcctctactcattttgagaattcctttgagggttcatcatttgcagtgggtgacattgccctggcactgtactcagctctgttctcctactcaggctgggacaccctcaactatgtcactgaagagatcaagaatcctgagaggtaggtactgcaccaccaactttccatagcagtgatagccatcatttaatgagctcctactacgtgccagacagcataccacaaccactatgaggttaattttaccagcctcattttaatagatgggaggcctgaggctcagagaagtaacttgtctatgatcacagtaacagggctaaaatatgaacttactcatgtatgctttgtaaatttttaaaggcatttttacatttgttcattaatttctgcattaattaaagcaggttgtattatatgcttatgtatgtttttaaaacagattttccttgatagatattttatccacccttatccccacatacatagctttgggatatagacttccagaaaccttcctgtgtttccctctgataccttccttgtttcctaaattcatactgacattgtggtatagtttcagtcattcaattaagtcaccctaccattattgctctgtagtctatatatagagtgaaaagagaactggacaggaagtcaaggacctagagttgatctttccactgacttgttggctaaccttgagggagttgcccggccatctctttgcctgtttccttatctgtaattgagggggttaaattctgtgatctccatggcctttcctggctctaaaattctatgattctgggaactaagatttgccagggagtggagtttcggtaaaatgttttttgttttttggagagagtcttgctgtatttcccaggctggagtgcaatggcgtgatcttggctcattgcaacctctgcctcccaggttcaagtgattctcctgcttcagcctcccaaatagctagaattacaggtgcctgccaccacgcctggctaatttttgtatttttagtagagacatgggtttcaccatgttggccaggctggtctcgaactcctgacctcaggtgatccgcccgccttagcctcccaaagtgctgggattacaggcatgagccactgtgcccagctttctgtaaatgcttaagtgaaaagactcacaattcttataccaataaactccttttggcttgagaaacagaagagcactcttggtacacaactagtggtaacgctatgggaacagagataacagaagcaggatcaaggcctgggtggtacttccacctaccggacagaaactgcatgactctatttgcagagtatttgccccactttgtgctttttttttggcagccttactgttaaggatgcttataaagatcatggctttattgggctacagggaccttgagagctctttgcatctttcttttgcccaccagttaggatggctcctgaggttctcaaactgaggaaggggtgggcagacatatcttccaggctgctagtcagatacatacacttctcttcctactgaaggcctatcttattctctgaagatgttaaatttcacaatttgcctccataatttctttttatatttctcaaccttgaggcaaaattgccaatgttgataatcttagagatggaatcctgacaccaaaagatctttggggtataaaacaaaacaacctcccattttcctgtgcgttatgatgctggggacagtctttgttaatcccccccgccctgcttttttttttttttttttttttttagacagggtctggctgccttgcccaggctggagtgcagtggcccagtcatggttcactgcagccttgacctccccaggctcaagtgatcctcccacctcagcctcccaaatagctgggattacaggcatgcaccaccacgcttggctaatttttttttttttggtttgtttttggagacagagtctcgctctgtcgcccatgctggagtgcagtggcacaattttggcttaccacaacctccgcctctcgagttcaagtgattctcgtacctcagcctcctgagtagctgggactacaggtgcatgccaccatgcctggctaattatttatatttttagtaggaacagggttttgccatgttggccaggctggtcttgaactcctgacctcaggtgatccacccggctcggcctcccaaagtgctgggattacaggcgtgagccaccacgcccagctgcttggctagttttttgtagagacagggttttgccatgttgcccaggctggtctccaactcctagactcgagccatctccctgcctcagcctcccaaagtgttagtactacaggcatgagccactgctcccagctgcacagtcctgtctcctaatatgatattcctttcccctaatgttctttagttcttaagtgttcagagcttcagccactatccagggcaccgtcaaagacaaatgcattgaggaaatgtagcaacagtctccatccctggaaagaccggtgtggcagggagagtctaaggattaaaggagagatagggatatgactgtgggactaatgtgcattttattctatttggctgtaggaacctgcccctctccattggcatctccatgcccattgtcaccatcatctatatcttgaccaatgtggcctattatactgtgctagacatgagagacatcttggccagtgatgctgttgctgtggtaaaggattttcactagcagaaggttgagggtgtcttgtggggtactgggtatattctggctcttgaaagtcctggaaagggggtagacagccttgaaaggagttcatttagaataccgggcttgcaagaaggtcctgttaaccccactgtggaagaaaggttggaatacctaataaggggaatctgggggcatgcccatccatgtctttcatcccttttagatcctgctaatgactcttccattcttttcccttagacttttgcagatcagatatttggaatatttaactggataattccactgtcagttgcattatcctgttttggtggcctcaatgcctccattgtggctgcttctaggtaagagtggcaacttttgtgaggggtgtatcatcaaagggctatgcagtggacagaacttacaggacccagcctttgattacttgtgttctccaaccgataccacaacctctttcttcttgtttctagcagaagcctgcagttgtcattaatcttaatactgagctccagtccatattatccaaatacttttgaaggaagggatggcagagagggagggccatgtggcaggtgaaccaggctgcaccgtgtccaccaattttctcagcttctcctatcttacctaacataggcttttctttgtgggctcaagagaaggccatctccctgatgccatctgcatgatccatgttgagcggttcacaccagtgccttctctgctcttcaatgtaagtgaactcaaggatgagactgaaagccagattgcgggggaaactttagtaacagcagaagcgactgttctagcttcctgaaagctctgaaagattccaatagaaaaactattggtggatcagaatgttcaccacgggcaaggcactatgctaaccgctacaggggaaatccaaatgctctaaggaatggtacacctctgctctaagataaggcaaaaagtacatggaatacactgtaatgattgattgccatgacagatagtgagtgatacggtgtttaagagaagaaacgatcacttccatgggagtagagggtgaagaattacatctagaagtgtgtgtgtgtgtgtcttaaaatccaccaaagtgttctcagaaaaaaaaagtgcatcttgatggctagggttgcaaatggtagagatgggctttaggtaggagaaatagcatcagaaaatcctgtgataaagcagtatgggttttaatacaggttgagtatccctaatctgaatatccaaaatctgaaatgctctaaaaatctgaaactttttgagtgctgacttgacactcaaaggaaatgctcattggagcattttggattttcagaacagggatactcaacatgtaggaggagataagagcgggttattgtaggttggagccattatggaaagggtcctatgcaagacttttgagggattgtttcgagcttgctttatacagggttaacttgaagaatgggttgaaaagccagttgagactactgacttataagagaggggataaggtactgaaactagggtgttaaagggattaaaaccagaagaggaccaggagactttgaggattgacaggggatggatttctggggtataaagggagtgaaaagcctttggattaacaaaggccctgagaagagctgacttaggctcacgcttacagggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaaggtaaggcaactccatcctacctctgctccacctgaaacagctggagttgttgctacaagggactatgacaaagcactttatttagaaacctttgcctgggacttggtcgttagtaatgtgttgaaattaaaggtatggaaagaaggctcagtgcgctaatccttatgggaggtggggttattttagctgttaagaatcctgagttgtccactccagttatgtttcctgtgcccttagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtgggtaagccgtgcatccttaagtccgctcagctattgcagagcttggtttttgcctttttctgtaaatccagcctccaaagacatctttgccttagccccttcttatgaacccttcggcttagtggaatcactcccctcacactgagttccattcagtgacacttgaactcagcccagctgacctcttctcaattccaactcaaagttctctttgtagggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaagtctgagtggcttcattttatatagtatctatctctaggacagctcccattagcctagaaacacaaagactaaaatcaatcttatgcttgaaagtatatccatcttttctctctcaagctagctgctgaaggctgataaaccaggctctacacaaaggcagacaacagaacacttaaactgctctagtcaaatgttggattgttacataaaaatgacatgaacttcctttttgagacaggatcttgctctgtagccaaggctggagtatagcagcatgatcttggatcactgcagcctcaacctcctgggcttaagctatcctcccacctcagcctcccaggtagctgggactatggacaagcaccaccatgctcagctaactttttagcagagacaaggtctcgccatgttgcccaggctggtctcaaattcctggactcaagtgatctacccacctcagcctcccaaagtgctgagattataggtgtgagccactttgcccagcctggaactttcattcttaattatcactaagaatttgcacacatctacttcttgaaatttttaaagtaatcttgggatcaagaagtgcggttactatatttagatacaatctcaacattcaacttatcagccacacctctagactgcaatccaaatgtgcatagaacaacacatgcatgggttggaagtttaaactgtttttttttttttttttttttttttttttttgagaaggagtctcactctcttgcccaggctggagtgcagtggcgcaatctcggctcactgcaagctctgcctcctgggttcacgccattctcctgcctcagcctcccaagtagctgggaatacaggcacccgccgccatgcccggctaatttttttttttttttttttagtagagacggggtttcaccatgttggccaggatggtctcgatctgctgacttcgtgatccgcccgccttggcctcccaaaagtgctgggattactggcgtgagccactgcgcctgggtggaagtttaaacccttaatgccaggttaaaacattatattttccaaggccatgggccagcaaaagcaatcatgactcactctattcttgttttcttttttttttgagacagtctccctctattgcccaggctggagtgcggtggtgcgatcttggctcactgcaacctccgcctctcggattcaagcaattctcctgcctcagcctcccgagtagctgggactacaggtgtgcaccaccacgtgtggctatttttgtaaaacagcagagatggcgtttccccatgttggccaggctggtctcaaactcctgatctcaggtgatccacccacctcggcctcccaaaatgctgggtattcttcagttttctgaagtgcacactcatttccctgttcaataagtatcaggaagcagcatgtagtacagaggtttactaactctgtgaatgggaagatcacttggctacccagtgctctcttataaacataagtacaagagtgtttcatgaaatccgtttttaaaatgaacatctctgtgtgccacagttcctaggactggggcaaggacacagtgtcaagtcttgttttgaggatgagtctctgaagagacagaattcctgccagaatgcgcacagaacataagtcagccaagtgtgtcgtgccagggatactttgactttggtttgctgctgctgctagggatattgggagggttatcctttccaggttgtaggagagggttgtgggtaaaggtctgtcgtaaaggacctgaggggagaagagaaaacaaatttcaacgaagaacagaaaggaagaaacaaaagacagaatttggcctgaaaggactatttacccctggctgctagctccaactgattccgcatgcgttgttcacgctctcgcagctgacgcgtcatttcagcatttttccagcctgtgtaaagagaagcaagagagtcagttgcattcctatttttag

SEQ ID NO: 12316 - DNA, 39243 bp, Human
catgggcgggcgcgccgggagcggggccggggctgggccgcgttctgtgggagccgaaccctgtgggtcttcgctgccgccgtcgggagcgggatgcggcccagaaacagcgcggggctggccgatcggggccgcgcgagaggcgctgcgggtgagggggggcgccacgaggagagagggacctcgagcgtgagggccgagtgtgggagaaacgctgtatgggtgcgagccccggaggctgatggtgaccgcgagggagccagtcttggggtgtgctggcgacgcggcgagtgtgagggagaccgggggtgtgtgtggagagggaaaccccaggtgcgagggtgaccgggacgctgagtgcgcgggccgcgccgcgagcgtgagactgtgcgacggtgaccctgagtggggctgtgactgcgcctccgactgcaggacggagaacctgtgctgtgtggcggccgcggtggggcaaagaaagacgcgggctcaggacctcaggagccaggcttcctggggctgtcgcaagaatgacgattatcattttaaaatcagtccttttactttagagaatgccgcaaggttttgtggcgtgctggagcctggagcgttgggctgctggcgctggggaacccgcgtgcccctggtgattatggctcttttgagcgtccctatagcctgtcatcttgtgtgactatctctcctgaatgtggggagatagacgtgaaacattctgaaaattctttgctgggctctaagcaaacatgttgtgtaatggtcagtataaataggaatcagggtgtcggcgaacacgtttttgagtacctcttgtatgccctgggcttggtgacacagttaaaaagaattcagtctctgcccttgataggggaaaaagccagggcagctcatctcgcagggcggctgttcagtgcccagccatccggggcttgtctctcagaactgctcccagatttcagatctgggaggagcagacttgaaaggctgtgagtacttccttatatcagttccacctctttttggtggcggtgaggccttttggggacctgcccaggctgcctgcattactcaggtcccatgtgtgctgcgcagacggcttttgcttcccaactttgatctcagatcgttattcaagtcgttacactggagtttattttcctggcaagtgtgtggaaaaccaccagcctgattttctcctctcttcctctccttgtcctccttccctatttggccgtggatgtatttttattgcatataccggttttatgatccccatctccctggaacttcttagtagaagaaatttcctgacctttgtgcttcctgctgtaatttcttggatgtatattagtttctaaaaaagttatgcaggccgggcgcggtggctcagtcctgtaatcccagcactttgggaggccgaggcaggcggatcacggggtcaggagatcgagaccatcctggctaacatggtgaaatcccgtctctactaaaaatacaaaaattgagccaggtgtggtggtgggcacctgtagtcccacctactcgggaggctgaggcaggagaatggcttgaacccgggaggcggaggttgcagtgagccaagattgcgccattgcactctagcctgggcaacagagcgagactccatctccaaaaaaaaagaaaaaaagttatgtaaacggtgcccacgggacctggggccccagagctgcctagacttacatgatttaatgtgacaaggccagttctctgacaggtttgggctggctacttcagttatacccaccctgtgggtgtcatggaacctgctagtaattaggactgcccctgccgggcatgtaaaatttagattttacaaggaaatatcattctgctgctttcttggttaattaaaaataattacatatatatatatatttaaatcagctttctcaggttaaaagagttcattttttgatcagttccctcccactctttgttgcagagtttatgtggccgaggcagacaagtggaattaggccttgctgcaggggacttcatttccttctcagtactggacccatttatgaggaggtggcttatgaaagtgtgatgttcgcgtatttcttgacaggtgaatattgttgcgctgtcttttcttttgtttgtgtgatttacaaagagtttttacttgtatacagtgtgaatacaatactagtaaacagaatggcttacacataattaacaactctttagtattacatattaaataacactgtaatttattataaaaataaattatacatttatttatattacaattctttataaagagtaattgtggtgggttttttctttttttttggagacagtgtctcactctgtcacccaggctggggtgtggtggcgcaatctctgctcactgcaacctctgcctcctggattcaagcgattctcctgcctcagcctcccaagtagctgggattacaggcgcccgccaccatgcccagctaattattgtatttttagtagagacggggctttaccatgttggccaggctggtcacgaactcctgagctcaggcaatctgcccgtctcagcctcccaattgtggtggatttttttttttttttttttttttttgagaaggagtttcgctctcattgccctggcggagtgcaatggtgcgatcttggctcactgtaacctccacctcccgggttcaagtgattctcatgcctcaacctcccgagtaactgggattacaggtgcccaccaccatgcccggacaattttttgtatttttagcagagatagggtttcactatgttggccaggctggtcccgaactcctgacctcaggcgatccacccgcctcagcctcccaaaatgctgggattacaggtgtgagacaccgcgcctggccataactcagagagttttataagaaaaagtcctctgtgttttcaccatagttaagattttgattcaaccagaggggggaataaaaagattttgatgtatttctctgtgatatagcaaaatattttttggtcttcagcccgtttcctagcatacaactcctaaaatacttagaaagatcaaagtaatgtctttttgtatgctgatggctggtggctggcagcccctagaaagcttcaggatgggggctggtcactggaaagaccaagtcaggattagagggttgggactttgagccctacccccaacctccggggaggggagaaaggaggagggtgaggttaagttgatcactaatggccagtggcttaatcactcatgcctatgtaatgaagcctctataaaaacccaagaggctgggggtttggggagcttccggatagctggacatgtggaggttcctggatggtacttctccctgggaggacaaggaaagtctgtgacccttcccccatatgtggctctgcaaacctcttcatctgtatcctttgtaatagcctttataatatacaagtaaaggtaagtaagtgtttctctgagttctgtgagccgctctagcaaattaattgaactgaaagaggagtcttgggagccccaacttgaaacagttcggtcagaagttcaggaggcttggatttgtgccaggtatcctgttggggaggggcagtcttgtggaactgagcccttctgctgtgggatctgatgctgtctccaggtagatagtgttgggattgaactggaggacactcagctggtgtccctggggagaaatgattgcttgttagtggggaaccctccccctccggcatttggtcacagaactcttctgtgttgattattgtggtgtgagagtacacagtaaaaatggttttgagtttttccaaacattctcaatagcattttttcctttagtcattacaaaaattttggtttcaaatccactttgtaaaacttcctttgtaatcgagcttttcccccctttcatcccgttttctgatgtaattgaattgtgataaattcatttattccaaaaattgcttgtggcagtttcgtggttaaattttcatggggaaattttggtagtctgttaaattcctttattacctgctgcaggagactgcaggaatttaaaatttttaaaaatttttttgttggctgggtgtggtggctcacgcctgtaatcccagcactttgggaagccgaggcaggcggatcacctgaggtcccaggagtccgagaccagcctgaccaatatggtgaaaccccgtctctactaaatacaaaaaattagctgggtgtggtggcgcatgcctgtaatcccagctactcggaaagctgaggcaggagaatagcttgaacccaggaggcggaggttgcagtgagccaagatcgcgtcattgcactccagcgtgggcaacgagcgaaactccgtctaaaaaaaaaaagagcaaaaatacgtattaaaaaatatttacctaggctatttgatattgccccacaggttgatgttctgttctattttttcactttctccattttgacccttttggttttcatctcactgctaaagttccacatttgtttctgcatgctgttcaactttttcagtagaaccttaaatgtatcaaacacaattattttaaattccttgtttgatgtttccattatctgggtcatctctcaatatggtcctattgattacttttcctcttgatagtgggttgtttttcttgctttttttatgttgcttgtaacttgttactgattgccagataccgtgtgtggaacagtagagactgaggtatatagtatttattttgggaactgggtacagctcttctttgctagactgtttgtatgggagtttgaactcctagtcaggagacagtagtgtttgggtgttattgttgctatggttacgttaggtgcaccaatggcttcaaattcttctcatgtttccttgccagcttacggttggtttgcaggagggaggctttttctcagtggttatcctccatccataccctcagtttattagccaggcatggtagtgcacacctgtagtcccagctacttgggaggctgaggcaggagaatccctcgaacccaggaggtggaggttacagtgagccaagattgtaccactgcactgcagcctgcgtgacaaagcaagactctgtctcaaaaaaaaaaaaaagaaagaaaaaaggtctcactcggtcatctcactctgtcaccaaggctggagtgcccgtagtgccatcatggttcactgcagcctcccaactcctgaactcaaacttacctcttagctttctgagtaaatagctggggctataggcgtgtgccatcatgcctggctactttttaatttttttttgtagagatggggtcttgctatgttgcccaggctagtctcgaactcttggcctcaagttcctccagccttagcctccagagtagctgagattacaggtgtaagccactgcgtccagccaccctcagctttaggatttctctgtgcacctatgcctcagtgcacagtctcagtggtagactactgttgcttgttcctgggtgcttgctaacctggtggtagggagtagggatttctctgttgtctggttcagcctcagtcttaaagcaggccctgtttgtttccctgggtcttgggagtggatctttctgggtgctcctgcccttttcccaggagaaagacacctccggtggtcttgcccagaatttcctacccctcctccaggcatagaggttttttttttcttttatcctgccccagctgcctcaggagtgacagagtttgctgccctttcccaggggtttatggtttttattctttagaggagaagggtataggttggcctttgtattttccctcccataagccagcactaccaagagaggttttctcaggttacttgcccagtatttcttctgagtaaccactgaggtctatggaaaaaacctgagtgtctgtggctcttactaacccacacttgacatttggtaatttttaaaaaaatttacttgaattcttctgactcacctaaatggtggtctcatctttctcccactgccacaggtgagccagaccttgtatctctctatctccctggaggtggctgtctttccatcagtttcaatctagttggttgccctgtaacttcagctttctgatggctccaagaaaaattgttgtttgtcactggagtgggaatgtgctatccatcctgagtggaagctggaagttgaggactttccattttatattggatttttttttttttttttgaaacagtcttgctctgttgcccaggctggaatgcagtggcatgataatggcttaccgcagccctgacctccttggctcaagaaatactcccaccttggcctcccaagtagctggcatgtgccaccgtgcctggctaatttttgtattttttgtagagatggggtcttgctgtgttgtccaggctggtctcggactcctgggctcaagcaatcctcttgcctcagcctcccaaagtggtggattacaggtgtggaccactgtgcctggcctagttttttcttatttcatttttttatagagacggaacctccctatgttgcccaggctactcctgaactcctggcttcaggcaatcctctggccttggtctcccaaaatactaggattataggcgtgagtcatcatgtctgctcccattttatttgtgctttttgttgtttgttttttgagacagggtctctgtcacccaggcgggagtgcaatggtgtgatcatggctcactgcagcctcaaccttcttgggctcaggtgatcctcccacttcagcctcctgagtaactaagactacaggtgtgtgccaccatgcccagctaacttttgtagttttttggtgtagacagggttttgccattgcccaggctggtctcctgggctcaagtgatccacctgctttggcctcccaaagtgctgggatcacaggtgtgcaccactgtgccctgccaaggtgaagtttagatatggagagaaggtaagggatggccctggggttgtatgtgtagccaagccagcctgggacttagtcatgtgctcttgggagctgctagggttacatcacaattttgctcttgggtgtttagcaaagaggtaggaactttaactacttttgccaaggacaggctcttgataacaattgcatttttcttttctttttttttttgagacagagtcttgctctgtcaccagactggagtgcagtggcgctatcttggctcactgcaacctccgcctcccaggttcaggtgattctcctgcctcagcctcctgagtagctgggactacaagtgcatgccaccacgcccagctaaatttttttgtatttttattagagaccgggtttcaccatgttggccaggatggtctcaatctcttggccttatgatctgcctgcctcagcctcccaaagtgctgggattacaggcgtgagccactgcgcccagcatgcattttgttactgaatgaagataaagaagtctggcatggtggctcacacctgtaatttcagcacttcaggaggccaaggtaggaggatcagttgaggccaggagttcaagaccagcctgggcaatgtagtgaaacactgtctctacagacaaattaaaaaaaaaaatacataaataaatagctgggcatggtggcaagcacctttagtcctagctactcatgaggccgagatagaggactgcttgagcctaggagttggaggctgcagtgagctatgattgcatgattgcactccagcctgggtgacaaagtgagaccttgtctcttgaataaaaaagagagagagagactgaaagagaaaaaagtcttatctgccttcagttttgtgtgattctgctactctccttggctgaaggagtccttaaccttccagcaggaactttgtctttcattcaggtgctgcgactgaaattctaggcatgaggtcttgtggggctgtgactgtgccccacctctctaaataaggccactgggtagtttcgccagtgtatttgacaaacctgataaagccatatcagcgacaccagtgccaggttttatgaatacaaagggaatacctagtaagctcaatccctcctcccagctagagtctgatggaatagggcgagctgtattggtcactggggtcagatttctctgcttgtctccatgttgacttgggtagaaaaggcatcctaggtctctttgcacctgactcttatgtgagactataggctccccagctgtgtactggttttgttctaatggatgcctgggctcacctgacaggcacatgaaaacaaatatgtttccaggtgcctgcacaggaaacctgcatggcttggtgccagagtgagagcaaaagtggtgctgccttaaagctcagcctcactgaagcagaggtaggctgccttcactcctgggactgggggaaggcttcactagggcctaggaggagcttttttacttggtctcaggtccagacttgaaggggtttgggacagggaaggcaggagttttgggtggggactgtggagatcagcatttcccctaagaactactcactcttgactctctgtggtttccttgctctgagctccatgaggccagattcgggcacatcacatacacatttgttgaacagataagagacttctggaaagatgatgtgcttgccgatcctgttcctattgctgattcttggaggttatctctgtgaccttaaaggactaactgttacgtgggtgggaatcaaatggcccaccagatttcttctgaagatgagatgggatcaaaggatcagaagtgtgactggcacaggagttgagggagggagaagatcacgctgggtgcagggtcaggaaggtgcttattttcctttgatagattctgggtccttcataggtaggttaatgtggaatccaacatgaggggcatgctggggaagaaagcaaatacaccagtggcaaattagccctgggttgggatgcccctggatgtcctttctctaccctgtcttattacgtaacccttctctttcgggtactttggaaaaagaaagatgtggaatgggcaagcagcaacatgggagagtgaggtaggtgttgcagacacagtgatacccaggcatgtattttttttttttttttgagaccaagtcttgctctgttgccaggcagtggcgtgatcttggctcactgcaacctccgactccctggttcaagcgattctcctgcctcagcctcctgagtggggattacaggtatgtgtcaccacgcccagctaatttttgtaagtttagtagagacggggtttcaccattttggctaggatggtctcgatctcctgaccttgtggtccgcccgcctcggcctctcaacatgctgggattacaggtgggagccactgcgcccagccaggtgtgtattttaatgagggacttccccttggtttagtcactacaatgactaaacctgtcttagcatcttcctcgcccttcccatcacctcctcatgttctgtactggcctgagagtagctgcagatgtctccatgtcttgctggacattgcagaagtcccagtttacattgggtagaggtgactgggcaggattacctgggtatggacagtgagaagccttttaggctggtgatgactgtgtaccaggtgcagggactctggtcttctctgcagggcaggtttgtgggttttaagctggtgagaacagagcagaaatctataactcaaggagaatccaatcgttggacaaatttaatgccagcctattctgggctgcaggacaggtatttgtcatcagaagtcattatcacatcatgcgtgagctctcatggtgtctttcttgggagcagtgaaggtctacccacttctatttccctgtgttctatggtgggaactgagacaggcctattgtagttagggctgtgtgcatggcatgctgtccctaaataggaagtgggcagggaaatctggtctaaatagagcctcaccagctcctgccctagactgacatacttgtattctttgccaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtaagtgggggctgagattgggaggatgttggggggtggggggtactataataacggtactttaggccgggcgcggtggctcatgcctataatcccagcactttgggaggctgaggcgggcggatcacctgaggttgggagttcgagaccagcctgaccaacatggagaaaccccgtctctactgaaaaaacaaatatagctgggcgtggtggtgcatgcctgtaatcccagctactcgggaggctgaggcaggagaattgcttgaacccaggaggcggaggttgtggggagcggagatcatgccattgtactccagcctgggcaacaagagcaaaactctgtctccaaaaaaaaaaaaaaaaaaaagatactttatatttgaatagcatattttgcattttggaggggagggaggcttcttaccttttgaggaagtaattttaccagtcatttggtcctgagagataagtaagcataaaggatggggatgggagaagtttgaatctgttcgtggcttttggtgcctcatattcctcctctcttggctgcccttgttctgttttgtggtctgtgtgacaggttggggcatgtcttttatttgtcttgacagctgtttcgattgaagtcaacattgctagttgtaagcccagaaaaaaaccccaccagtgttgaggcctttattctgttgctaaaggaaaaaaaaaagagttattttatttcccagatttttatcttaaaccagttaaagtcatcagtgagaaagtaggcttcactagactgtgggagtcctacggtgttaaacttcaggcccacaggtccctttcctgtctgccattgctgctctttgcggcttgctctgagcagcaggtacaacaaaacaccttttcttcctagtgtatcagacttctttacactgactttgtaaacaagctctgcctgcggccacatttgagtttctgcagatagaacctgagagatctcagttgatccctctttattttcctttttctcttatggggtagtaaggagaaaagattgctgtgaatttacccagccttgcagaactagtgttttaaatgagaaagacccagaattctatgttccttagcactgtactgccagaggtacttaataatattctgttctttccacatctctgcttgcaaaagcattggcagtatatgcagtttatccagtgttaaaaatagcctgagagtaccttggagttagcaataaaggactgtagaatacccatgcctcttgactttatggaatttgttaaagacaaattaaagggaaaacgctccatattccttgggatagtgagggggaaacggatacccttaggattagggaaggcggctgctcagctgtatgtctgataggctttggctagggagactctggtctgactgagctttctaaaaaagggaataattttctgattataaaatatgtttattaggccaggcatggtggctgacgcctgtaatcccagcactttgggaggctgaggtaggaggattgcttgagctcaggaatttgagaccaacctgggcaacatggtgagaccctgtctctacaaaaaatcaaattagctgggcatgttggtgtgtgcctgtggtcccagcaattcaggaggctgagatgggaggatctcttgagcccgggaagtcgaggctgcagtgagctatgatcacgccactgcactccagcctgggtaacggagcaagaccctgtctccaaacaaaacaaaacaaaaaaaaaacctcacaaagcatgtttatttagaaaattaaattactcttaagtcatccaaaatctaccaccaaaagaagagtacttttttttttgagatagagtcttgctctgtcacccaggctggagtacaatggcatgatctcagctcactgcaacctctgcctcctgggttcaaatgattctcttgcctcagcctcccgagtagccaggattacaggcgcccaccaccacgcccagctaatttttgtatttttagtagagagggggtttcaccatgttggtcaagctggtcgagaagagtacttttatttatttatttatttatttatttatttatttgagacggagtcttgctctgtcgcccaggctggaatgcagtggcgctatctcgactcacaccattctcctgcctcagcctcccgagtagcccggactacagtaggcgcccgccaccgtgcccggctaattttttgtatttttagtagagatggggtttcaccgtgttagccaggatggtctcgatgtcctgacctcgtgatccgcccgcctcggcctcccaaagtgctgggattacaggtgtgagccacggcgcccggccttgtattattttttaattaaaaaaaattttttttgagatggagtttcgctcttgctgcccaggctagagtgcaatggcattatctcagctcatcgcaacctcggcctcctgggttcaagcgattctcctgactcagcctcccgaatagctgggatttcaggcatgtgccaccacacctggctaattttgtatttttagtagagacagggtttctccatgttggtcaggctggtcttgaactcctgacctcaggtgatctgcccacccggcctcccaaagtgctgggattataggtgtgagcccccatgcctggcctattattattattattattattatttttcttttttgagaccgagtcttgctctgtcgcctaggctggagtacagtggctcgatctctgctcactgcaacctctggctcactgcatcctccacctcccgggttcaagagattctcctgcctcagcctcccgagtagctgggaatataggtgcgcaccaccatgcccagctaatttttgtatttttagtacagacggggtttcaccatgttggtcaggatggtcttgatctcttgacctcgtgatccgcctgctttggcctcccaaagtgctgggattacaggcatgagccaccatgcccagccataaataccttttgaggtcatcttttcttgtaggttgtatactgctttataattttttttttttttttattgatcattcttgggtgtttctcgcagagggggatttggcagggtcataggacaatagtggagggaaggtcagcagataaacaagtgaacaaaggtctctggttttcctaggcagaggaccctgcggcctttttttttttttgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcaccgggttgggggtaaggtcatagatcaacagcatcccaaggcagaagaatttttcttagtacagaacaaaatggagtctcctatgtctacttctttctacacagacatagcaacaatctgatttcgctatcttttccccacatttcccccttttctattcgacaaaaccgccatcgtcatcatggcccgctctcaatgagctgttgggtacacctcccagacggggtggcggccgggcagaggggctcctcacttcccagaaggggcggccgggcagaggcgccccccacctcccggacagggcggctgccgggcggaggcgccccccacctccctcccggacagggcggctggccgggcaggggctgccccccacctccctcctggatggggcggctgactgctttataaaattaaaaaaaaaattaatattggctgggcatggtagctcatggcttttgtaattccagcactttgggaggctgaggagggaggatcacttgagcacaggagtttgagaccagcctgggcaacaaagcaagaccccacctctaaaaaaaaaaaaaattaggcatggtggcagtggcagtggtgtgcatctgtaatcctagctactcgggagcctgaggagggaggatcccttgagcccagaaattcaaggttgcagtgagctatgatcatgccactgcactccagcctaggtgacagaatgagactttgtctcaaaaaaaatttcatatttaatctctttcatcaaatactcttagaaaacatggtttgaagatacataagcaatctccaggcagtatagtatagtggttaggattgcaggcctccatgccagactggatttaattttcagctttatcattgaccaactgttgatcttggggagttaactaattgctgcctcgattttctcttttatttttattttttgagacagagtcttgctttgttgcccaggctggagggcagtggctcaatcttggctcactgcaacctccacctcccaggttcaagtgattctcctgcctcagcctcccaagtagctgggattacaggtgcaagctaccatgcctggctaatttttatatttttagtagagatgcggttttaccatattggccatactggtctcgaactcctgagctcaagtgatctgcccaccttggcctcccagagtgctgggatcataggtgtgagcctgtaagtgtgggcccgccagcctctttcattcaacatgtactttcatccagattcctcgggatctgaattcctgcaggctttctatcctagaagcactggcttttccagaatctaggcctgagggcaagaacttgcttgtcatagtagtggccaagtcataaaaccatattctcttccgactagggtaggctttagggttcagcttacttcccttcttggaacttaggttgcagtatcaggctttcaacagagctaggatatgctgagtctccttgagtagaggcggcagtgggaacaacgtggtttcaggagacataaattgcacgaaaccaattaggttatttaggggaaagaaatgaaaggtctgcactgaatctagggtaagacttcggtaggataggagaattaagttggtcttgaaattgaggcatgagaggggtccggcttgttggttgggagactgcctaaacaagttatagccacgccattctagacacttccatcctagaagggagggcccaggaagtctgtatataaccaactctagggcagaggctgccagctggtggcccgtgagccagacttgggccccagagatagatttgtttggtttgtggtgttgtaaataattttgaattagttgccaacatttgaaaatcaggacttgccttttctcttgaaaaatcaaaagttcaggcatcattggacccaaattcctgcccgataaaataagctggatttcagtagtcgtagcttctttaaaaaaaaaaaaatttcttttttgtttatttaaaaggagtatccctatgttgcccaggctggtctcaaactcctggctcaagtgatgctcctgcctcagcctctccaagtgttgggattacaggcatgagcctctgtggagggctctggctccttttttttttttgagacagagtcttgctctgtcacccaggctggagtgcagtggcgcgatctcggctcactgcaagctccgcctcccaggttcacgccattctcctgcgtcagcctcctgagtgctgggacaacaggtgcctgccaccacgcctggctaattttttgtatttttagtggagatggggtttcaccatgttagccaggatggtcttgatgtcctgacctcgtgatccgcccacctcggcctcccaaagtgctgggattacaggcgtgacccacggcgcccagccggctgtggctccttttaaatggagtatggactccccagtccactgtagtcctccacttcttgtattatccccagactttcttgcctttgctcactcatattactttcctggcctctgaaggcactgcactttcagatcctggctttctggctgtaccccatccccttcccaggttatactggcaaggagatccaagcagctttttgcagatttcaggctattttattttacctactaattatcctagaacagtggttctcagccagaggggagtttatcttccaggagacatttagcaatatctggagacacttttggttgtcacaactcctggaagggggtgctttttgcttctaatggtagaggtcggggtgctgctgaacataccaccatgcacagaacagcttctcacaataaagacttacttggcctaaaatgtcaatagtgctgaggttgagaaactctgtcttaagggtgcactctgttcatatgtgttctggggttttggaatcttatgtggtgaggcagggccacaggctgctgactgaactcagtaagtttaggggctcatactcacttgtgggactaatggggagaaatgttggttcttgaggtaggtacatagggtctcctctttgcctaggtgaccagcaggattcacagtaacccaggtgcccagtattataagagtacttgatttgactgcagaagggtggtgtttctgccttgggtgttgtcagcccatttagctttgtgggctttgacctcgggatcctccctcttgtgtaggcttatacacatcaatggaaagtatttgctttgaagatttcaacatggaagtagttcattgctgacacagcggcatcaaagcccagcgcctgctcacagctgagactccattccccctgagtttgtttggcaagggtgacagtgagcaggaggaagagaaggagggagactgggaaggatgagactggagggaagaagaaacactgtatgatccctgagtatccattgtttccatgctttcctgctctcttggacccaggcctggtcagagttctcagtagaaaagatacgctcctcattttggctagttgctatggacagacaactttcttgttctgagagtgatacggggctagggaggactgggtcttgatcatagttgtttcaagactccaaccctatatatagttcgaatgctttcataatgggactaaatgtatttgtgtaattaaaaacaaagacactggccaggctcagtggctcatgcctgtaatctcagcagtttgggaggccaaggcaggaggatcacttgagcccaggagttcatgaccagcctgggcaacatagcaagaactcgtctcttaaaaaacaaaataaaacaaaaaaccacaaaaaaacaaggatactttaaaaaaagacacatacattacatatttatatacatcccaggaggtagccactgattctgggatccccatttggaagggtttacctcccctggagtgttggagagcatttcactcctgaatgtcttgtagttgtcccctccctaccctgcctttcttcctttcttccttccacatttttttttttttagatggagtctcactctgttgcccaggctggagtccagtggcgtgatcttggctcattgcaacctctgcctcccgggttcaagtgattctcctgcctcggcctgctgattagctgggactacaggcatacgccactatgcccagctaattattttgtatttttagtagagacggggtttcaccatactggccaggctagtctcaaacccttgaccttgtgatttgcccgcctcggcctcccaaagtgctggcattacaggtgtgagccactgcgcccggcctttcttccacatttttgttgttattttttgtttacggttgcactcctttgtccttgaatgcccctttataacattcagcctgtctgggaggaattggaaggtttccctccgctctctgttgcctgtgggaaaagagagttgtgactactgtcagcgtagctgggagtacagcttcagattgccaggcaatctcctcatcagaaagagagtatgaaaggcacagttctgcgagagggtgcacatgttattcactattaacttgggtttcagacaacagaaaacctttagcagcatggctcaaacatgttgatgtttgtttctctcacatgttaaaaggaggcagtgtggtttggatgacttcagttcttcagggagccaggtttattccttctgtcttcctgccatcctcagcctgtgacttctagctggtggtccaggatggttattgaagctctagctgtcatgtctgcactgtaactgacaagaaggacaaagacactgcctcccccatttaaagacactttctgaggtcttatatgaaatatttgcatacatcccgggagaaaacctggttgcacagccgtacctacctgcaggagaggctgggcaatgtcagctttattttggacagccatgccttcagctaaaatttctattacgaatgaaaaagggaaatgaaaaagggaaaaagatagaggaagataactagccatgtctgccacagagactttggggatttgtttctgctttggctttcagtttggatctgccatttgagtactcctttctcagcaataagctcccagagagccttgaagaccctcacatgggtcccacgctccttggtgcaggcttgtccagcaaggaaatgagatcaggagaagagggaaggcttggatgttttaattgtggtagctgaatcttagcatctggctttaaggcccagttgttgactttgtttgaactctgatagtttatggtaagctaggggggctgggagttctgggaagcaatagaggagtaaggatcagatggtgaaattttgtttcttaattagaatcaggagaacagtcaagggacttggcttctgcttgacagactgttctaggagctctctgttctctggcagggctgatagtagggtgaggcaaacgaggtgcctggggtcagcgttgaagggcgtactcactctcaggttccggcatgtggtcccctgagagtgagtgcctccttaaattttgtgccctaggtgcctcctagcttcacactaccctggctctgccttctggtgctacattgttgctaatgaaccatttttatttttaaacaaattcttttaaaaattttcaggggccatgctaatcttctttgcgtcgttccaattttagtatatgtgctgctgaagtgagcacgaactatttttatttttatctagaaagaggcgtatgttcacggtaaaccatggtaaaccacagagtggaaaaagtctccttccctctccacagctttagtctttctccccagaggagccactctgaccaggtgcttttgtatccttccagctggtctattggaatggactctgcaggcatttccacaagcagccttctttattcattagtttagcacatagttgaatttccactgtgtgtaatatttacctgtgcacagagaggaccaaacctgtaggacatttatggcaggatagaaggaaggagaaggatcagaagtgagacccagtgccagttagtgggtctgaggagtgtatcagcttctcttccccttggagctgcaaaccagaagcacagttagcactgccaggatattgtcagacagtctctttctccatgtttatttccacctttttgtgtttctctccttttatcctcttctgtctctgcctccttgtctcttatctctcacccctctgtctcttctgtgtattttctcgtctttttttttttttttttttttttttagagacaagttctcactctgttgccctggctggagtgcagtgactattcacagatgctattacagtgcactataggcccggactcctgggttcggcagttctcccacctcagcctcccacacagttgggactccaggtgtgcaccgctgccccggccccctgtctgtctttttgtctaagctgcatgccctcccacttctgcttctttttgtgttctgcttccttcctctatttacttatggtttctgtccctttgttactaagggcttgtatgtgactttcacttgctgtagctcctgacccttctgcccattactgttagattcagtttcttggtattccaactctgtgtttctgggagaggcaatgtaacaggctcaacttgggtccagtgtctggctccatcagtcatgatagggaagggggagcaattcccaagaaggagctgggcaggtacttcaaaacatggctactgtactgtgtaggggcctatggattactggtacctattaactaggtaatccttatgttagctgattgaggcttaaccccatacaggtagctttgatcatcagggtaggtccctgggaagacctgccagcagcatgcatttctttgggctgcttctcccctcccatttgaccactgtccccctactcccacatcatgattgactagtaagcacctgtgttactggccagtgtactgagtgaaagctctttgaagccattgagcctggcacctgccacctgtgttcattttcacaggctggccataggcacttctctccatttgaatggaagaatatccaactttctgacaatttgccttgctccagggaattggaagttagagtgaaaatcttaccaccttggttccaaccagggtttatcagtgcccctctttgcttggtgatgagcttaagaaaacaacgtggccaggcatagtggctcatgcctgtaatcctaatatgggaggctgaggcaggaggattgcttgagcccaggagttccagaccagcctggacaatacagcaagacccctgtctctacaaaataatttttttttaattagctgggtgtggtggtgtgcacctgtggtcccagctaataggaggttgaggtgggaagatcacttgagccctggacatcgaggctgcagtgagctgtgatcgcacccactccagcctgggtgacagagcaagaccctgtctcaaaaaaaaaaaaaaaaaaaaaaagaaggaaagaaggaaaataaaatgatatactgctgttaccttctgagaatttgtgatcttgggagaagcatgacccaatcacctgagggagagacttgagacaggtgtctacatgatgatagcatagacactaacctgtgctaagaagcaggaatgccatgtggttcaggagagaaagagctcagagaggggtggggtggtgtattcagagaaggttttacagaggaagaggaagtgggggctgaactaaccttgactgggagttgctgttggctatggcaggaagaggaggggaggacatttctttttatgtgtgtgtacggtacgagtaagagagagagtctggctgaaggagagagtgcaaagtgggtaggagtaagtggagttggcctagaggatgggcccaaaagattttgtagtaagatttgaggtgcacataaaagttctgtttttgtatgctagaggcagtactcacagatgtcactgcgttccttcctgctggatattgctcttatgtcgtccccatggatcagtcattgtttagcaggagcaaagtgccggggctctcagcacagggcccagatgtcactgaagtgtgtgaggagctagaacttaaagccacgtgagcctagggagtactcgagtgggtgcgcttctccatggacttcattgagaattgggaggtatgggtaggaatgagggtggaagcgatcagtgggcttgggaatgtgaacttagaaatggtagttagcttctctcacctcagtttcctcatccataaaatgggaataggaatatctgtattttggagtcgtgagaattgatggagaggtgtatgtgaaattgtcaggcatataacagacttttctttttctccttttttttttttttttgagacgaggtcttactctgtcatcaggctggagtgcacggctcactgctgcctcaacctcctaggctcaagcgaccctccctcctcagcctcctgagtagctgggactacaggtgtgcaccaccacgcccagctaatttttgtattttttgtagggacagggtttctccatgttgcccaggctggtctctaactcctgggctcacatgatccatctgcctcagtttcccaaagtgctgggattacaggtgtgagccactgcacctggcctcatttttacacttaatgcaaaacactgtctctctaatttcttaggtaacctgccatctgcattcaaatttacctcacttactgatgagtttcttttggccatgaagaggtcttgtgtctcctgtggtttggaaccttgggagtctgggtgggaaagagtaggtgaaatcacccatccctgggcctggggggaattcccagaaatggtgctagccatcaggatgtataagtatgtgttcacgcatgccttcatatccttgagcaccagtagtgatggaagtgcctgtgtgctgtcagctggggcgggtgcagggtgtcccctcgcttgccagttcgccttgttctgactggtccattggcccctttgccttaggcaggaagggcagaaagagtgctctctgtaaagaggggttgggcccctgtgccctcaactcaagcctgccagtgactttgtggttttcctcctaggtctgctgacatttgtgaactgtgcctatgtcaagtggggcacacgtgtgcaggacacgttcacttacgccaaggtcgtagcgctcattgccatcattgtcatgggccttgttaaactgtgccagggtaagtggtgggaaggggggtaccaccaacagttcctctggattccctgaggagaacatggcgactctgttagcttcactgctcggctgtttctatgtacatgctagcatgtgtcagtgagtgcaagagatgggagtagatttctttctgggctttttgggccaggctggcttggccaagtggacatgagtcagcctgtccctcagggctggtttcctttggtggaggctgggagcattgcaggaagccagccaagggcctaggagctcctgaagcttgggtcatgattgggtcataaaagtaatctgtggggatagagtggctcctgtttgtggtctgtgactgccaagctacaagtaggaagactgggccctccttgagacaggtggcagggtatatggagctggaagtggggtatggaaatgggtggttattttgcagcctttacttttcatctggacttgtattcagcaatccctccccaagtcagctctcagaaaaatattaaaatattgtgaaattggcagtgtctttcctaaatgttggctttagaaagcttttcattcctggatcagagaggactggcagtgagggtaacaggcctaccaagatctcatgagccctagagaggtcttgaggtgtctttagccacagatatctcaatcatttcacagcccagttctctaggtcatcagtccctaaatgtggctgtgtacagtcacccggggagctgagaccctaatctcaaatctgttggatcacattctggttggtgtggagtctaaaaagctgtgcttttaagaattgcccttggcccggcacggtggctcacgcctgtaatcctaacactttgggaggctgaggtgggcgaatcagcaggtcaggaattcgagaccagcctgaccaacatagagaaaccctgtctctactaaaaatacaaaaattggctgggcatggtggtgcgcgcctgtaatcccagctacttaggaggctgaggcaggagaatggcttgaaaacaggaggcggaagttgcagtaagccgagattgtgccactgccctccagcctaggtgacagagcaagattccatctcaaaaaaaaaaaaaaaaaaagaattgcccttgttgggctgggcgcggtggctcatgcctgtaatctcagcactctgggaggccgggaggctgaggcagatggatcacctgaggtcaggagtttgagaccagcctggccaacatggagaaaccctgtctctactaaaaatacaaaaaattagccgggggtggtggtgggtgcctctaatcccagctactcgggaggctgaggcaggagaatcgccttaaactgggaggcagaggttgcagtgagccaagatcttgccattgcactccagcctgggcaacaagaacgaaactctgtctcaaaaaacagaaaaagaaaaagaaaaaaagaattgcccttgttgattcttagactgctggtctagcctgtgtacttatatcaagttagtagagctagccatgtggatgtccctggaggctcaggagcatcctggggtcaaattgggttttgagtaatcctcccctgaagatctgttccttagggaaccactgctgtgtatgagaatggacacccctgaggacaggggtctctattttctcttctcttgctgcatagccagctctttttaccacatgagagctgggtctaggctttcttcagggtgtgacaatgggcttccttagaagtctgggtcttgttaaagaccccagtatgtccagagggtctctgatctgggtagctgggtgctgtcccctgggcttttgtgtctgcagtctctgaggcctctgaggagaatgacaggctgggctggctccccggagggtgggggtggctcaggcctagtgaaagataaggtctcagttcctctatagcatgtcatctcccccatgcaaccatagctaccgcaagtagagcagcatagagtccttcccatgaggctgataaacccattgaccaaattgtgcagtagtctggtccaagagaggtagttcacaggaaggtataattttcaatgaaaaatgactccttcatgtgaaatggggttcttgacataaataggtagaagagctggggcttgctgtgagatcatttgcaggaaatggaaattctttagggttttggaagaagtattgtcacatcagagggcggccaagaatgtctttggttttttattgtctagttttattaaaggaatgtgagctttcctgaggaagtgggtggggtggtaaagtgtagggagctagtggttgttgatcttttggtgttaaattatgtttttttttctttcccctgccttcttgttttttctttcttgttcctccccattcctcctttttttcatcttcccttcctctttcctattctcctttcgtatctttctcttacacctcccatctcctcttcctttctcctttggcctgttccttctctctgaacccctcacctgcctttgcccccacaggacactctgagcactttcaggacgcctttgagggttcctcctgggacatgggaaacctctctcttgccctctactctgccctcttctcttactcaggttgggacacccttaattttgtaacagaagaaatcaaaaacccagaaaggtaaagatgggatcacactctcactccccagcttggctggaactcctgctgatagtgggcgtgcctgccctcatccttctcctcctccctccgactctcctcccctcttctccctactcccccttctccagctaggaggggctgagggctagaatgggagtgagtgaaggtaggaaagccttcggctccctgtcctcacgttcgcactggaggatagggccttcctagaggagagggccttcagtggggagcagcaggcccagctggggcaaaggaattaggacctcggactctggtgctgacactacagcccgcagaaccaaaacttattctggccagctgggtccccagcctggcatccagtccccaggacactgttccttgcactgttcctctgagatcacagatgcaggaggattatgaaacccagtaggacccattggtcctactgtggcaaagattaaatattgatcatgagctatcttcacagagaaagttgggtctttctcaatagaaagaacccagggtcaaggggaaggtgagcctccctcaaagacttggaggctagtgaactgttaaatgttaggaaaatcccagtggagacttgataaactttgttcccaaggagaggttggttctaggtagtcctttctcacttgtcctgacagaaatttgcccttggccattgggatttctatgccaattgtgacgctcatctacatcctgaccaatgtggcctattacacagtgctgaacatttcagatgtccttagcagtgatgctgtggctgtggtgagtctcttgggatccccatttgttcatcatctcctgatactgagccaccctgcacagctcagtctgtcttactgcaccctcctcagctctgcaggatgaggtcatgagtctaggccagagggtgggctgcttagcagtgattgcatttgttccgagatcatagatgcaggaggattatgaaaccctgtgcgtttaagtgccttttctgtgccctgcccccagacatttgctgaccagacgtttggcatgttcagctggaccatccccattgctgttgccctgtcctgctttgggggcctcaatgcatccatctttgcttcatcaaggtactgtgtctctgtgtcactgataatagaccacaatatttcattctctggggcttaggcataagagttccttttttccctccttctcatgggcatatagggtgtgtgtgtgtgtgtgtgtgtgtgtgtgtgtgtgtgtgtgttggtatgtgggcatgtacttgcctttgtgcaagtagcacatttgtatgctggtagctcatgtttccatctgaggtgaggacagattgtgtgctgatagctcatgttatgtgttgatagctcatatttatgtgctggtagctcatattttgtgtgctggtagctcatgtttatgtgctggtagctcatgttttgtgtgctggtagctcatgtttccatctgagatgaggacagattgatgaaaggtataggggagaaaggcaacagcttggagtggtgacttgggcagggaccagattctaggctccttgtgggttatgctgtagccccaggattcattccttcagtaaatgataacagcacttgctgtgtaccaggtattggtgctatgtacagaaagactttccccctcacttcccagaaaatgccgaggccatcaggtctcctgatctcctctgtgcagacatctataagcgtgctggtccttcctgttgttgaagaggaaggagcaggtgtgcctttcctggcagactctgctacttgggctcggggttccagcacttcccctcttcttcagcagtttgctccatcagttggcccttctctttggtgggtgctcacttggagccagctctccaatagcttctctcctctccacttaggagagacacaaaatagcgtttcgcatctctcctcttcccacttactggatgtactactttttatttttaaattaattttttttagagattggggtctcactatgttgcccaggctggtctcaaactcctggtctcaagtgatcctcccaccttagcctcccgagtagctgggattaaaggcatgcgccaccatacctggccctggaggcatgagggcttgtgagacagcagtctgggcttcaactttcattcattttcccatctgttaagagtttggcttctactacctgaaaaatattcttattaaggcgatctctttcttagcctgtctttagtcctcatcctattggacctctgaagcaagtgatgctgaccactttccaattttgaaacaattcccatggcttctatgacataagatacatgagaagaaaatttctttcctgatttctcttccactcactctataactggtgttgtccccagggccgggggtataatagtcatccaataaatatttgccatgtgaacacacagaagcatgaaaaataaaagagagttttgtcccgttcattctttttactggttttcacacaccagtccatgtgttgtgcctccctggggcaagcaaagaattagagaagtcaaggccttgtaaaagaacatagtgtccagctgggcgtggggctcacacctgtaatcccagcactttgggaggcttaggtgagaagattaccttaggtcaggagttcgagaccagcctgaccaatatggtgaaaccctgtctctactaaaaatacaaaaaaagaaaaattagctgggcatggtggcacgtgcttgtagtcccagccgctcgggagggtgaggcaggagaattgcctgaacccaggaggcggaggttgcagtgagccgagatcgcgccattgaactccagcctgggctacagagcgagactccatctcaaaaataaaaaaagtagtgtcaccttccctctgctcagcctagttgtgatagatggacttcttttctagcctttccctgacaccctagcctccccctgctctagtttgctctccagtctggtgtcaaatcccgtcaggcccttacctcaaagccacagctgactgtgtttgttcagactccacagtgtggccttgtatgcaggttcttcccagcaccctcttctcacacagcttgtcctggggctctaggcattctacatcaacctccaaagaggccacgctctttcatacctccacacattttgcctatgcacatgctcgttttttccacctaccgacttgcttctggaaactcttctttgcatctctcctcttgcaaagcattttggcacaagcctcaagcctagcgagtgagtgtcgtgtactccaaggtgatgctgaccatgctggggacagttcatttctgtgccagtctttttttgtttgtttttgagatggagttttactcttgttgcccaggctggagtgcaatggtgcgatctcggctcactgcaacctccgcctcctggattcaagtgattctcctgcctcagcctcccgagtagctgggattacaggcatgtgctaccgcgcccggcttattttgtattagtagagacagggtttatccatgttggtcaggctggtctcaaactcccgacctcaggtgatccacctgcctcggcttccgaaagtgctgggattataggcatgagccaccatgcctggacgctgtgccagtctttttcccagtcggtagagctctttaggtgtagaaaggaagcctgggttgtctctctgaccctcagtcttgccttacatcagctcagggaaaatatatggagggcatgaacagaaatctggctgccctttaaaagctattatgttagctatgaatctggcatggattgggtgagtctgttagtgggtgacagcagggtgaggcatctgttggatgttggtgaggtatctgtggctgagagaagagggggtatctgggtgatggtgggtggggcatctgggtagtggtgaggtgcccggggatgaagagggagggaaaatctgtagggaaggggggagcagggaggttggactggtgatgcactaaggacctgggatgctcctgggaggctgcatcctgctttcctcgggggctctgagctgagtttgtccaagtgaggagtgagtatggctgagtaaaaggagtaaaggatcctgctgacacatttctcatccttctaggttgttcttcgtgggctcccgggagggccacctaccggaccttctgtccatgatccacattgagcgttttacacctatccctgctttactgttcaatgtaagctttgctgggaccacggggctcaggtggatctgtgcattgctccttctgatttgtgctaagttgttaaataagagggaccctgagaaaggccttactctaagatgtgaaaaacagttcattttttgttgtcatttaattcttttatggttttattacgtttaattttggattaatctggaatttatattatagcatagtattgagaaaggtggggattcacttaattttttctcgaatggcagccagctataccaatatcgctcactcaacaatccattttcccacagttttcaaacttttatcacagaaaattaatagctaatttttttagggtccttaatatgtgccaattattattgtatgccccttaaatgtgccatctcaactaatcctccccatcagcaccaagtctccttagtttagctttatactgactatctgaaaactaaagagggaccaagggtacttctttagtccccccgcccttggaattttcctagcaattctcatattcgtttatttgtcttgatgaacttttctatcatttcatcaaagtaagagaaaaattctcttgatattttgacagggccagcattgaatttataaatttaggaggttatctgactataggcacacaccaccaggcctggctaatttattttttgtagagatgaggtctcactatgttgcccaggctggtcttgagctcctgggctccagtgagctgccacttcagtctcccaaagtgctgggattataggcacaagccaccacgcccagccttctcttcttaatacagggttctcccttatctccacagaatgagctatttggttttaaatcctttgttgataatttgtaatgaaaagattattgaagtttaaacacatttgaccttgtcccaggaccctaggccctaatccttgccttctaggattcttttgttccagaagctaatgctgtcttatgtctggatggatccattttgctagtttccaggtccaacacctgacttcagaggcctgaaatgctacaatttctccctctggctcaaaattcttccatggggagagagttagattccattatttattgacattatttagtccagatgggtagggatccaattgctagttagcatttctcaggcctgaggacagtgagatggttctgaaggcgtttcccccatttgtatgccaggcagtcgggacccaggtctaacccctctctaggacaccgtgtaatccatgttaaggttgctgcactgaagtgaggagggcctcagcgtctgcctttttctaaagtgcttgcaacaagggggaggcattgagtggaggaagggctgcaacagaagggggaaagatgctaccctgagggttaatgtacctcagggtacatcaaggaatggacctatctgatgccaaggggtcaatgaaaagagccagaggtaatctggtgaagtggcatcagatctagtactgactgctgggtgggggagtctcctgggggcgcaggtggtgacgatgctcacctgtctccccacccctttcccacagtgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaaggtcagcagctctggccagactaggaggggtgggccatctccctaaggtggcttcttgcccacgagctgtttcctcttcccacgttacttaatctctcaccccctctatttcagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctgggtgagcttctctgtgccccattactcactggcggctatgtgtgcatgcgcatgcagaggtggggggtggctaacagcttccccatactcagaatttgctggaggccatgtgacccagctgtccacgacttcccttttgattttgacatgatcactttagttctaattttagtgtcctattttggggctaaaacattacctcctgacaacacaaatcacctgggaagatgagttgtgcatcagactctggttgggcatgggacagaggatgatgaggcttgttgggagacaggggcaaagcctgatatagggtacttaaggggcaggtggcgagggagccatagatgttactagtcagccttgttcaggttagggctgtagctagatgtttactaaaccctgtgcttgctctattttcatttagctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacaggttttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggccttcttctctcttctttaatatagttactacgggaattatgttgtcagagcatctttcttcttcccccaggtattatgtctgtgttgcatctttctcaaaacagttgtacatgcagcagttttttgagaagttagataactgatttgtgaaaactctgggcttattcctactggcaaacctctctcttcattggtttcttgactggggcaggggaagagacaatgagctacatattttacataatctcaaccactaaaattcatgcagaaccatctcatttggagagaaaatgaggctcagtgaggtgaagtaactgcccaagagccacagcaaagtaatgacaactacagatttgaatccaggcctgatggattattacacccccaggaggcccctgggaaacactggtctttgggtctcctacagcatggctcagttgcggctgggctgctggcgctcaatgacagagaaggaaaggcaattaagatgcacctgtcaactatgcctgcacctcagtctcagatcctaccagtccctcccggtctggggctgccacccacctctggaatcctcatctccatcactgctctcctcctctgggtactcattgcgccagttattctcactgttctcgtcatcttcatcgtcgtaaatgtcctctggttcttgatcatcattcacctacacatctcaacacaaacatgagtccaagtcaaaacctctaaggttatgctctgggggaagttgttagcataccagcttgaagagatatcatgtaaaagtgccctgtgaaaaaactgcagactagtagtttgactccattgcacaagaggctatgagagggagataatagcccccttccactcagagcccagctccacaatgataggacatgctggaccccatgagaagggaacacagggaaaagaggagtgatggctctgagcgattccttcaaattccaaaggtcaaaaccaaaacccaagcgtaagaggtgcggaaaggcaggaggaagggccatgcagtggtccaaggtgggtacctgactgcaaatctgtcctaatgcaggtgcaggatgcagtgcttcttgattatagtctgagcatgaccattaggtgccaccttaagttttcttgttaagcattttagaatttgagaataggctgggcgcggtggctcacgcctgtaatcccagcactttgggaggccgaggtgggtggatcacttgaggtcagaagtttgagaccagcctgggcaacatggtaaaaccttgtctctactaaaaatacaaaaattagccaggcatggtggcatgcacctgtagtcccagctacttgggaggctgaggcaggagaatcgcttgaacccaggaggcggaggttgcaatgagccaagattgcaccattgcactccagcctgggtgacagagcgagactccatctcaaaaaaaaaaaaaaaaaagataatggtgtcagctaggtgtggtggctcacacctgtaatcccaacactttgggaggccaaggtggatcacttgagcccaggagttcaagaccataagaccagcctggacaacatagtgagaccctgcctctacaaaaaaatcaacaaaaattgggcatcatggtgcatgcctgtactcctggctggctgcttgggaggctgagataggaggattgcttgagcctgggagatagaggctgcagtgagctcagatagcaccactgcactccagcctgggtgacagtgtgagaccttgtctcaaaaaagaaaaaaaaaaaagaataatgtcaggacgttagctttcttcatccgaggtttctctacttctaaggtacgaattaaaaaatagattttgttgtcactcatgttaagaatttctgattttatcgtctttatcttatcataagccccatatacatatttcccccctaagaatggatagctataaacaataaaggtgatgttgcaaaccttgtaaaatattcattaatgtaaaa

SEQ ID NO: 12317 - DNA, 103993 bp, Human
  misc_feature (1)...(103993): n = A,T,C or G
gaccccctattgctgctggctgtcctcagcacttaccttcccacacatgcttttgtcccttttgtcccaaaacattctatctctttcctcttcctttatttaaattcccaaagcctgtagttgatcttagcacggtgttctgtcaaatgcaaggaaaataatttatactatggtgtaagagactgataggtttaactattcaaaggagcattcgcatctttaagggacagtttgtgaactcaaacacatctcaaacgggtagaatgtgcacgggaaatctcttcgaagcagggtctcaggaactcttccagttccacgtgtgtagtgcccaccgggccaccgccacccgcctcctgggagcaggacagggctccgctgccgagcccctctgcggaaagctcaggcccggcgctccggagtctgggctcccggggtgggcggggatacttaggccccacgtgccccgcggcggagcggtccccaaacctgagccctggcctctgccggcccggaatgaagccgcggcgtaggagggggcggcggggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcccgcctcccgcctcccgcctcccgcctcccggggcctggagcgcgcgtggccccggagccgccggcgccgcgcgaggaatagctgtgcagcacgccgagcccggactcggcatggctcggctcggcgcgggcgggcgagaggatgctggcgggcttccccgggctcggccgcgctcccgccgtggagggccccgcgcgcgcccctagcagccgccgccgccgcggtgcaggggaggggtccggagagccgcgctcgccgccgcccgcgcctgccggcccccgcacggcccctgcccctgagcctcagccccagggcgcggcgcgctgggccggcgcccacggatctcccagccctcgtcgccgcctcctccttccccctgcggccgggcgcccgcggatgctgaggggcagccctgcgcctctcccggtcggatcccgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacaggtaaacgcaggggcagggccaggcttccgggggggaagacagcgccccgagcgtgggaagggggccggatcggagcccgagcctccaagggtttggtggaaaaaggaagtaaacagaaggaaggctcaggaatcccccacgatggtcctgatttctttccggcacattttatttacagcttctaaggactgggcctggagggaatttaggtgaggaagtcggggactgagaaagaagagatgacagagagaaaccggttaccagggatggaaaggcggctaggcccttccacaagccagggacaggaaattgagtgtctggcgtggacaggactaagtgtgcctgcggtgggcggtggtgtgagccgggggtggcagggaaggccctgggttgggaggctcttgcagcagagatccttttatgagggttagggcgggtcatggggaaaccgcaaggtaggagggaagaggtgcttctactcagcaatgcccttttcagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggaggtgagtcctgcccactgtccccccacagcgtcctctcctgcagctctcaccaacttgggacctgttggagttgctgtttgctttgcctttgagtcaaaatgtgtcctgggggcctccggggctctcacctctctccctagtccctgccttttcacccctgtgccattacccggagtctgcctgtgcttggccccagggaaaggaggatgtcagggcattgggcctcagggccactcttcacctgtgcccagtctaagtgtgtgacaggaaggcccacccagggctggtcttgaggcagcattgtcctggccattccctgtcagtgaccctggcaaggaggacctcccttgggaagagggctccttgattcccatctctccccagcactgactagctgtgtggactcagtgcccctttgtcaaatggggataacgtccgctctgcctgcatgacacggttgttgtcaggattgcaggagatgtgggggaaagcgcattaggatacgtgaagggctgcacagagggaagacgcagttgtcatatttcctgcctccgggagctcggggtgcctggggagttctatgaagtggagaatggtggtctccccactgaaggtgtggtgtggggatgcaaatggggacagtcatgccggccactgtgacgtagggtctcctggtcctaaagcacgcattctgctggtcctggagcacgctttctactggaaggggtggaatttcggcctcagcttaactattatagtattgtgttcccaccaagtgccaggccctcaggggctgcagagaccaggggacctgagggacagtaggcagtgtgtgtccctggggagccagcaagccggtgaccagagaatgaggcggagatgtctgcatctgggtttggtgcccagcctgccagcctcgtgccaatgatggtcaagagaggctcccccacttcctgcccctgcagtgctctgtctggtagagatgtcttaactcccacgccagctctgttctgtggttagtggggctggggtagagtcagctctgaagcggtgaccttctgggtgtcaggagaggcagggcgtgcccagaatccttgctgactgacgtgagcctctagcagccatggaggtcagtgcctgggtcctggagaccaggtgctatgtgcaggcccagggtggacagacagaatcttccactcctctgctgatttctccactcatgtctcatcctgctgatttgttctagaaatgggtagaggatgttaacataggcagggcctggcagggcatctagcccagactacccattttacagaggaggaaacagagatgagtgataactggttcactgtcacccagcactttggtggcagaaacaggacgggagcccaggcattgacccccagcccagggctcatttgtgtatgttccttggagcactgagagctgcctgagagcaggagctttgcttcccaccccacctcctggagacagtggctatgtgctgccctgccgtccccaccccaaatctctgtagagggggctgtgagtttctggtcattgactaggtggaaacaccagtcatatctcttcaggccatgcattagccagtcccaggttctttttttttttgagacggagtcttgctttgttgccaggctggagtgcaatggcgcgatctcagctcactgcaacctccgcctcccaggttcaagctattcttctgccttagcctcctgagtagctgcgatgacaggcacgcgcctccacgcctggctaatttttgtatttttagtagagacaaggtttcaccatgttggccaggatagtctcgatctcttgacctcataatccgcccgcctcggcctcccaaagtgctgggattacaggcgtgagccaccatgcccaggcatcccaggttctaaggtctgaggtctgaggatgactggtctctctagctccatctcctcaggtggacaaggagcttattttgaggctcctggagcttccagggaaaaggactgagaaggtatggccacagggctgggccggggcctgggtgccccaccacgtggctactcggagatcacttctaaactcatgattgttctcctttgagtattgctaagacataaaaccctaaaacttagaaaacagaaaaaaaaagatagaaatcaagaataaaaatattagcatcccaggggagcctgaccttggcatgcaagcagtgcctgggaggcagctttgggaacagagcaggaggggcagagagctctcaaggtccgattgggagcctgagatcgaaggcaggaggccccagcttacagtgggctgtgttccagaagcttctgagtcactggtttgggactaatgtgactttttaaaaggtgcctgggttcccaggcccacccaccagggtcttcctcaactcacagcatcccggcatttggcctctgaagatggtggaaatggggccgggcatggtggctcatgcctgtaatcccagaactttggcaggctgaggcgggcggatcacctgaggtcaggagttcaagaccagcctggccaacatggcgaaaccgcatctctactaaaaatacaaaaattagccaggtgtgatggggcgtgcttataatcccagctacacaggagactgaggcaggagaatcacttgaacctaggaggcagagattgtagtgagccgagatcgcaccactgcactccagcctgggcgacagagtgagactccatcaaacaaaaacaaaaacaacaaaaaacacaagctgcagcagcctgtgttgctgtggggagggacacccgggacagcggtctcccctgagccctggagtgaggtgtcattcatctcccctgctgccgttgcctcctgggatgtgggccccatcaaggatcgggggcaagggctggaggacaggatgcaagaaccaggggaccaggccccttctggtcagggtaggtcccagaactttctccagaccccaggcaccgcctttctcctacccatgtgcttgcccttgtctttctctctcccatcccctgtcggctctggctggggactccctccagggtcagtgggggatgaacgcagtttcccagttcgaaatagacacctggatttctggggtcttgtgagttttgtggttttgttgctgctgtcactggcagcatgaagaagcattgccagtgtcaaaagtcttcttcctctgcagcccttatccccccatgcccatgcgcagctctgtggggaaggacagaaggtacacatggggctgttggcagcctgagaggtcagaggccagccagacaacctgtcctgggctcctcgcaggaggccagtgggtggggttctgacaggaagagcaggtgatcagggagtgtgggatggggtggggctggggccccaccaatgagttaatgagtgaatattgccgagcagcatgggccttgcagcctgcaaggtcaggggataaggaggatgaggccatctgacactcaggctgtgctggggcggggaggatgttctgagagccaccttgggtgggcagagacctagccaatggttctcacgacccatcctctagcccctgcctgtcccccattcctttttttttttttttttgagacagagtttcattcttatttctgaggctggagtgcaatggcacagtcttggctcactgcaacctcctcctcccgggttcaagtgattctgctgcctcagcctcccaagtacctgggattacaggtggccgccaccacgtctggctaatttttttgtatttctagtagagacaggatttcaccatgttggccaggctggcctcgaactcctgacctcagataatccgcctgccttagcctcccaaagtgctgggattacaggtgtgagccgctgtccagaggagggaacagaggacgaaacagagatgggtgataactggttcactgtcacccatcactttggtggcagaaacaggacgggagcccaggcgttgactcccagcccagggctcatttgtctgtgttccatggagcactgattgctgctccatgggtcccccatcccaagaggcaacacaggcccagagcagccggaagggaggacagatggatcaggaggagccgaggctggcagtgtttgcccatttcgctcccctggcctgggtcctgccccaggacctgttacggaattacttgccctttactgccctaaactgcccctgggctgggtgaggaggaaggaggggactgggctcaggaccaggacctgcaggaccagcggccaatgagtgcggacaatggggaaggcagccaggatggttgggggtggtggtgggcggggcgtgcctttagcatttggcaaagtagggactaggaactgctgacaaatattttgtacccttacttcagagcagaaaggctatttgggagcaaaattctctcatggaatgaagagcctgttaagaccttttttcaccaagtaaaacatgaggaagctgtggatgtgcagtttctttcacacctgcaaattacacagcaatcattcacccagcaaaggaacatttgctcctaggggctggagggagctgccgtagggagggtgagaggaaactgaggcttccagagacaccctgtctgcagacggcaggtagctgttgcatgcacctcatcccatttaatcctggatgttactggctccatttcacagataaggggactgaggctcagtgaggttgagaggaggtagtggggctggattacaggggaggggtcactgatgagtgagaaaggtgggttgggggacttccctgaaagcctctctttctctggaacccaggcatctgggcctcctacttttctggctgcccccaaatgtctttgctaagcaacgtagctgaacagtgccaagagatggcagtccctaaggtataacaggaggcacccccttctccccatgggaattggatgcaaaaagggagaagcccatgacgatgttccctgtgggcacgtggccaggagtacttgagaaaggcagggggctgaatcgggacaggagctggtgtgaggtgcggtgggcaggaagcagcaggcctgggggctttcagccttcaggaagcaggctgcagggagaggtgtgcaggacacagagcaagaggaggcaaactcaagccagtcctggctctttggccctgggctcctccactgacccgggacgggaaagaagccgtcatccctccgtggagagtatgcagatgggcatcagtggagggtccagggaccagaacaatgatgacgtgcgtagaaggggactgcagggccatcagattcagctgcatgtgaggaggaataatcagtcattgaacatgtaaacaactttgcagaaaatcaacccctccatcctttccctgtcgcagctttctgtggccttttctgaccccgatctgtgtataaacagagctttcccagtttgtcatcatcatgcatatgcaatttaggccccacctttcatccacattatttccctgacattttgctgtgaacactggactcctcgtgtttattattttaaatcagcgctttatagtcagcgagtttttctagagaggaaacggaagcccagggctgggccaggggtgggtaactgggtagttttatatgcacatgcaggcacacacacacacacacacatgcacacacacacacacagcacacacacacacacacacacacacacacacatgcgtgctcactcctgggcttggtctgcccagccttctgggtaaaccctccgtcagatggaatggctgggatgccagggttattggcattctgcagtttcttcataaacaaacagcaaatcccacgagggtggtctaatgctgggtaaatattccaacaccaccctctgcccctggctgcccccccaccaaattacacattctttttgttttttctttttttctttttcttcttcctttttttttttttcaaatagagacagagtttcaccatgttgcccaggctgggcctgaactcctgagctcaggcggttcacccacctcggcctcctaaagtgctggattacaggtgtgagccaccatgcccagccatcaccaaattacacgttcttgataatagattccacgggtatgtgctatcaccaacacggagactcagagacacattgtgcgtaggtcgaggcccatgagcagggacagtgaggaggtggctgtgtttactgagctcttgctctgttacagtttagtgccttctggcaagaggcaaatattatttccattttacagatcaggaaactgaaatgggtgacaactgaaatgacttgtccagggccacatgcctagtaagaggcagagcaggattggagcccaggtcagtaggattttggagttccttctcactggagtcataaaagaacccattaggcggtgaccagtagctcatgcctggaatcccagcactttgggaggctgaggcaggaatatcacttgaggccaggagttcaagaccagcctgggcaacataatgagaccccatcttcatacacacacacacacacacgtacacaaccaccaaaaaaaattcagctgggcttggtggtgtgtgtgtgtgtgtgtttgttttttttttttttgagtctgtctcccaggctggagtgcaatgatgctatcttggctcactgcagcctccgcttcccaggttcaagcaattctcctgcctcagcctcccaagtagctgggatttcaggcacccaccaccatgcctggctaattttttttgtatttttagtagagacaggttttcaccacagtaaccaggctggtctcgaactcctgacctcaggtgatccacctgcctcggcctaccaaagtgctgggattacaggcatgaaccacagcgcccaggctgatggtgtgtgtcttgtacaggaggctggggagggggatggcttgagcccaggagtttgaagttacagtgagctctgatcataccaccccactgcagcctggggaacagtgagaccccatctcaaaaaaaaaaaaaaaaaaaaaaagaacccttatatcttccctcggagcctgttgagatagttccaacggggttagggttttggtttctcaacccacaagcgttagaaggtgcaatttgggggatgaggaggtgtttttgggggcatcttcaaggaacagagatgtctggggtgttgagtgttgcaaccaacagccctcatatgcaccttctctggctgtaggagacgttgttacattataggacagcatagtaactgatgtgcataatggtgaccaactcatcaagaaaatattaaggccaggcgcggtggctcacacctgtaatcccggcactttggaaggccgaggtgggtggatcatgaggtcaggagatcgagaccatcctggccaacatggtgaaaccctatctctattaaaatacaaaaaatcagccgggcgtggtgatgcacgcctgtagtcccagctactggggaggctgaggcaggagaattgcttgaacttgggaggcagagagtgcagtgagctgagattgtgcctggtgacagagggagactctgtctcacaaaaaaaaaaaaaaagaaaagaaaagaaaggaaatattaaattgcatttagcataaagtgtagtgtagtatctaaaaacattttcctcgggaatggataacacaagtttgaacaaataaggattatatttggaaattcagtaatgtgggatggctcattactcagtgttactgagtatatgtccatttattcaccatgtgttttagttatccactgctgtgtaacaaacagccccaaaatttggaggcttaaaagagtaacagtttaaacctgggcaacatggcaaaactcttgtctctacaaatggtacaaaaatcagccaggcatggtagcatgtgccagtagtcccagctactcagaaggctgaggtgggaggattatgagccccggatgctgcgatgagccatgatcgtgacactgcactccagcctgggtgacagagcaagaccggtctcaaaaaagaataaaaaaagaatgacagtttattgtttctcatgatcctgtgggttgactgttcagctgggtggtttttgtgcttcacgtggcatgggctggggtcactcatttgtccacctgcgctgtttcattcacctgcagcattcagttgccagctatgctggcaagttctaagaagcctttactcatgtctggagcctcagagctcctcctcctgacctctccatgtggctaacttgggcttcctcacagcatggtggtctcagagagaaggtggaagctatcacagtttttaaaggttaggctcatcactatcggctacaagaagtccaggctaactcagatgcaagaggaaattgattctatcttttgatgtttgagtagcgtgtgtaagggagggaatgaattgatagcagctgtcttctgaggctgtctgagaaaccaggaggcacatgggggatgctggggagacggaactaattaaagccatgagattgggtagggtccaaaatactctgtgaccacagaatgcttcaaaagttagaaatgtggcccagagcccagtgtttttaactccattaaggtattgattctctgtaggatccaatacatcatttctaagatttttagaaagtttcagaaactgcattgtacagagagaaatggtggctcagaattcatctgtatagactttgccttgccttatttgggtgagaagtcattctcttaccttctcaagcatgcaacggcccctgtgtccaggacactgccctaggtgacaggatgtgtggcttaatcatggaccccagcaccattcctgcccctttctctcctcagcttaggttggcagcttggctctgatgtttgtattcctttcccaggaggtagagatttgcatgtgcacaagcttcagaaacaccagataggattgggtttgcatttagggggatcatcttggtggacctgaatgaagtcgacatggtgcaggaggctggtgagggagtccaggcgtggcaccatgagggccacccaccaggacggacgtaggggatggagaagatgagtttggtttgagttgcccgtgggacatccaagtggaactttcagattattcagtggaaagttattgaacaccttctgtataccagaccttgtactcaagatctggagaagaaaggtctagagttgcagatttgagaatcatcggcatttaagtggcacctaaaactgtagggaggctgaggggttgcctggggagagtgtgtagaatcaaaaaggaagggggcttagaatccaacacgtggagcagccaatgtgtgtcgggggggccctcagcatgggacatctgtaacccgcccctgcttcctgccgggacccatgattgtcccaggtagcctgtgctgggtagatcggccattaggaagcaggaagcagtgtctgtctgatggtgttttgcacgattgatgctcttgcattggggagacttaagcctagccaaggtggggccatggtgccagttgagggactgcttcccacagttctaactggcaaacaagggcacgggagtgtgactgtgttacctggttgggggaggggtgggtaattatatagaggcgctttaaactacaaagcactgtgcagatgctagttatttctttattacatttaatcttggcagaccatctctgatctttgaactatgaatgaatcagaccaagtttcttcattatccttttttcatctcttttctgcgtaatcaactagctctttttcttcattgtgaaaggattattgttaagaatgtttcaaattataaaatgctgaataatattgcagaatattgtactattccttttctgtagggcatttgtctacttttttttctttctttttttttgagacggagtttcgctcttgttgcccaggccagagtgcaatggtgcaatctcagctcactgcaacctctgccttccaggttcaagtgattctcctgcctcagccttcccgagtagctggggttacaggcatgcgccaccatgcccagctaatttttgcatttttagtagagatggggtttctccatattggccaggctggtcttgaattcctgacctcaggtgatctgcccaccttggccttccaaagtgctgggattacaggcgtgagccatcacgcttggctcatttgtctactcttaatttttgtatttttatttttattttttcttgagagagagtctcgttctgttgcccaggctggagtgcagtggaacaatatcagctcactgcatcccctgcctcctaggctcaagtgattctcctgccttagcctcccaagtagctgggattacaggagctcaccaccacacccggctaatttttgtatttttgtagagatggggtttcgccatgttggccaggctggtctccaactcctgaactcaagtgatctgcccacctcggcctcccaaagtgctgggattacagacgtgagctactgcgcccagtcttgtctattcttaatttattgattttatttatgtgtcacttgcattttatttacttgctgtcgtttcagcaggcccatcccctctctcctttcccctccttgccattttctgtctgatgactcttccttcttctgagcaggttttcagtcctttcttctaggaaattcctctttgtggttcctaaggaattcactttgattagaaatgaaactgtttctttccttttccccttcctctcctccacaacactttccttcttgtagacaggaaagtaaatgacttgtttcagaagaaatctacccctctcttgagctccattcaaaaccccaacataagcgactggacttgaactttcgcaagatttccatgtctggggtttgttgttcacatgtcacttcaggactgatctccaggaagtgtagtttggtgtcggctgagtcagatctggtagtggaagactgcgacagctgcctatccagctctcggtgggctcctggactgcccttgggggcagtttctcacccaaggggaccaggccctgaggaatttattcccatgagcctgattcctttcatttttatttttatttttttgagatggagttttgctcttgagtgcagtggtgcgatcctggctcactgtaacctccgcctcctgggtttaagtgattctcctgcctcagccttccgagtagctgggattacaggtgcgtgccaccacgcctggctaatttttgtatttttagtagaggtggggtttcaccatgatggccagggtggtctcaaactcctgatctcaagtgatccacctgcctctgcctcccaaactgctgagattataggcgtgagccaccacgtccagtcttgagcctgattcttataagacagattgctcaaggcctggtcaccaacctgcttatggtaggtggaccttcccaccttctctggagggcagcggggtgggagcagggggtggtaataccatgtgtgtcatttggtacatatttgctgccaattcctaagaaaccaaatcagtaatttcctgaaggggaatctgagcaaagcgcatggcatggtgccgagggttgttcatcctcccacgtggggctgggggccgaccccactgcccacaggcacattttctactgtggacaaccctgtcagctggagccagcccaaggagtggcacacagcctcacccttcagtgcctttttgctctactcctgcccatgcttacagtttacctttcattggtgcagcactgagtgctctggaacacacattcctcctgtagttgggcttgtagttgttaatatcatattgcccatctccagggacaaatttgggatattcactctttatttccatgaagagcccaatctagggtggttctttttattttttttttaaacagtctcactctctcgcctaggctggagtgcagtggcatcatctcagctcactgaaacctccacctcctgggctgaagagattctcctgcttcagcctcccaagtagctgggattacaggcgtgcaccaccacgactggctagtttttgtagttttagtagagacggggtttcaccatgttggccaggctggtctcgatctcctgacctcaggtgatccgcccgcctcagcctcccaaagtgctgggattacaggtggcatttcctatcccttccattgtgtctcagacctgctggccttcacaattacggcgtagtgaagggaccttgtgagtcttggtcgaccctcaccccgggtggctttctgctttggactctgggtcaaagcactggcgtcacagtcattcgacttgaaccaccaggagctcccccacttaccaactgtgagatctggggtaagttatttaacctctttgcctggtttctccttctgcaaaatgggtgtgataataatacctttttcactgggataggcggcaagcactagaaatggctgtttctctggctgtcactgtcattgtgatgattattggctctgataaggaattgtagaaaagcctggcccaaccacaagggagggaagagcagccccaggcttcttccaggatgtctcaagggcgcctggtggcttcaagccctgcccttgcctccctggttggggcggacctgacatccctccccgcttggccctatccaccctatcattgtttcccaacccctgactggggtgtcggaccctcagcccctgtttaataaatagccatattcaactttcctagacaatttttgtcttaaaaaatgtaaaaacggctgggcacagtggctcacgcctgtaatcccagcactttgggaggccgaggcgggcggatcatgaggtcaggggatcaagaccatactggctaacatggtgaaaccccgtctctattaaaaatacaaaaaaatcagccgggtgtggtggtgggtgcctgtagtcccagctactcgggaggctgaggcaggggaatggtgtgaacccagggggcagagcttgtagtgagctgagattgtgccactgcactccagcctgggagacagagcaagactctgcctcaaaaaaaaaaaaaaatgcaaaaacacactttcaattattcaccatttccccacagtaactaagaaagaccaaactgtaccttcccatctctctatagtgatcatggctttgcttgctggacagggctttggttaataactctaataatcagggaaaaagcaaaaacaacacaatagaggaatggcgcataggaggcaaaatagaagaaactgaccagtcgcattggctcacatctgtaatcctaacactttgggaggctgaggcaggcagatcacctgaggtcaggagttcaagaccagcctggtcaacatggtgcaaccctgtctctactaaaaatacaaaattagctggacgtggtggtgcatgcctgtaatcccagctactagggaggctgaggcaggagaattgcttgaacccaggaggcagaggttgcaatgagccgagattgtgccactgcattccagcctgggcgacagagatgctgtcttaaaaaaagagagaagaaacttacaagctgggtcaccgttttttttggttgccttctaaatgtcggagagaatatgctttccacatgaagttctccacagagacaaagaatcatgtacttttttcttttcttttctttttttttgagatggaatttcactctgtcgctcaggctggagtgcaggggcacgatctcggctcactgcagcctctgcctcccgggttcaagtgattctcctgcctcagtagtatggactacaggcatgtgccaccacacctggcaaatttttgtatttttagtagagatggggtttcgccatgttggtcaggctggcctcaaactcctgatctcaagttctctgcccatttgggccttccaaagtgttgggattacaggcgtgagccaccacacccggctagaatagtggaatagtgtacttttgatccaaatttctctctgcctcttttctttctctctctttctttctctctctctctctttttctttctttctttctctctctctctgtctccttccttccttcctttttgcattttggcaatggcctttcacttaatgtcttttctctttatgctccgtctttgggaggaatgcgtgaagagttggttgtgggtgggagacatggtgaagaaggctgctggcatggctgtagtggaggaagccaggtatgtcctttcattaggtcagatcatgtgagctgcatggagctcggttcctttcatatggagaacctggggttaggatgtccctgtggccctagatggcctcactttgttcccctgagctttagaatcttcgtcctcggcagggttagtgacgcacaacacctgaggcttcgagttgcatttagggaagaaagggatcatggcgctccctgttcagctggcgagccgtgctggagccctgccatggtgcccccgcaccctcctacccctgctcccattcctccccgcccctcacccacttcccttcacgatggcctaatgggtctgatgactctctgaggactagttacaaataacatttgcatggatcattgaagcgctttttatctcattatgtcacttagtcctcacacccactctgtgaggtggatattcttgtcactggcattttatagaaaagaaagtggaggaggaacagagggtgaagaaggcgcccaggctccccccgggaagcgcagacccggctggtctcagggccaagacttccagatccaaatgcaagtcagaagtcgtcttctctgaggagatcgagacagacggttgtggaagtggttacatgactgtgtgtcagaacatagaactgtacaccaaaaaagggaattgtactgtacatgaaaaaggggaataacaacaaaagatagatggtggagagcacagacggtcaaaagatggcttcagcatacagttgacccttgaaccacacaggcgttaggggtgctgccccccacacagtcaacatccatgtataactttttttttttttttttttggagatagagtctctctctgtgtcacccaggctagagtgcagtggcgcgatcttggctcactgcaatcttcgcctcccgggttcaagtgattctcctgcctcagcctcctgagtggctgggactataggcgcccgccaccacaccaagctaatttttatggtgtgatcacggctcactgcagcctcaacctcttgggctcaagtgatcctcctgcctcagtctcccaagtacctgggaccacaaatatgtgccacaacactcggctaattttttgtgtttttagtagagacggggtttcaccatgctggccaggctggtctcgaactcctgccctcaggtgatccacccaccgcggcctcccaaagtgctgggattacaggcacgagccactgcgcctggccaggaaaatatattgactattcattaagtggaggtggatcatcaaaaggtcttcatctgcatcttcacgttgagtagctgaggaggaggagaaagagaaggggttggttttgctgtctcaggggttgccgaggtgaaagaaaatctgcaagtggacctgtgcggttcaaaccctgttgttcaagggccaactatggtgtggtaagagctatggtaccttaacagacactccacggggctgggagagaagttgacttggatggggcaccatggcacatgttgggatgatggcagtctttcgtatcttgcttggagaagtagtcacacagctgtacatatttgtccatattcatcaaaatatacacctaaggctgggcaaggtggctcacgtctataatctcaacactttgggaggccaaagtgggaggatcgcttgagcccaggaattcgagactagactgggcaaaatagtgagacctcatctttacacagaattaaaaaattagccaggcgtggtggcacacacttgtggtcccagacactagggagactgaggcaggaggatcgcttgagcccaggaggttgaggctgcagtgagccatgatcacaacactgtactccaacctgggtaacagagtgagaccctgtctcaaaaaaaaaaaaaaaaaactacacacacacacacacacacacacacacacacacacacacagagttaaaatgtgtgccatctactaaaattcagtaggttttataaaaagtcagtaaaatacaggaatcacaaaaattgtgcatacatatatacatttatatgtattttaaatagtttgttttaattgaaaacatttagctatacagtcatttgccaatcttttgttgaagggaaagttctttcctttttatataggtactctgtttggtattccttgtggcctttttctttttccttcttcttttttttttttttaaagatgaggtcttgctatgttgcccaggttgggcttgagctcctgggttcaagtgatcctcccaccttgacctcctgagtagctaggaccaccggtgttagccaccaccccctcctatggccttcttttgcagctgggatgtgttgtgtgtcatttccagtttccttaaagtggagtaagaattaaaagtcacttggaaggaacctgggtacagaatccccctacatttttattactgttctttctttttggccaaattgttactgtcttgcctaccttgaattcaacagcaatttcttctagctacttatatttgtcaaaaatgttcaaaatactcactttactttttttagaaacaacgcgctttctttcacatccatattttatctgtgtaggttatatttaattaagttatgtaaatataataccaaaaacaactggcataaacaggtttgggactaaacataagtgattcttggaaaatactccgaaagttggagcagaaataaatgcatggccttcctagagaggagcttgcctgcggcacgtgtaacgtcagttgatttctggagggactggactatcttggtggatccagtgtctcggctctggggactccagcgctatcctgtgcccctgccccttcctgctcggctctgacctgctccctcctcgctgcttccattcctggttctttcattttccttttttttgagacggagtctcactgttgtcgcccaggctggagtgcaatggcatgatctcggctcactgcaacctctgcctcctgagttcaagcgattctcctgcctcagcctctcaagtagctgggattacaggtgcccactaccacgcccagctgatttttgtatttttagtagagatggggtttcaccatgttggccaggctggtcttgaactcctgacctcaggtgatccacccgtctcggcctcccaaactgctgggattacaggcatgagccaccctttcctggttctaatttgtccacaggaagtaatgcatgtctacttcttgttttctacacagcagcccttccagtgtttgaattcagctatgttgctctccctggatctcctcttcagcctcgcccatctccctttttcaagaagtcctcaggcgacatggtttccagaccttacatggtcctgggcactttctctaggtgtagactaaagcgcattgctcaggactgccttctcctgtttgcccaggctgctcacagaaccttgtccatcctgcctagctgcgggacacaaacactgcaggtagaaattctgtagctatacatttaagattgggggtatggcccccccatttctggaaagtttatatgtcaggccttaatgatagagctattgtctacataaacatttacgtttttaaaaaattttttatttaatttttttttttttgagacagagtctggctcttttgccccaggctgnnnnnnnnnnnnnnnnnnnnnnnnnnnnnnnnnnnnnnnnnnnnnnnnnnnntggcatgatctcagctcactgcaaccttcgcctcctgggtggtggcgcacacctgtaatcccagctactcaggaggcccccccaggagaattgcttgaacctgggaggcggaggttgcagtgagtcgagatttcaccactgcactccagcctggggtgacagagcaagactcctgttctcaaaaagaaaaaaaaaaaggcaacttcatttcatatgattcaatctaacataaaagtaacaaatgtattcactgtggaaagcctggaaaatactatgtagtatgaaaaaatattacccataatattatttctgaaggataactgctattaacattgaggcttctcttaaacgaatatcagttttcttctatattatgaagcactattgtaagaaaataattcaacctagacaggagtacaaagaataaaagtgaaagtcctccttccttcccttgctccccttctcataggtacccattgccaaatgtttggtgtggatacttccagagatctttctgtgaattgcatatttatgtgactctatgcacatttaggacagatacattctttatataagcttatgcaaatcggggaagcaaagctctacacacccctctatggtaactgtagtttcctctcaaggggatgagatgcctctgccgtctgcagccctgcctccatcagctgggtggtgccactcgaggtccacactggtggcctccttgagccacagccacctctcgagctgaggaagagtcagggctggtctagcaagctgcttctgcttgcttccatctgcagcagcaagaaggcatctttcaagggcctactgggcaggaaatccagggacagttcggcctggcaggctggtggcagaggtggctggggtgacagcagcattccagccgagagtgaggtcccgctcttagacaaacatgggctttggtcgcaagagaatggtttatttattgggattgaagaaggcatcaaaatcaatacagtcatcacctcacagggcagaagagcggatggtggtttggggagaaggaggcggtgtgccaggaggagggaagcgtggcccagagttggatgcctggggccctgggcagcgcagctgacctccctgggcctctgtgggtcagctgcctagggagttgcctaggcagttggcaactgcctagtggctctgcctagggagcagaggtagagacaggtgagctgggaaaaggtgggaggggtagggggacattggaagccagtgacaccgggattcagggtgacaaggggcatgaggggacagtggagtgtttggaggctattgagtgtgtggttgtgtggtgagaacagggagaatggtggtggagctggagggagggcaggtcacctgccgtggtcgtgcttggcgtccgcgctggagttctctggcggtgaaagggtttccagtgtgaactggagctatccccaggctgcagacctcccactgctgagctgctgttggttgcgtggtaaattttgcttttgttctcccagtcttaggaattctgtttgcttccccgaacctcccaggcttccccaggcaagggttgtctccccagagacctggagccgggagctgtgcggtttcctgggacctgtggcttctgctcctttgctttgtggaaaggaagtcagaggcggaaatgggagggctcctttccagtgctgcagggctccattgagaggctgatttgagagtgaagatcttcggaggatatttcctctggctgagtgtaattgacttaatctgtggtgtggctcatttttccttttggaaaaaggagagatggcgcctgactcaccccttcatgaagcactgtgtgaagtacacgaagcccctctccccgaggacagccctgcataggtgcattcccacacagtcagtgtcccgactcccatcccgcagacagtaggtccactcccttcctttcttctcggtgcgagggtggggctcaccccacggtgatggaaaggcggtcctcgagcctccccgggggcctctgtggcgcacgaactgggagagtggagagaaaagcccctcaggaggaggagtactgagctgggccgtgaagggcacgttggatttcgatcctgaggtcagtaggggaggggcagtggcagtggcttgtgaacaaaggtctgggggtgaacatagacggggtagtggagaacctctgactggagagttgggtgcagtagtaacaaagaagcctggaaggttatttgggatctgaaatggggaggagtaaaagccatatgagacagttctgactccattttgtagacagtgggcagccattgaaagctttggagcaggcagttgacctgagccctgctacctttcaggaagatgattctggcagcgaacggtgatggctgtgagcagcagagtatgtgagaacctgcctgaacgtggcgggatacaaggagctgacctgagccaccgaagcgggtataggagagagagggattcgttcagccagcatagacggagggcctgctggtgctcagcatattagaaggtgcaaaatggaaaagtctgggttgttgtccttgctgaacttcccgtgtgagtgtgaagatttcaacacactccccataaactgatgagagactatttcaaatcacccatgagaaggtggaggaagagaacagccagccacatgtgacatcgtgatggtagagttgggaggaacactgaccaagcacctgtttcgcgccgggcactgtgtcaggtgctctgatcctctccccaaccctggggagatttcagagagagactgaggtgctttctcagggacacacaggcccttggcaggtgaggctggtgttcagcttctgctctgtccagtttcagagtcttggctctttatgccaagggcagggggctttgaaccaggccttgaagttagtggtagcaatggaggtgggggtacattctataagaagtcccagaaagagagagggagagagacaaagagagagagaagagggaggaggaggaggaggagaagggggaggaggagaaaaaggagaaggggaaggaggaggagggtgtggctgaattagagaccaggaatggcagttagggaaagatggggtacaggtatggtaggcaagagggatatggttgaaagagggtgggtggctggtctctttcttcctctgatctaccatgatgtcatcttgcgaaaagatgatgagacttctgcttccagtcgagagtgagcaggacagcctggaattattctcccactgtaaacaactaggagctggataaaatatagggaccaggcaatggtggactgtgattccttggaaaaagaagactaaccgagtgagccctatcgttcattacctagcctttctacctgaagagaattctaccacagggagggagaacccaaacggagactggcgagattactaagttgagggaacagagatcagaatttggagacaccaagttctaaggtttctagaatctgtgggacagaatcctaaaaggaagaagctggaaagagaaagatctccagaaatctcgatagaggcctcctggaatctcggtgaatatcaatctgctcatgcacagggcaaccctgtgagaccagaagagaacaactgcagagggagctgtaagacaaacaggatagagccaacacaggaccagggttcactggagtcctctttaaaagaatatgacaaaattatgcattgaaaaatggtaacgtttgcagtgtgagacatccagcaaaaaattactagacaaagaaggaaatgtgactgacccactaacaaaaaaaaagtggtcaatagaaatagacctagcaatgacaaagatgtgatggaattatcagggaaaggacatgaaaataacttttttttttttgtaacagaatctcactttgttacccaggctggagtgcagtggcacgatctcggctcactgcaacctttgcctcccaggttcaagcgattctcctgcctcagcctccggagtagctgggattacaggtgcatgccaccatgcctggctaatttttgtattttttagtagagatggggtttcgccatgttgaccaggctggtctcaaactcccgacttcatgatctgcccatctcggcctcccaaagtgctgggattacaggcttgagccactgtgcacagcccgaatataacttttataaatatgtttcatttgatcaagcatgtaaatgaacacatcaggatgatgggaagagaaatggaaagtataagaagatccagtagcacctctagggatgaaaaatcaaaatatcaactacaaaatcaaaaatgaaaagctaggtagataggattaatagtagattagacagtgcagaagaaatgatcagtgaattgaagctagagcaataaaactatctaaaattaagcacataaagataaaatattccaccctgggcaatatggtgaaaccctgtctctacaaaaaatacaaaaattagccaggagtggtggcatgtgcctgtggtcccagctactcaggaggctgagacgggaggatcacatgagctcaacggcataggttgtgttgagccaagattccatcactgcactctagcttgggtgacagagtgagaccctgtctcaaaagaaaaaaaaaaagaagaagaaagaaagaaaaaacattgacaaaaggtaatactcagagcatcactggcatgtgggacaatataacagaccctaatatgtttaattgaagtctcaaaagaacagagagaaagacagaaaaaaatatttgaagaaataatggtgggaaaacgtccaaatttgatgaaaactcaacccatgactcaagaagctcaacagaatacaaacaaatataaggaataagaatgaagagaattggtcaggcgtggtggctcatgcctgtaatctcagcactttgggaggctgaggtgggcggatcacaatgtcaagagatcgagaccatcgacaaacatggtcaaaccccgtctctcctaaaaatacaaaaattagctgggcgtggtggtgtgtgcccgtagtcccagttactcaggaggctgaagcaggagaatcgcttgaacccatgaggaggaggttgcagtgagccgagattgcaccactgcactccagcctggcgacagagcaagactccatctcaaaaaaaagaaaaagaaaaatgaagataattacatcaaggcacattgtaatcagattgcttaataaagatacactcataaaagtaaccagaaagaaaacaaaaaggaaaaaaaagacacacgacatagagaggaacaaagataagaatgacagcagatgtgtggtcagaaattattcaaggcagaagacagtagaactgaaaaagaaagtaggtcaatctagaattctatacccaacacaaatatccttcaaaaatgaaggtgaaataaacactttttgatggacaaactgaagttgagagaattcgtaaccagcagacctgtagtacaaaaaatgttgaggcaagttttttaggcagaagaaaaatgatactagatagaaatttgggctgcacaaaggagtgaagaggcttccaaatggtaaattatatggaaacatatgaaagttatcttttctcatttttaatctctttgagaaactgcttaaagcaaaaatataaacaaggtactttggagtttagaacatacatagaagcaaaatgtatgacaaaaatagcacaaaggacaggaggggagaaatgaaagtatattgttataattttcttatttatctttatttattgttactagtttttagagacagtgtctcactctgttgcccaggctcgacagcagtggcacaattatagctcactgtagcctcaacctcctgggctcaaggtcttctcctgcctcagcctcccaagtagctgggactacaggcatataacagcatgtctggctaactttttgtagaaatagagtctcaccacgttgcccaggctggtcttgaactcctggcctcaagcagttctcccaccatggcctcgcagagggctgggattacaatgtgagccaccacacttggctgtaattttcttatatgcaaagtaatagaatatttgaactagactgtactaagttaatgtttactctaagtcccagagtaatcactgaaaaagcgtaacaaagagatatgactcataagccaataatggagataaaatagaatggtaaacaaaaatcattcaaaagatggcaaagaaagtgggaaaaaggaacaaagaacagtaagataagtagaagacaaaaaacaagacaacagttttaaatatagccatattgataatattaaatgtaagtgatataaatattcagtttaataggcagatattggcagtggctcacgcttgtaatcccagcactttgggaggctgaggaggacagattgagctcaagagttcaagaccagcctgggcaacatggtgaaaacctatctctacaaaaaatactaaagttagccaggagtagtggtgtgtgcctgtagtcccagctgtttgtgaggctgagatgggaggatcatttgagcgagcctgagaggtcgaagctgcagtgagctgtgatggtgtcactcactccagcctgggcgacagagtgagaccttgtcttgaaaaaagaaaaaaaaaaaagacaggtattgtgcagtggataacaaagcaagaaccaactatcaactatcataaagaaactcatcttaaatataaagacacagatagactgggtgtggcagctcatgccttcaatcccagtgctttgtgatgcccaggtgcaaggattgcttgaggccgggagatcaagaccagcctgggtgacagagcaagaccctgtctgtacacaaaaaagagaccctgtctctacaaaaagaaattttctcgctctgctgcccaggctggagtgcagcagcgtgatctcggctcactgcaacccttgcctcctgggttcaagtgattctcctccctcagcctcccaagtagctgggactacaggcatgagccaccacatctgtcctctacaaaaaatttttttaaaaattagctgggggtgatggtatgcgctggtagtcttagctaccttggaggctgaggcaagaggatggcttgagtccaggagtctgaggctgcagtgagctgtgattgcacaactgcactgcagcttgcatgacagagcaaggcccagtctcaaaaaaaaaaaaaaaaaaaagacacatagattaaaagtaaaaggatagaaaaagacattttgtgcaaaccctaattaaaagaaaaataggccaggtgtggtggctcacacttgtgatcccagcactttgggaggccaaggtgggcggatcacttgaggccgggagttcgagaccagcctggccaacatggcaaaaccccatctctaccaaaataaataaataaataaataaagatggtgtggctataagtaccagacaatatatactttggaacaagaaatattatcagggatagcgagggacatttcataatgacagaggaatcaattcatcaaaagacatcataattctaaatatgtatgcacctaatgacaaagctgtaccaaaggaatatttatagaaccctgcacccaagaactagagaacatacattcttttcaagtgcactgaaatgttctcaaagacacacaacctgttacaaaacaagactcaatacactttggctgggagtggtggctcacgcctataatcccagcactttgggaggccgaggcgggtggatcacgaggtcaggagatcgagaccatcctggctaacacagtgaaaccctgtctctactaaaatacaaaaaattagccgggcccacttggtggcaagcgcctgtaatcccagctacttgggaggctgaggcaggagaatggcgtgaacccaggaggcagagcttgcagtgagccgagatcgcgccactgcactccagcctgggtgacagagccagactccatctcaaaaaaaaaaaaagactcaatacactttaaaagattgaactcatataaagtatattctctgacaaaaatggatggaagtagaagtaacagactatatctttaaaaatcccaaaatatttggaaacacatgcctaaaggaaggaaaaaaatcacaagagatcttagaaaacatattgaattaaatgaaaatgaaaacaacatgctgaaattagcagacgcagacaaagcagtgctttgaggataatttgtagcattaaatgcttatacagtagttcccccttattcgtgggggctgttccaggatccccagtggatgcctaaaactgtcagtagttctgaaccctatatataccatatttttcctatatatacgtatctatgataaagtttaacttataaattaggcacagtaagagatgaacaacaactgataataaaatagaacagttataacagttggtacacattttctgtttgtgtcttccacccacaaacttaatacctttttcatctttaagccctttactatgcactgtagctgttacttttgcagtctgaagtgcaacagcaaaactcacacaaatttatctttcccttttcacaagttcacatatagaagatttgctcttaccctagatcttcgccacctcaacgtatgatctttcctttggttgagaaattttttcttttcacttaaaggaaacgctttatggcttctctttggcatatctgaattgctagcatcactacttttatactttggtgccattataaagtaaaataagggctacttgaacagaagcactgcagtaccttgtcagtcaatctcataaccgagacagctaccaagtgactcacaggtgggtagcatggatagtggggatatgttggacaaagggctgactcacatctctagtgggacagagcaaaattgtactagagttcatcacactactcaatttaaaacttatgaattatttatttcttaaatttttcatttaatatttttggactgtgattgaccttgggtagctgaaaatgcaaaaagtgaagccacagataagggagactactgtattaataaagaagaaaggtctaggccgggcgcagtggctcatgcctgtaatcccagcactttgggaggccgaggcaggtgcatccttgaggtcaggagttcgagaccagcctggccaacatggcgaaaccccatctctactaaaatatgaaaaaattgctgggtgtggtggcatgcctgtaatcccacttacttgggaggctgaggcatgagaattgcttgaacctgggaggtggaggttgcagtgagccgagatcgtgccactgcgctccagcctggaggacagagcagactctatctcaaaaaaaaaagaagaaaggtctaaagtctgtgatggaagcttctaccttagaagcttaaacctttagattgaagtagaaaaactagatccagagaaagaagcagaaaaaaaaattagtgggaaaacattacaaatcagtgactccaaagctggttatttgaaaaggtcagtaaaatagataatcctctagctagatgattgggaaaatgagggaggacacaaatgaccagtaccgggatgcaggtgagcatgaatacagatcatacagacactcagagagtcataagatgatgtcataaacaactctgtgccaatacattgaacgacttagacaaattggacaaattacttgagaggcacaaactatcaatgttgaatagccccatatccattgtagaaattgaattttggtttaaaaccttccacaaaggaaaccccagcctcagatggtttcagtgctgaatttcatcagacatttaaaaatgaaataataccaattccacataaattttatcagaaagtagaagaggagggaacatttcccaacttattttatgaattcaatattgccctgatatcaaaaccagacaaagacgttacaaaacaaaaactccagatgaatatccctcatgcacatgtaagcaaaaatctttaacagaatattagcaaagaaaacctggaaatatataaaaagaataatatataatgaccaagtagggatttgcacaggaatgcagggtggttttaacatcttaaaattggtgcagtttaacattagcctactgaaaaggaaaacccataagatcatctcaattttgtcaaatgcagaaaaaagcatttgacaaaattcagcatccattcagataatacctctcagcaaactaggaaaagaagataatttcttcaacctgagaaaaggcatctttgcaaaacctacatcatatttaatagagaaagtctgaatgttctctttttaaccaaggttggctttatgagcacatgacttgtgcagtctggaaattcttaacaattttatttattcatttatttatttgagacggagtttcgctcttgctgcccaggctggagtgcaatggcgcgaccttggctcactgcaacctccgcctcccgggttcaagcgattctcctgcctcagcctcccaagtagctgggattacaggcatgtgccatcacgcctggccaattttgtatttttattagagatgggatttcaccacgttggccaggctggtctcaaactcctgacctcaagtggcccactcgcctcagcctcccaaagtgctgggcaggattacaggcgtgagccactgtgcccagccaacagttttatttttgaacttatgttttgcagctgaagcctgctgagacaatggaacatgcatatgtactgaagaaatacatacaagatgagtacctgccatatgtttttgtgtcatttgcatatttgtgtgtgatgccccggcaacatggagttctggtgaattcacaatgtctgggagttgagcaagatgcaaaacaagcgcaaaataacatgtcgcatccacagctgagtaagtagaggtactgacagctctgagattttgtgctttctgttcaaactagaacttgcttcaaatacagaaagaaggcagtgacattctcagaaacatgaacatcccatgctgcttccctgtattggccaaccatttaatgctgaaattaatgacacagaaataaaagggaaggtaggacacaccctaatagctttcattccttcctcacgcattataagctgaagatagtgttagcagaaggtgcgtgtatcaataaatgaaataaaaacagttgagttttctgcagcctttccactgtttttgtttttgagacagagtctcgctctgtcgcccatgctagagtgcagtggtgtgacctcagctcactgcaacctctgcctcccgggttcaagcaattctcctgcctcagcctcccgagtagctgggactacaggcacatgccactatgcccagctaatttttgtattttcagtagagacggggtctcaccatattggtcaggctgatctcaaactcttcacctcaggtgatctacccaccttgacctcccaaagtactgggattacaggcctgagccaccacaccaggccctttccaccattttggtaaaataaaatacatatatacatatgagccaagaaatactaattgccatgtgaggcaattttccatgtgagaaggttgcagagggaggttttaagggactttctaaggagtgatagaacacaagccagtttggctccaaagacagtgcttattccacggcatcacactccctcctgttgtaggggctggaggaggacttgttgactaatggtgtgaaggttaattggtgtccccagacacaggcagccactgtgggctgggaggtagtcggtcagttcagcaccggcaggtggctctagcagctgctggcactgccatgagggtcttcccgataatgagacgtggaaagggatgggacaggagctgagccgtccagctgggtggcagggtcctggggccaggatgtgcagctacactgcagggcccaaaacccagccagtgcacagtgacacaggcagcattccacctcagaggctggacaggcaatgggggaggaccaggggatgggaacttacttgagagctgttgtggtttgaatgtttttgatgttccgaatgtgtttgaatgtttgtgatgaaatttgagttttgttgaatctgtggatacagaggacctactgtgtacaaggcagtgtttgaggatggagccttagaatgtcagcacagccaaatttggggaccattgacacacattgccttcccaggtgatgaaaatgaccttgactcactcaagcagactcagaaagctggagaattgggaataaattcaggagtaaccttgggaatttataatatgcctaacaataataggtaacacttagatgtattgtgtatctggcacagtctgatgctgggctctttacacacatcatagaggagtctccaacccaccctgagatgggcctgtggttatttgcatttcgcaggggaggcagcgagtttaaagtgtggcaacttccaaggcccaggcccatgatggagatgaaattccactccagcctgagtttggagctgcattcttcaccgccatgctttcctgccccgagtgttggcctcaccgagaggaggtgtgtgtgtcgggggggagtgggctgggacacgtggtcatgggggcccacagagccagatgccgggggaaccaggcaccctcaggagccatcacggctatcgctgcatgatgccggtgaacccctcgggacttggcctggttttcgacctcttggcagccccgagtgttcccaggctgtgaaaatccccccaggtgcagtggctggcctggtctccgagggaaaggagccgtggagctcgcaggtggaaggctagagagagtaagtgatacggttaggctttgcgtccccacccaaatctcatcttgaattgtaatctccatcatccctacgtgtcaagggagagaccaggtggaggtagttgaatcatggggtggtttcccccatgctgttctcgtgatagtgagtgagttctcacaagatccgatggtattataaagggctcttcccctttcgctcggcacgtcttcctgctgctttgtgaaggaggtgttttgtgaccctttcgccatgattgtaaatttcctgaggccttcccagccatgctgaactgtgagtcagttaaacctctttcctttataaattgcccggtcacaggcagttatttatagcagtacaaaaacggactaatacaggaagaaagctggggctgctagggagaagttaagaccaagagtgagccacggggtgtcacttgtgggggactgtcgagttggtgatttgcacccctttgtgccagccaggcccagcatctgcctagcagagccccagggaccggcttgccttgtgcagcagctaacctcacccactcagggcacatggcagcctccttgccagctgggcttcccccttcccctccccagggcaggctcatccgagtgagtgagagcagtgagtccgtgggcatcgcccggaaccagctccagtttctaaggagagtagagcttttgcgctgctgggagctggatgatgagtggcgagaactggcctggcagcgcagctcacacccatctcggggcgggggtcttctcccttcattcctggttgtcatgaccctgagcttcagagtttctgtgtcaaggcgaagcaggagggcagagtgaggtgactgggttctgtgcccaggtcttgtgggaagatcttagggaggtttatcttcccacctggccctttgcaaggtccgggtggaggtgaggcgtgtttgctaaacatgatgtagcgcaaggaggctcaggtgggctcgatggaggaggcggggttcagctagatttcgagggggaggcggaaggcggccaggtggggaggggcattctaagtgcgtgcttcccacattgggggtgcagggttgtgtttgctttggcgcatgtgaagccacaggatgaccgtggagttggcatttcctttcatcctgtgtcctccatgtattcattccttcacccagcagacagcgtgctgggtgctactgagtgctgggaacacagtggggactgggacagatgtcgtccctgccctagtggcacttacactgaaacaggtggagacatctgtttggcaaatatttttaaacacttaaaaatacaaatacaaacatggattttattgaacagaatgcagaatccacatatattagcaagtaaaatgagaagcttcctccccaggcactttcgtggggaagtttaagagctctcaaaataggggctacagcatgtgccgaggtcaggaggccagttggtgacatgctgaggacgtcagcttggctaaagcagatggtttacctcaggcagctgtgggggcggggtttagattcaagttcatggtaaagcccagagtatataggaccctgaatgccagaatgaagattttgaactcttggacaattggcagctattgaggtgttttgagcagaaggtggtacttgcaaaaatattattttggaagattaatgtgttccagggtggattggcaggaccagggagatgagtctgtccccagccctgtgggaagtaagggtgtgagccaggtggtggcagcaagagtgaggaaaaaggagacccagaggcttttacctggaaagaccagctgggatgaaggacctgctggaggcacagaaaggagctcagtgagagagagcaggctggcgctggttcaggcgttcagccaatgttactgaggacctgcgccgtgttgggtgctgtgttcctagctggggcgtagtgttggcagaagtgagacctgtggatcagggctggttaggggagaccatgacaagcttgggtgttcacattgactttagcgttttccactcctggtcccgccataaggtctcctggaaacttttcagcaataccagtgtctgggcctctggttccacttttgtggactctgcctgggcataactccccaggtgattctaaggcacagccaaagttgggatctgctgagtgagggtgaagtgagcacctgcaggtggtgctcatcaagacagtggaggctgaggaactggaatttaggagaggtgatagttcaccagggccttgaacttgaattttggaatttggaagtctctgtcatgtgactaagagagtgcattgagaggcctggtccatgacctgccatggtccttccagaccagagtctctcaggacaagaagaaggaaaattggaaaggactttaaatctgaattgaaaaccagggaactgaattaaacgcaggagacatgaagcagcatcaacaggtggaaagcaccgccgtgggtggagctttgaatgtgtgggagacatgctggtcagaagggaaaaaagatggtaaaagggtacctaactcagggtgagggtgaaccagggatcagaagactgttagaaaatgagggctgggcgctgtggctcacacctgtaatcccagcactttgggaggccaaggcgggcagatcacttgaggtcaggagttcaagaccagccaggccaacgtggcaaaaccctgtctctactaaaaatacaaaaattagccgggcgtggtggcgggcacctgtaaatcccagatactcgggaggctgaggcagaagaatcgcttgaacctgggaggcggaggttgcagtgagctgagattgcaccactgcacttcagcctgggtgacagagtgagactccgtctcaaaaaaaaaaaaaaaaaaaaaagattattagaaaataaagacaataaatgcatagaagaaaaataggggataggcataggaagatggcctaaggcagcagcatgagagtttggtttaaagacccaggaaggctggaagctctttgccttgttttcatatctactactccaccttgaacagtgattctgtagaagagaatcacctggaggagggcacagatgcagatgccggggattctgtgggctaggaccctggaatctcccattttaaccagctccctttgggacgctggtgcacctggcccagaaacactgaactggaaaaacagcaactcaggaacaacgccagaagggttgcatcagaaccagtgactggaaaaaaaaaatgctgaatgtccctgggaaggctgtgagaggctgtagggaagagggaattgctgagaaacccctagaaggactaaaggggagaaaaaagatgtatcaaatccccaggagaaagctgtgattcaggagagcagatgatgtgggtttttgttgcagacggtgtgcaaaaagttttactctcaaaatgtcattttctgaattgaaaggtaggaagttttggaatccaaagagtttgctgtgttccatggccacaaacacaagagaataagggcttggtgtttctgtgtcatcagtgatctgttcccttcaagtttttacattttaagtttgtgtgatgatctatctggattcctaaatatcttctgtctccagattatacacttgtcttcctccgagctggtacatttgctttcaagttcatctaaagttagtttcagaaagtcaggtgatctgtgtgataaatgtacccagtgttgcttataggtaagaaagcatgagcaaaagcatggagccctttcattcctgcctcacttagtattggccgtcagttagaaattggtttcaattttctttatcgtccagaatctatatgcttaaatatatgtgaaagctctgtgttttcagaacatgtgaaaactccaactgagtgtggccagcccaagctttccttcctcatgggggcctttgctgacttctcccctctccctcagaatcaagctgcacatcctctgttcactgctagcttctttttttattttttttgagacagagtctctctgtgtcgcccaggctggagggcagtggtgagatctcagctcactgcaacctccgactcccgggttcaagcgattcttctgcctcagcttcccaagtagctgggactacaggtgcccgccaccatgcccagctaatttttatatttttagtagagacggggtttcactatattggccaggctagtcttgaactcctgacctcgtgatctgcccgcctctgcctcccaaagtgttgggattacaggcttgagccaccgcgcctggccctttttttgagacagggtctcactccatcatccaggctggagtgcagtggtgtgatctcggctcactgcaacctctgcctcccgggctcaagcagttcttgtgcctcagcctcccaaataacttgggactacaggcatgtgccaccatatacccagctaatttttgtatttttagtagagacggggtttcaccaagttgcccaggctggtctcgaactcctgacctcaggcgatccacccgcctcggcctcccaaagtgctggaattacaggcatgagccacggtgcccggccactgctagcttctttactgccagtagagtcagctccttgaggtaattttataatctccagggcccagtatggggtccgccactcaccagagtattcaatagagttgaactgaccactttgtaaaaagacatgagaccaaacatgattcggctttaaaacggacttctttaaatagaattggaattatttggcctagagaaagagaccaaggtgactaaataatgaggtcacatcaataagagaagacaggaaatgctgtgagcagatgtttgtgtgtctagtgaagcagcaagagcagtgggagcttttgaggagttttgtggttctcagtcatctggagtaacagatccttaggagaatctgacaagagcaatggacttgcttcccagagacgggccaagtgtgatttctgccctactttaagggctcaccaactcctccaaagcctagtccaagtgagtaatccctgggttaggataagatgctacatttgagctgtccattcttgcatggaaatggggaggttgaccagatggccttctctggttttgaccatctacacccctgaaacgtgggccttctgggtgggtgcattgatcaggctgttgtgtctttatgttcagtaagtatcaggagcattctcctcttagcccacaaactctacaattgacataaaaataaatctacttgttcacaccattgcttcagagttcattattctctggtagaaaaggtcaagaaaaagttcattgtgaacactcaggaatcaaaaaggaagaaggcgttgttccaggccagggtttcttgacgttggctccgttgacatttggggctggatggttctttgtggtgggggctgccctgtgcagtgtaggatgttcagcagcatccctggcctccgcccactagaggccagtagcacccgctctcctagtcgtgactgtcaaaacgtctccagacacactgtggaatggcctcggtggtgggctgatcacctgtggttgagaaccacttctctgtttatcttcattttggctctcttatcaagggggaacacttcagtggagaatgaactgttctttcagcttctttttaccactgtagctgttcacacagctcacgtttgctatgttccaatagctgtgcaaggccctggggctacaaatgtaagtgacacccatgatctcaggtacttactgcatcctcttgggagatacacacagacgcatcaggagctgcactgagggaaggctgtgcctcatgctgtaggggggtctcctttgcactgctagtgtcttctccacccagaatgcccatccttctggcctctcccgtggctggatcttgcttggcattcacttctcagttgaaatgacactgcttccgagagacctgtcctaacgtcggtgccagctgttttcacctaatgctgcataacagcccagaactcggtggctcatgccaggcattcctcacttgcacatctgtgggttggctggggtggggctgatctgggctgggctcggatggctttggctctaagctgcagcttgggatcagttctgctgtatcagtttattgttctgttgtaccagtgaggttcttagtgtgtggtgttctggtgacgggagaagcacaaaacaaaaagccagccctcatgggcatttcagaatgtgctgcttttatagatgctgaagtctttttggccaaagcaaatcacgtggtcaaagccagcaggaaggaaggagactttttttttttttttgaggtggagtctcactctattgcccaggctggagtgcagtggtgctatcttggctcactgcaacctccgcctcccgggttcaagcgattctcctgcctcagcctcccgaatagctgggattacaggtgcctgccacaacacccagctaatttttgtacttttagtagagatgagtttcgccacattggccaggctggtctcgaactcctgacctcaggtgatccacccgccttggcctcccaaagtgctgagattacaggcgtgagccaccatgcccagctggaaggagactttatactctgcaaggatgtggctgtgtgatgcttttgcgggggagtgaagaactagggccagctgtcttcctcagacctcatctaaagcagctacctagtcactttctaccacttttattctcttttgagctctgatatgcttacatttgaaatattatttctgctaagagcttgacaagggtaaggtcacagactcgtcataacatgtggacctccacaggcagcagaggcaggctgttttggttggagccttggatccctgaaatagcacatcttatagggaggactggagagaggcccattgtgattggagggaggggagcctgttgaggagcaaccagagtcaagacagtagagcctggggccaaggccgccatgttccgtgtctggggaagccatcacgacagatctgtgtagtggcacccctggcagtgcgcaacctgagaagctgctctagctgcctggcagatcatgagggacctggcctaacatgtcagatgggctggatgcctattctggaagtcctctttgttttggaagagggtagactttgaacatctcttaccaaaggcatgcacaagttataagcagaaagcttctggaggcccctttgttttgaggcacatggtggaaacttggcagatacccagctcggaagggcatggcagcagcaccccaggcttgagcctcgtgttgtattgattaaggttgcatttattggagatctcagagtctctcttggtgcagcgatgcttagaatttgcccaaggcagcatgggagagtcactcactgtctgcagaccttatgactcctccttcccacctgcccagatgttccaggtcctaactggatccttagctcttggggagccccctgtgccgcggctgtagccccgccttggcagacacccatcacagttcagctaaggtgatcgtattgagggaggggagccctggccccggggtaagggggtctgggttccggtctcagcgctgctgggagactaggggctcggaagcttatttctctgactttaagtctcttgcaaaatgagaataagaaaactctgccctgcctcctcttgttgtgagaaacaaatagaatgatgaacatgaagattcttgtaaaacgtcctcaaagtgttattattagttactaatttgccttcaatggaagcaaagaaaaagtcatgaaaggggtattttgtgccaagccctgtgtgaggtatgtgcagtctttcagtcttttttttttttttttttttttttgagacagagtctcgctctgtcgcccaggctgcagtgcagtggcgcaatctcggctcactgcaagctccgcctcccgggttcatgccgttctcctgcctcagcctcctgcccaccacgcctggctaactttttgcatttttttttagtagagacgggatttcaccatgttagccaggatggtctcgatttcctgaccttgtgatctgcccacatcggcctcccaaagtgctgggattacaggcatgagccaccgcgcccggcccagtctttcagtcttactggaacagcctgtggggttactgcaagggtgaggagccatgtcagagaggcaggcgacttgctccagggcacacagcctgcgggcagccgtgtgcaggtctatgtgactgcgaggcctgacctcttcccgcccctccatctgccagttgttgcctatggctttctatgtgccagtcccgggtgctggggagccagcagggaaacaacccgtgtcccggctgcatggagtttgctttccaggcgacgaggcgaaggagtgaggacagagaagggcaagtgcagaacattctgtgctgggcctcaaagcaggactggagaatgagtaggggtgggcagggaaggcctctgaggggtagggacatttcatagggacttaaggagccactgcagcagcctctacaggcgtctgcagcgagagtggccccagaagtgggacccatctgtgctgagtggcggcctcacaggctctggctgggcctccttgggtgggagaaggctggttgcctttggaggggccacctcccctcctccttcctgccccatggctgctaggagactttttcctaaagcatctgagtaagttttaatgacgagtttcccgtgcggctggcctccagccgcagaacgtcataggtctctgtgggcgacacggacactgcaccctgagcagctttctcttgctcagcttcttctccacagttccagagtgttctggaaccttcaggctggaatgagcttataggaagagattggtttgggcaagagagccaccaaaccgcctccagtggggtgacttccactcgacagtcccacttagagcagccccatttccctacgggttgttagcaaacgtgaaggatcttgcgatgcgtaaacttccaggagggaggattttgtaaaggaatgttctcatggttgcgttctgagccgggatattagaaacactttatcaggctgtcatgggttagatgacactttagtccaagtgtttatccatttgggagatgcattttattattctaaaaatgttgtatattttaaaaaagcagaacaattcttttgaaataagttatttccaggaaaactttaggattaagaaacttgtaaaaagatctataaatagagaccccaggggctgtggacctctgtcaccacagagcctgatcgtgctgtgcagtctaaaggggaccacggggcaagaagaggtgactttggtggtgtccagagcaggcttctcaacctcatgggtttggtgagtcaccccaggacccgggactgggcagtgcagtcagctcccaggtacagctgttgcccttgggcccagaagtaaggcttcgagcgccagctgtctcgccccaggccaaggagcctcttccctctctgtctggtggtcagatggtgcctgtgtgtgtgcagaacactttgagcgggagccctgggaataagttgctcttcatgattccagagagggaggagtctcctgtgtgccactcacccagtgtggtgtctgagctcgtcttcgtgtttcagagagacccccatctttctttaatgctcacgtcttcgtgaagccatcctcagcatcaccctgattggatgtgatctccccaactgttcacacctctcctcctgcctgttggtctgctctgtctgatgttctagatcactcccaaaatgtaccctgtccgctgtcctcaggggagcgaccgagccttgttcctctttgttcttcaggcgggggtggactggggtaggtaggggatgctcactggaaggctagaagcagcaaagctgggtcccaggaaggatctagggccagaaggtcatgtttactgatggcttctgctcagctcgcctgctgaccagaggctgaaggggggaggggtgggtggtgagtctgtgagtgtagagtcgtaacccacatctgtgccacccaacagcgtgaggcttcctgggcacctagggctggatggggccaggatgggctgaggacacagatgtgaggacagtgcccaccttcccgcacacagtggcagggccatgtgtgggggacatgggggaggaggaggggctgccttgggtgcagcagtacaagtgatggagcagatgggaggtctctgcagggctcccaggtggacaggagcctgccaagtgggccaggttgggtagaatgggatgaggggtttgcaaagtggtgggtgtggggaagggccaccctggagggagaagagttctaaaaaggaaggtcacttctcactcgtaccttggagtgggaacaccggaaaattaatcccagatcagcagagctcaaggcctggtgcagagaaacccatgtgtcatggtgacgtgaaagacctatttcagattctcgctagggttcaagttttccccagaggcagaattttttcctgggtcttcagttcttcacctgtaatgagaggcgatcctgatggatgcattttagaggaacggcagctgccctgcttacccagcatcaagttcttcctgcggccacacctgcctggccctggggacagggacgatgtcacgccaccgtccctcctagggccagctcagggccctgctcatgctgaaagagtgaaacttactttttacagacatattttgaggggcacattcattttgctaagtgagatacacatttatgaatatgaaacaggaaatttctgaatcttattagcttagagataatggccaccactgtgtatggaagctgtggaaatgataatggccaccactgtgtatggaggctgtggaaaatctgcaagtattgtttcagatttaaaatgcgtgcagctcacacctaagtgctatagggctagtatcttcgtgactatctaaatttcagttttaaaaatctctaggccaggtatggtggctcatgcctgtagtcccattgttttgggcaactgaggcaggaggatcacctgagcccaggagttcaagactagcctgggcaatatagcaagaccccatctctacaaagaataaaattagctgggacaagtgatgtgcacctgtcatcccagctactcaagaggctgaggtgggaggttcgcttgagctcaggagtttgaggctgtggtgagccctgaatgtgccactgcagtgcagcctgggcaacagagtgagaccctgtctctatctgcaccaccgcccccctcccaaaaagaagtccacactcctttctgggaaaagatggggttgtgaaatatgtaaataagttgaggagtgctttagggaggggttttgaaccatagaataatgagatttgaatgctggaggagatctcaccctctagttttaacaccttgtttaatttaatctcaattccttctgtaaaaccagagtgacatcacctgcctcagcactggttgtaaagttagaggagatgaggctgataaagtgcgtgcttgtgtctaggacttaatgttgtgatgctgaggtgaggatacaggtgaggaaactgaggccgggagggggactccccacccaggctgcacgtcagtgttgcctgggagcactgctgccaccctcgcctcccgtcgctgcgtgagcaccccagggtgctgccaccttcccaggtgaccctgtcgggagcctctcccaccacaagcgcagctcctgcggctcactctggaatcatctctctcaaagctggctcctgcttctgccttgaggttttctgggcttggcagcatcacccagtgggatttgtggcctggccctggaggctgtgagttggcctgtagggttgtggctgagcctcccatcagctacacccacggggggtggggtgggggaggttgggggttgccaagctccctgcaggccttgtagccacgactttgtgggagagagggaccatagggatggaacagggggcagcgccccagggggtcctcctcctcagttgaggcaagttgagagaattgggggtgctttaggaaacccaagacctggcattcacagaattttctagaatcagctcactggcaggcagggagggagttccctggtagggatggacaaccttgcctggccatctcatagggacagatgggacaggctctatcgagtgaacagcactgagcttgtgcaaggagttactgtcattaccccctcggttgtctacctaagacctgctgtgcagcccaccagaacaactgtctcagaaaaacttcacaccaatcaccaaagattatgaccccaggctggaagcagggtcaggcttggctcatgcctggtgacctcctatgtaggacagtatttctttcattgatctgcaagtttttaaaaataaaatctgctttttcactgcacttgtaggtacatacaatatggggacataaattcggggggaaccctggactctgatcctgcccctcaccggctgggcaattttccaggtccaaccactactctgagctccagtttcaccggtgagctgagaatcagctcccctcaaagctccctccagccctgacactgtctggtctttgtccgcctcacttccaaggggaaaagcaaggccagaagaagacctggcccacagaagcccagccgggaaggaggctggagggaaggagaggtggccagctcccaggttggccagagagttaggctggctccagtcccggagcctcccccaagtcacagaggcctccccttcccaacctgcactcacagttcccttctggccccaataaggctggccattcaggtgttgactgggtggcctgaggacatatggtactgaccactcagacaggggtgggttgtcctgccccaacagacttgccccacaaacggggtaggcgactggggctgctcagacccaagaggtcaacaggtcattacaagctggaaccagacgccagcagagcttgggaatctacacccggtgacttgctgaccagcactgagactcgcctgacctcctgattcgtcacgcaacgggcccttgttgagtgccacagaggctgcaggaacattctgccgggtgtggtggtggttgatcctcagggcaagtgttgatcagctctgatgaaacacaacacagttcagggaatatggcataaccaagagaacccagaaaattcatgtgagaaccagcttcccttgttgtctgttagaccatcttgtttaaaaataaaaaattgacttccctgcctttttcacctaccccagaatacagtctactctgaggccaatcttttatcccctgagggccagaaattgagaaattcttccgcttctcttcccatctcatttctcaactccaaactcggttccgagaaaccacacctagcaggcgaggcgtcggggatccagggctgggagggtggccacagcctcgggggaagggcatggagctggcgccagggaagctggaggagccagaccaggaaagaggccttgcttgaaaaggcttactgaggccagtggtcttggaggaggaggaaggattagcacttggtccagccatgttggggcccaggcatggccaaagattggagtagcagcagccaggcctggccgccaggcagggttgggatgttcagatctgtatccaaggttaccccagcaggagaccatcagatctgcagtccctacagcctgtggaagtgggccaggacacctggggcatcttcagggtgccagggatggggaataggcacttgatgccccagaagccctttgagccggggtactgaccttgcaggcagtgggggagacctcaagtcccaggacacccccacaatagcttgagacctgagtattggtactgggcacccctcacctgctggcaggtggggttagctgagaggatacctgtgaatcccagaaaactagaaacctatgacacatgtgtaaggtaaacattgtgactgccgaatcagcctgagacctcttcaggggtcctgccgcatcccaagccatctgagcttttaggattacacagtcctgctcagtgggacctgggatttgtgcaccctccttaccaacaaattggcagagcacctgagtgagtgctgcttgagcaaatgcgtgaaggaatgaatgggtggcagagggtctgctcaggcgtcacaggtggagggactggccagccttgctttgttgggaagccggaggggggatccacagcccctcagccaggcttgaacgcctgcaccctgcccctcgtggaacccttgagcctttcaggccttgagccatgcccctgggtggaccacccatccgtggtacatgtggtggtgtctgaggctctggggtccaaggctgtgctgggcccctccctggacattgggcaacttgaggtttgattttggtcaccacccaccccacctcctccatccccttctccatccccttttctgaagacgtgccttcacccctggccttttctctcttcttccttggggtgcagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggtgaggctctcgggaggcctcgggcctggagcttgggctcagggactgtggccttgtcagagggagaggaaccagagcggcagcccctggctccgtggggcttggcgttcatccaccctgttcaggtgtttgcttctgaactttgtcttctgggctcctcactattagagggcagcttctgagcttcagggagcctctcactcctaaatctgcttctgcttgacccagatctctcctcttctgccttcctgctctttgttttgttttcgtaatgtaaaacttttccctttcaagaaatgcattgcccaagcagccagctatgacttcctgcattcctttctcagatgaccttctcgggaccaaggtcagggtcaggggcatcacgggcattccttcacgtcacgcctccaccaccactcttgctggtccaaccgcagatccaccctgtgcacctgctcatgccgtgggtggggccttgacccatcctgcggcctcagggccctgctgggtgaagtgtgtcagcctcacacccccactcaggggagctcctccctcccttaccttcccatctgaggtcactgctgaagaaggaaaaccagcctgttccccggggatgcccttgtttacattctccatctggagagaggcctcgctgtccctgcctcggtttcctggctttcctccagtctcttccatggccgcaccatcctcccagttctcatgtcactcaggcttgtacatagttttggcctggattaatctcacatgctttttgaaggtctccagaaattacacccaccaatttcctgttatccatagggttatttccccttcaaaaacaaactcaataggttgacactatgattctctgctctgggaaccatgtcatctgtgttcaggaggttctgtgtgctcctgattcactgaaattgctgttttcatagatgctgccactcgggtggacagggccttggtttcgggggccactccggagcccttggcttgcaggagccccaccgtcgggcctcactcacattctctagacagtgctgttccgaggcacacactaagtcatttagctgatgggcctccgattccactgtcctggggatgttttcttcctccccgtttaccaatctcattccttacagaaggcccccataggaggggattttccctggctgccattgtgacaaaggtccaggcttagtagcccatcgtattcgccccttcccctgggccctgtgacctgtggttattgaggagctgctgtggcctgtgtatatttaaagaatcctcctttcctggcttgtaaagccccttgaaaggcattcttcaactctgtttttttttaatactgtctcatttcttgtttgtatctgatctcgcactgtggaggcatccctctgggttctctgcacttaaaaaaaaaaaatgcatgtgtcaccgcctagctaggcgagcattctttttatataacatttgcgcagttttcagcatgtctgtctgcattgatcttgtctgtctcatattgtacaatctaggacatcttaactcacactgaaccgtcttgtggaggccccctggtgtgatgaggaaggccctgtgtttcaccctggggctgttctcgtgtagataatttagataagttatccaccctacagagcctcacttttcctcatctgcaaagtggaggtattgacatttgtcttgtaggtttcttgagggtcaaatgagaaacccagaagtgctttgtaacccatagagcttttttagaggtaggccgagtgcacggggccatgaggcctgctttctaacacccagggccatatgcttcctctgggcagggtcagtgcagggagcctgggcaccagcagagagggtcatccctgggtgccccagggctcctgagggtgctagcagcctgcccgggccacagtggtgcttctctgcattgcctgcccacgctgcagcggcagagcagacattggccccaggatggagaggtccaggttaggtggaagggaggtgcagaggtgtggggggagttgaggggtaaggtgcatcctcaggcctagctgggcacacagccggagcctagaattctccaagtgggatgaatttgtctagccaggctctgtcctgagtgtggccttgggctcgttgctgcccctctttggacttcagtatccccatatgtaaaacttttgagagatttttttttctttctttttttttttttttttgacatggagtcttggtcttgtcacccaggctagagtgcaatggcacaatctcggctcactgcaacctccgtctcccgggttcaagcgattctcctgcctcagcttcccaagtagctgggattacaagcacctgccaccacacctggctaattttttttttttttatatttttagtggagacggggtttcaccatgttggccaggctggtctcaaaactcctgacctcaggtgatccacccgcctcggcttcccaaagtgctggggttacaggcatgagccaccgtgacctgctgagagattgttttaagggtaagaaggaatctatgtgaatcccactgggattggtaaagcactgttaccattgggaaggatggaatcctgccccctgtgagtttccatttacctacattctccttacgtcttctgtctctgttcaagagagaaacctgcctgccattttccttcctttccatgtgcttgacaggttttggtattacggttatgcccaactcattaaataatttgagaagtttctaacccctgatagtttgaagataatttgggttattccttaaatttggaagtcacagccaggcatgtggctggcctgtaggtgtggccaggcaggtggctatgcctgtaatatcagcactttgggagattgagacaggaggatcacttgggtccaggagttcaagaccagcctgagcaacaaagcgagaccccatctctacaaaaaattaaaaaattagctgagtgtggtggtgcatgcctgtagtcccagctacttgggaggctgaggtgggaggatcgcttgagcccaggaggttgaggctgcagtgagccatgattgtgccactgcactccagcttgggcaacaaagtgagatcctggctttaaaaataaaaaaataaaaataaaaaaggccctaatgaagaagtcctataggcctggagtgttctttaggggaagattctgtttccgtcatagataataaggttgttcagattttatatttccttttatataggttttagagaggtttttttcccccagaaacatgtccattcaaattttcaaaattttggcataatattcttaatattttctttttatcttttgtctgaaatgggtaatgatgttcctttttttcattactgaagataatttgtgcctttttaaaatttttcttaatcagtcttgctaaggcttattgttttagcctgttcagcagaccaccgttaatctttgttgctttctttgtacatttcttatctctgatttatttatttattttgagacggagtctggctctgtcacttaggctggagtgcagtggcgcgatctaggctcactgcaagctctgcctcccgggttcacgccattctccagcctcagcctcccgagtagctgggactacaggtgcctgccaccatgcccggctaatttttttgtattttttttttttagtagaggtggggtttcaccatgttagccaggatggtctccatctcctgaccttgtgatctgcctgcctcagtctcccaaagtgctgggattacaggcgtgagccaccgcgcccagcctcttatctctaagttaaactttgtcattgcctcttttttctttgggcttaatttgtgtccttttttaccttcttaaaatggaactttattgttgttttttggagactgaatcttgctctgttacccaggctggagttcagtggcgcagtctaggctcactgcaacctctacctcctgagttcaaggtatcctcttgcctcagcctccgagtagctgggaacacgcccggctaattttttgtatttgtagtaaagacagggtttcaccacgttggtcaggctggtctcgaaacctcggcctcccaaagtgttgggattacaggcgtgagcccccaggtccagccaaaatagaacttcagatgaccgattttcagcctttctttcctaaaacatgcatttaatgctacagatctcactcattacattgtttgagctttatctcacaagttttaatatgccatattttcagtgtcgtttaatttaaaatatttactaattttcattgaaatgcctttgatccatgggcgacgtagaagtgcactaagttctaaacatttgaggatttgtttacaattatgttgttttttatctttattctggtcagagaacatactctaatttcaagtctttgaaatttcttggaacttgatttttggcctagcatgtggtcagttttgatgcacttgagaataatgtatattctgccaaatctgtcaaaatctttaaaaaatgaaataatgtcaactatgtcatatttgcatctgccccaaattagtacttacctctttagtcatgatgcaaggacctcacaaccttttaacttcatttcacaagcctctgccccccactttctgcttattagtataatgtgttttagttcaacatattttaaaccccacaagtccttattgtgattattttatgtaatattcttattaatattctttacttatatttacccacagttttgccctctcaattgctcttcctttctccatttctttgcttcattttcttgaagaattccctttagtattaccttttatgctgatctcttggtaccaaattctctccatttctgattacctaggagtgtgcttattttgctttcattttcgaaagatacctgtcttcatccgttttgtgctgctacaacagaatacctgaaactgggtaatttataaagaacagaaatttactacttacagttctagaggccgggaagtccaagatcaaggcaccagcatttgctctggtgtccatacatggcagaagggtgggctagctgaatgttatgtgatgccccttttaaaagagccttaaccctcatggcctgatcccctcttaaaggccccacctcttaatagtattacattggcagcacctgaattttgaacagacacattcaaatcatgccaagactttttgcagataattctaggctgccattttttacttctagccctttaaaagcatttcactatccttcccgcttccttcattcctgttgaaatgccagttgtcagatagactgttgctcccgttacattaatgcatactttttcctgtggttgctttcccaatgctctttgtttttggttctcagcagttttacgatgctgcgcctgggagttttctttgcagttgctctgcttggtattcaaagagcttcttgaatgttggtttgacatctctcgtcagttttgaacattttcagccagtatctttttattgcttcttcccattcgctcctttcctctaggactcaatatccttgttagacatttttaccatgttccagaagtatctctcttctttttctgaatctttttttctttttgcacttcagacaatgttttgatgggcctaatctacagtttactaatcctgtcttcctctggtttgtcagatcagtggttgagctcttttattgagtcatcaatttcaattatatatttttctgtcctagaatttccatttgattttaaaaactggacttaggtccctaacgatgtattcctattttgtcatctattttttagaatatattaaacatttattttaaagttcctgactgacaaccataataataccaatgggtatgcatttttttgttgttgaaacctggcatcttggcctttttttttttctttttttttttttttttttttgagacagggtcttgctttgtcactcaggctggagtgcagtggcttatgcatcttcgagttcctgggctcaagcaaaactcccaccccagccttttgagtagctaggactgcaggcgtgtgccaccatgcccagctaattaaaaaaatggttttttgtagagatggagtctcactgtgttgcccaaactggtctcaaactcctggcctcaagcaatcctcccactttagccacctggcatttttaaaaattaaatactagatattgtggatgggaaatagtagtgcttctgaataatgttgtgtctctccagggaagatttacttttcttgtggcagatggttagagcaggggcagataggaaatagcttctcaggggtcttacctgaaaggctggtgcttttctcatggtatcttgaactcctcagcaatgtgaggctactgaaagcttagcctcttagtctcactttctgcttggattcttggtctcttgccccatgcaaatactaaagggtaatagtgtacagaaagtcagactcactgttgtatggttctctttccccggggtcttagcccctctactctctctgccttggaatccttgctcacagtccttgtttctccagccccttgaaagccctcatcattgctctctctccagcctctcgaccctggtcgcaagggaaaagtggtggagtgcattgggctcacttaaatgtgtttcccttcccctgagatcttggcccctcaaatcctggctgctttggttgtttccattgcctttaaagagctaggttctttttatgtattttatccagcttttatagttgttcttggctggagggttggcctgctataagatcctctatagcaaacgtatacatgtataaaatcgtaaaagtatgaaaaagggtatactaggaaaagtaagtcatcccaccttcatttcccctagccatccagcccccatccatgaatcaccagtcactattatctttttaatgtaccctttcagaggtttatagaattttcacacacacacacacacacacacacacacacacacacacacacacagatgatagcctattcactcttttgtactaaatctatttttctttttttgagacagagtctcactctgttgctgaggctagagtgcagtggtacaatttcgactcacaacttccgcctcctgggtttaagcgattctcctacctcagcctcccaagtagctgggactataggcatgcaccaccacgcctgcctaatttgtgtatttttagtagagatggggtttcaccacgttggccaggctggtcttgaactccttacctaaagtgatctgcccgcctcggcctcccaaaatgctgggattacaggcactagatcttttcacctactatcttagagagcattctaagtctgtattgcattgccacaaccttcttaatgactgtgttcagtcattatacaaaagtaacaatttattttgttgcgctctccatagatttctaggttatttccaatcttttgctactgtaaacattgctgtaataaatatccttgtagcggtatttattatatcatagtatatatgtgcaagtgtatctgtggaagaataaaaacctagaagtggaattgctggatcaaaggacatttgcattttaaaaattatatatatagctactgtaaaatatacatagtataaaatttaccattttaatcattaagtatacaattcagtggcattaagtgcattcacaatgtcgtgcagccatcaccactgtccgtttccagaactttttcatcatcccaaagagaaactctgtgcccattaaacaataactgcccattctcccagactctggtaaccactgttctactgtgtctctgaatttgcctctactaggtcctttatataagcggaatcatgtatttgtccctttttgactggcttatttcacttagcatgatgtcttcaaggttcttctgtgtcgtcgggcagatcagcatttctttcccgttaaggctgatatctccttgcatgtatacaccacgttttgtttgttcatttggacatttgggtgttttctgcggctttgctattgggaatggtgctgctgtgaacacgggtgtacagatatctgtttgagtccctgttttcagttcttttggatatatacccaaaagtggaattgccaggtcatatggtagttctgtgtttaattttttgaggaatctggaatgtgctttttttgttttgttttgtttttttgagacagagtcttgctctgtcgcccaggttggaatgcagtggtgcgatctcagctcactgcagcttccgcctccgggttcaagctattctcctgcttcagcgtcccgagtagctgggattacaggtgcccaccaccactcccagctaatttttcttgtatttttagtagagacggggtttcaccatgttagacaggctagtctcgaactcctgactctggtgatccgcctgcctggcctcccaaagtgctgggattacaggcatgagccaccacgtccggcctcctatagagcttcaaacaatttatactccaccagcaatgagtgagagtatacttaggcacttaagttttccttgtttatctagaaaatacctcattgcttttggaaaccctccccaaaggattcctatttgaaaaccccagccccagggaaccagcctcaaggcaggagtgacatcctgtgggctgtttcctgccttatcctcatttggctcaagccacagacagataaactcaagtttggaagagttcctttgctttcttggcctacactgtgtaatatttggcaagaatatacaattataaagaaataaaaaagaggttggcatagtggctcaacgcctgtaatcctaacactttaggaggttgaggcaggaggattgcttgaggccaagagctcaagaccaacctggccaacatagtgagacctccatctctaaaataaaagactgatagaggctgtattagggttctctagagggacagaactaatggaatagatatctatgaaggggagtttattaagttttgactcacatgatcacaaggtcccacaataggccatctgcaggtaagagcaaggagagcctgtccgagttccaacactgaagaacttcaagtccactgttggagagctggatgcatccagcacaggagaaaagtgtaggctgtatggaggctaggccagtctctcttttcacctttttctgcctgtttatattctagcaaactggccactgattagattgtgcccacccagatttagggtgggtctgcctttcccagcccaccgactcaaatgttaaactcctttggcaacaccctcacagacacacccaggatcaatactttgtatccttcaatccaatcaagttgacacttagtattaaccatcacagaggcatattccttcaagccttttttttggtcctgatatttgagagtgtcctagccatgttttatcctgattaagagattataaatgtaacaccttcctctcacatagtatagcagctgagagccaagtaccagagtctctgcccctctcctatggccttaggggagataagtgttaagtagttattgcacagtgcctgcacatagacactcaaactctctaccatcatatgattgttggatacaattttgaagatatagaaaagtagaagaggccaccaaaacctcccttaatctgggactttttttgaaaaataatttttaaaaatgaatatggtattataaattagatatgcagttagaaaaactcaggtttgcttcatttttttttcttttttatagagctaaaatgaaaccccttgaaagtggtttagtacactcaccatgttgtgccaccaccacctctagctagttccgcaacatcttcccccaaaagaaaacttgggacccgagcttgatttttatttgtttttattttttttaattaattaattttttttttttgaggcggagtctcgctctgtccccgaggctggagtgcagtggcacgatctcggctcactgcaagctccgccttccgggttcacgccattctcctgcctcagcctcccgtgtagctgggactacaggtgcccgccaccatgcccggcaaatattttgtatttttagtagagacggggtttcaccgtgttagccaggatggtctcgatctcctgacctcgtgatccgcccacctcagcctcccaaagtgctgggattacaggcgtgagccaccgcgcccggctaccgagattgatttttaaaaccagatagaaagggacctggtgagccctgggacaggccttgcacgtgaggacaagggacccagaccctagcacagtcccacagtcctatgctccagcctcaccttgtggtggatacctgtctgtactgggggttggggagggatgaccccgctggtcatcttggacctggatttgcatccacagcctctgccagcgtttttgggggactgtgagccctggctttctctgtgtggtgttggtactttacctctctggtctttagtttaattttctgaaaatgggattaaaaataataccattgttaggggatagtttgggaatcacatgaaataaggcagaggggagtctaaaaaccatgaagccctttggggctccaagatgccgtcacgctggcccccagcccctggggaggcaccggctgaagtcagggtggtgaggtaggatgggagctggctggggcctgtgcatccttccccttctctcttccagccaggacagaggtcactccctcccaaggcattggggctgacgttgggagtggcgtgggctctgggctgatttgacgtttcagaaacatcagctgacgggtcttcggagctgagtgcaggccggtactagaggctgcatgaccccgtttcactttcctcctgtaaaagctcctcatgagaataaaaatgagataatagatggaaaaacactttggaaagggccgcagacagtcctggtatgagaggaaacagaacctggtttggaagtggctccaaagagccatttgaggtcagtgtcagagcaggccatcccttacttacatgtgtgcttaatgtcttttttaagaaaattctccatttaaaaaaattatgagtgtctcctataaaaacaatcgttaatctaccctctgcaaaaaaggggcctccttccagaattgagtgcccagggtccatgtctcactttttatttggtcaggtgctcttatcttttttttttttttttttgagatggagtctcactctttcgcccaggctggagtgcagtggcacgatcttggctcactacaacctccacctcccaggttcaagcgattctcctgcctgagcctcccgtgtagctgggactacaggtgcccaccaccacacacagctaatttttgtatttctagtacagacggggtttcaccatgttggccaagctggtctcaaactcctgatctcaagtgatctgcctgccttggcctcccaaagtgctgggattgcagtcgtgagccccatgctcggctatttatcttgttttctaagctgccttaagagtgtgcggctgaagggcagccctggccatgtggctgtcccagcaggtgtctcctcgctgggcctcagcttcctcctctgctgtgaagtgaggtgtagggatgcgctggtgacctgagcccgctctctctcttgccatcccctgggaagttgtaccttctgttatgaagatgaccagcctcctaatgacagtcaactcccagatgggtgggcagccagccatggtccaggagggtgaggcggcacagtccctcaagcacaggcatccctttctgcctcctcactggggtgagcatgtccacatgtcaaagggtgcattgaggcaacagagcatttgggtaatggcaagggtctcagattccagtggctttgctgctttaacctccctggctccagtctccttcagggaggtagtggagcctgccctgccctgaggccttgtggatttggagctcttggtgcagccctggcatgcgaagcgtcctctttgcctctgccgaacacatatctggcttcgcaggcagtgccatggcgcttccctgtggtgcggggccgccagggtgcatgctgaccttggtccagcctcccggctctgtgggcatgtgagggtagagcaggaggcccagaggacagaactggagttgtttgtctttattcccatgtgaccacacttcaggggttagttggggaccttgagggttgctaagcaccccagccgccacctggcaacaggcggcacccagaaaacccactcagcacacacctgctgccaggtggagctacaaaactgagcctctctgaatcatactcagaatcacttcccagggatcggaacatggttgacggaggatgtgggaagatggagggatgacaggggcaggcctatgcttccttcacacgcgtcctgtgtggttaactggccctgtgcctggtcctccctcggaggtgaggactgtccacagtgcccaccctcagacaggaggatgctgcagccagggcacgtagagggagagcccagggcagactgcacagggtctagggtagaaagccatccccatcttcacccttgggatcctggggagacagctgaggtggacgctgggtgggtttccattcaggtcttgggggactgcacagagacacagctgcctctccccacctctccttctgctttaacccacttgcagggtcacctgttactagggatggtgtttttccttcaggccggtcttacagggaagaaccgcccattgaccacaagcgtcaggcccctctcctgggagccccggagcttgggacactgggaggctgccatttcctaagcttggattgtatctcttgcttttctgaatgttcttcctctgtaacctttgcccaagcctggtcactgtttccctcaagaccttttgctattaggacaaggtgtcatcaaccctgagccctgttcttataggcgcttggtaggggagaggggagtcagagccagaggccagttgcctcttggcctggggttgggcttctagtgccaagccccaccgtgccactgttatcctggcaacagtgaggtcggggcagggggaccactaagagtgggaagaggagacgaagctggtgtcgagtgggagggctgtgcctctgcctgtggatccatagctgctctgcgtcttgctcgttgcaccgtggctgcatcatggcattctccgcgtctaatgtaatgggtcaaatccattgtctgcttcacaggagacacacagacacgtccccacccccagcatcagccttgcattgtactcgctatcttcttcacagaaccacccacaaagatatctaatatttttagtttttcttttagcctcgaatgcctctcagtgtgagaaaagccaggtgcgttccccataatgcgaagtaggcactggtccttctgttggttccaactctcacctcttggatgtcacagaatgctcttcatttcaacattccaggacttagcaaaacaaatccacatttcagataatgcagatgatgaacccatagaaaacaggttgtcctaaagcagtggtgggttcctggtggcagtgggaggatgttggctgtgtcagggtggacctgagcagagctggtgaggacagtcctgctgacggcccatgcatgggctgtgtggcctctgagctgggctctgctgggctgtggcaggtcttaagcctttgccacatcctccagcagaatttttctccaaacagttgtagaattgctggagaactgtagagttgtagaattgtagaattgtgcattgtggccagggttgtggcgcattttatatttatctggctgtaagaatgaagttttgttagtaatgagtgtagttttattgaacatttattttgtgccaggccctggatggtgttttcattggattatttcatttaataatgagatctctcatttaccagctggcacttcctcctggctctatttgggagatctgttaattaacaggaagaatcagttaggtagtccttggaccacagctggcctgtgggtatctgttttgtttgaccttcccagagtgttaacattttctaatacttaaacatttgtacattctggataaaaacctggatttttgactcacttagaaaatggaaagatctgtcaacaaaggttgcaagtaagacttgcattcacattctaactgggtcactgagcccctcttgagcccaggagtccaacaccagacatggcaagaccttatctctacaaaaaaacttaaaaaaaatccaggcatggtggtggtgcgcacctgtagtcccagctacttgggaggctgaggcgggaggatcacctgagcccagcaagatcagtgtgcagtgagctgtgactacacttcagcactccagcctgggagacagcgggaccctgtctctttaaaaaaaaaaaaaaaaaaaaaaaattcagaccacaagtatttcaggacttttctaggcactggggatacagttgtgagcagaacagattctagtgtgggcaacacacattaaacagacgagtatgtgctatgtcaggagctgggaagggctgtggagagaaagcagaggacggagcttagggagtgccgtgggtaaaggtggaaattttgtcggtataattttcttgggcctttatgcccagggtggtactgagttgctgcatctgggtcaaggagagaatgcaaagggtctgctttccgccagtcacagatacgaaccctccgcatccttctcaacacagggctcgaggcagctgctctctgcccatcagagttggcacagtacttgtgactacagtgttctagagctgcaataggtagcagtatggtagccacttgtcatatgtagctatttaaattaaacttaattaattagaaaatgttagtctttcagtagcactagccacatttcatgtgctcagtagctaaatgtggctgccatattggacagcaaagatacagaacatttctgtgattgcaggaagttctattagcgctgttctagaggatggtggcttgccccttgggccaggtctcctagttgacagctcgttaactcttcaaacctctaaggagtagtacctgctctttgccaaataattcgtggtgagggctccaggtaccacacacgtggccatctttgggcccagtgggctgtctcctgagactgcagtcaccttggcctacacggtggcccctgtctctggggactgcacaggagaccaggccagtgaccagaagtcccacatgttcggtgtcccctctcctgctctggcagggtaagagctctgggctgaccctgggtctgtgtgatttccgcactgttccagatgacatggcctggtggcttgttagtctggccccgccaacactgagattaaatgtggccctgcttctcttggggcctgttgatctggggactctggggacactggtctggtgcctgttctcatgctggaggccttgtttccaaatatgctgacttttacagttatgcagctcctccctcctctacgttcctacagcatttggctgaagactgtgaagcactcctgccctgggagaccagtctctcccacgtgtgaccattgccccacccatccaagctctttggagtactgtttacctttgaccttcccagcatttagctcagggacatgcatagatgaccagtgactgtccttcgagtgactgaggtggggaacacatctcttgggcaggggcagcacacgtgggccccctagtctaaatggcggcagtattggagtttccagatttcacacattgtggtacttcgtcccctcatccgggagaggtgagctgtttgggctctggcctcccaaggttactaggcctggtccttctctccattccctgcctcccacagccccctctgcttaggtagtcaggccatgatggacgccctggtggggtgcagtgactttttggcttccaaattggctggacactctaagaatctggattaatcgggaccaagacagactggtttgtgaaacatctgtgggtatgctcacagcctgtgatgggttacagtgacatgtatttgtcaagcacatggcacttagaacacatgaacacacatggacacacctaccctacagacaaacagacttcatatacatacctcatgcagacactgtagacagtagacacgtacatgcagctgcatgtgtgtacatgtgcaagcgctaacgcatggacacacacacacacactctccacattcacactcattcccagccacctgagcactatgggtctctctcgacctaactgtctccctcttacaaggatgttgtagaaacttagcttctcaccagccaacctcatttatccaaatccctcctggcctccttgctgtaattaactcctgaatgcctcatcagagcctcagctgtaacagctcgggcccctgggaacagtgctggctgcctcccccttctatctctgtcctgagccagtgcgaaccaggcctggcatgagtcatccctgagtagaagggggcttgggtggttccttctcggagccctgtggaggccatgccgacagattgccctggggtgagaagctcaacacatctgctctcagctgagatcccagcccaggaggcccagcatcttgccccaggcccttctcaactctctaccccactgcaggcctgggtgcttcttcccaggatctgggcaggttcttgctttacccaggaaacctactaggaacttccagggcttgttgttttttctctggactttgattcttttcccagagagggtcagggccttgacttttattaccatgctgtatttttaggataaccatcaaggacttgaaggctgaggagaatgaagactttaccctccttcttctctgtgcagaaccacatctgggcacccaggcctcggcccccagggtttggccacatccccctcctccggtccagccttccacccctgctcggctcttcccgcagtcttctctctcggtttctgggaatgggagttcaccacctctcagggcagcacattctttgaactgtttgactctttaaaaattcttccttctctgaaagcaacattctgttccccagcagcctttcctcattagctttctctcttggggcctccaaagcaagtcttgtcccttttctacatagcagctttcctcagacttaaagacagcttcctaagaagaagggggtgggggggacctggggctaaggacacagcctggttaagctggaccggggcctttttatttttctgtcacacagcccagagccaaggggcttgttcaggcagctactttatgctgggaattcattttattttattatttttatttgtttcgggatggaggctcgctctgtcacccaggctggagtgcagtggcgcagtctcagttcactgcagcctctctctcccgggttcaagcgattctcgtgtttcagcctcctgagcagctggtattacaggtgcccgccacgaagccctgctaatttttgtatttttagtagggatggggtttcaccatgtggcccaggctggtcttgaactcttgaccttaagtgatccgcccacctcagcctcccaaagtgctgggattacaggcgtgatccaccatgcccaggctgggaattcattttaaatctaacagcatctcaaatggtaggtgtcccccttctaccccccgcaacattggtacattgtgtctctcccattctgttctcctgcatttggtttgggagtctcaggtacagactatgacctctatcctttttgaatttcatcctgtatgttgcaccagatttcagcagaacaaaagccacgagccacttgtcccagtgacacgccagccacacatttctaaatacatcctctgtatcttctgagaagttctccttctggaaagatttacactttaaacaaagaggcctaagagatgcccattttatagataaggaaccaagcccccggggtgaagtacctgcccagggcatgggggcctttgcagcctaaccccagatcagtgagctttgctgtaccccccaaaacccctgggtgatatggccactcctctgacagatgttctgattttaaacatgctttgtttcttcagcaaagccacctttgggattagtcattactatcttacgtcaacagatactcctctgtttagtccaggccatcagataaaaagtagcttcaagtgaaggaagggtcctttttccacagtccggttctctggaaccctgccaccccctaccgaaagtcacagtccaagagtgaagccaccacaggccacagcttcaagacaccacagcctgaacaggtgcagtcctgggagaagtggcctctgtgtcctcaagtaatttttataaaggagagacaacaccaaaggggcctgaaatggatcacaagaattcacatcatgatgaatatcaccattcaattgtgtactgattattgtatatcctcattcaatggctatagtcattgtatatacagattcagtatatatgaatcagtatgtatgaataatgatgttcagtgatgggcattgaatagcgatgaaatgcccagtgccaggagctttcaagagataaggctcactggccgggtacggtggctcatgcctgtaatttcagcaatttgggaggccaaggcaggcagatcacctgaggtcaggatctcgggcagatcacctgaggtcaccaggctggccaacatggtgaaaccccgtctctactaaacatataaaaattagccaggcatgatggtgtgcacctgcagtcccacctactcgggaggctgaggcaggagaatcacttgaacctgggaggcggagcttgcagtgagccgaggtcgcaccattgcactccagcctgggtgacagagcgatgccatctcaaaaaaaaaaaaaaaaaaaaaagatgaggcgcgtttcaatctgaaaatcacactataaaacaattgtaacaataaaaaaggattacaggaaaagaaaacatacaaagaatatggaagctgccaagtgacccctgccccctgggcgctgccctgttgcaccttcccctgcggcagctcctcacagtggggtcctgtgccatccttgggctttgggaagggggcaaggtcgccatacgtcgtgtcctgaggcgcgcagccatttccacctcaaaacacatcgcactggctttgagggtcttgttttctgcagcttccttataccccagtcctcggttacaggttttgcctcctagtttgatatggctggaggcagtgcctttagtaggtagactcttccagaatgttgtacaaataacacccctacacacacacacacacacacacacacacacacacacacacacacacacacacacacacacaccctccagctgttcctttccttcaaatcttgttcctcaagagagacttctcaaacctcaggtgcacaggtgtgcctcacggtccgtggcttccccaccctgatgagcacgggtgatgctgagtccacagccccaccagccacactctgggtagggcagcctgaagtcctggggatgggctcggctgaaccagggctgcactcccagcaccggctcggccactctgtgtggcagtgacgagggcaacccaagtttccgcgggcgttggcagctcgggtcctcgggcagcggctcctggccgtggagaggcaggcaggcgtctgctgggggtgttggggagcagcaggcctctgtcgaggtccggggctgtcctggcatcaggcctctcacgctcagcccagttgagtactttctgagtacacggtggccactcatgcctgctctgaggccgggctttgccacgtgggcccctcctctcctcagcctgtgaggagtagcacagggcagtgaggccggggaggccgggtgacccaccagtgtccttaggccacagggtggggagggagccatggaggcagcactctcctcctccgcttcctcttctctgcttaatgtgggtcccagggaggactctaggagccgccaccaccactgcccctgtaccccccacccctgcctggtgcctggcaatggcagccacaggacgtctttgaggacatcagatgccgtggggacagtggattgcagaggaggagcggaccggggtgctgggagacacatcagaggctgttgcaagttccccccgaggcagccgctgggccgtttctgtgaggaaggacccaccggaaggggctgcctgattcccacgcccaggtggcatggagccctggggagggtgtccagagccagagccgcactgtcagggccttactatgttacaaaacaccagggcttcggtctgggtcctgctgcttgcacagaaagccaatcactgtgacagcaattattgccaaggaatacggctttaatcgggtgctgcggtagaggatatggggactcagtctccaatccatctctctgacctgctaaatccggggtttacacggcagggaagaaatggaacaacgcgcgagacaataggaatgaggggtcctgagtctcattgtctggatgtggtgacctggttggtgagtttcagttattcagtacttcatttgagaggcctgaaggtcctttgctgaggaaggaactcagataagtagaagttttaagccttaagagcagaaggatccatttctatgtttatttaaaagaacagtctatgggacttttggaaaggttttaaccgatgcccctgggcactggggggaccttcacatctgtagcagaacaacattaaagcagatgagagaactggggtgggaaaagcacaaaaactcacccattccaggggtctcagagccctgggttcagggtctaccgctaaccctttgggatgtgtaacagacaacttcatctctctgtgcctaggctttgtcacctgcaaacttgagacaatattgcacataaataataccgggttgatgcagaagttttagcaaaggagagggatgattttgactgggtggatggtgtctgtcacctggtgggtgctgggttcatgagagctacagagcgaagccagcccagggtgaccgttctgtctttggcttcctaggaggaccactgccttcccccacccccattttggctgtgtgtctccttggttcgtgcctggccataggttccccctcctcaggttatgtccaagctgactaggaagtctggagccaagcccaaaggccttgagggatgttccctttctaagaaaactgtggtccttccagagaagccgaggtcagggataggatcacagctggaggcaacaggaagttccatgtttatttccagtttaaaaagtatttttaaaaagaacaaccaccagcaccctatagcaactttgaaaaacgtttcaggttttccctaattcggtcgtccaagttaaatgagccttttctctttgcatatagccttctgcctttatttctatgcacacatagatcccagcgtcagcttcacagaacacaattttgtcccgctcttctctctctgtactttattgcaatgataaacaatactgttgtttcattatggtcattcttaaggttgtagaatcttccatccagaggatgtgtcattttaattagccatttgctgggtatttgggcgacttacagttttttccacaagggttaagtcaagttgcaatgcagatcaccttctacgtatatctttttacttctgttggatttggggggataaattctcagaagagctattaatgggtcaaaggtttggaacattcttgtgactcttgaaacgtatagcaactgctatctttggaagagcaggctctgcttccacgctggggagaccaagccacattgatcatccctggggccctgagcaatcctaggctgctatgggtggcctctctcccctgcactcctgtcccccactgtgggacccatttgccagttcacctggatcccagcctccttccttcccccaggaacacaaatgaaggggtgtcggagtctttagccagggctctggaatggtaatcagggatcttctgtgtgtgtatgagcatttttctagaaggtccgtagctagcatcacgcactcatgaaaggggccaggatccaggaaagggtttagaacctctgaactctaagggcaaacaaggccagcaccaatcgagaggcaccaacaaagtgggtgttagtgaggagggaggaacagacacccctgggcaggggccaggggctctctggagaggtgacatgtgaggtgggtgtcgaaggtgtggggagggaggaatgttccacagagagtgacaccagaagcagaggacagggaggggtaccgagaagaggaaacagtccagctcatctaccctaaggggccacaaggagagcagtgggggacaggactagaaagacaggtcagtgccaccactgagggtgctgggcaatggtgtcgcacagcttagaggacatccagataccgtgccaaaggtggactgaatgagaggagccggccggcacctgggagacacattcagaggcggttgccagaggccctgaggcttggggggtggcagggggagggcccctccctccgtgggccttcgtctcccagacccccctcctcctttcccctctgtcaggttccgtgtgtcctttcttctgcacgcactgacgtcttgtttaaaactcgtcttgttaccagaatgactccaggtagactgttggcctgcttcactttttgagcctgactataaggtttccacaaaccacacagggaattggcagcctgaatttataagcatagctcctttcttgttatttaagtttgattttctgctttcagaacatatttgtgctcttagcaaaggttatggaaatatataagggaaaaaaatggaaattccccctgtcccacccccagagagaagctcacggccgcttcactcatgtggcccttccgaggctcctgttttgggctccagggctgccctggttttgtgcctctgccgctacttttgttctgtattggtagacagtctccgagaccccagccataccgggaggaggctcagcagtgtctggagggagaaccagtactgtggtcaggggcatggagctcccacaggactggattggactctcaggtccccaaggttccaagagagcctgaagaggcttttctgaagggacagaactctgaggtagacccaggagggcaggaaaggcctgtgtgggctgtggctgcaggagccactgcatgtaggctgggagggaggccagcacggtgctgtgacgttcttaaacctcacgttccacgtccctccctgcccacacacctgaccacgcctccccatgctcctcacacatctgcgccctcctcacccaagcagcaccctgaatgcacacgtggcggggggggctgagactcaaatggaaggcagggcccttccttgtatccctttgttgtcccacctgcagtaagcagagctcaggagaccaggctgagtgacccagagggtttgtgctgaccctggcacatctcactggaactcaacctaaaaacttctggccaacttcaaagcccagaggaacattaagccctgtctttttgagccacctgctgtctccacaccctcagtcactcagtcatactttctatcatgtgactgtaggaaaagctggactatggtgagcgcttcctgtgggccaggcactgttctaagtgcttgccggcaatgaattgtgtccttcctgctttcctgcctaggaaaccaaggcacagggaggtttagtatcctgccttatgccgagaccagctcggctggggagaccctaacccagtggtgctagagaaattaaagacacgcacacagaaatatagaggtgtgaagtgggaaatcaggggtctcacagccttcagagctgagagccccgaacagagatttacccacatatttattaacagcaaaccagtcattagcattgtttctatagatattaaattaactaaaagtatccgttatgggaaacgaagggatgggccgaattaaaggaataggttgggctagttaactgcagcaggagcatgtccttaaggcacagattgctcatgctattgtttgtggcttaagaatgccgttaaggggttttccaccctgggcaggccaggtgttccttgtcctcatttctgtaaacccacaaccttccagcatgggcgttatggccatcatgaacatgtcacagtgctgcagagattttgtttatggccagttttggggccagtttatggccagattttggggggcttgttcccaacaccttatagccacagtgagtgcaggcagggctgggggctgagccaggccagcactcatgatcctgacggctgcctcctcctgccccgcgagcctcaagcacaccagggccgcacactccagtgcgggctgggatccccgggattactgaccagagaaacccagccccagcccagtgggtgctgcctcccacctgcctcctccagactcctcagctctgcctgcccctcaggactcccagcagctgtctgccttgagaggctgccctcaagagctggtggggccccatctctggcttttcttgaaaaccttcctagaggctcatcttttctgcaaacccagagctttttccacaatgtctggttagttaggttccgagacgggtcctgtcccacccagcacttcacccatttctttgcattgggcatcctctcaccacacttgactggcagagagaggggagttgccaagcaccaaggctgcctaagttgctatccctgggctgcagggccctgggagaactggatgccacttcccaggcttcggtggagccagggcagggcgtactgggattactttgccttctcattcctgagctgtagtgccatgcttgaggttaacagtgaagagatattgctgtggaaatggaagaataagagtgtcttagtccacattcatgctgctgataaagacatactcaagattgggaagaaaaagaggtttaattggacttacagttccacatggctggggaggcctcggaatcatggtgggaggtaaaaggcacttcttacatgctggcagcaagaggaaatgagaagcaaaagcggaaactcctaataaacccatcagaccttgtgagacttatttgctatcacgagaatagcacatgaaagtctggcccccatgattcaatgatctccctctgggtccctcccacaacatgtgagaattctgggagatagaattcaagttgagatttgggtggggacacagccaaaccatatcattccactcctggcccctccaaatctcatgtcctcacatttcaaaaccaaccataccttcccaatagtccccccaaagtcttaactcatttcagcattaacctaaaaatccatagtccaaagtctcatctgagacaaatcccttctgcctatgagcctgtaaaatcaaaagcaagcggccagacatgatggcttacacctgtaatgccaggactttgggaggctgaggcgagtgaatcacctgaggtcaggagttcaagaccagcctggccatcatggtgaaaccttgtctctactaaaaatacaaaaattagccgggcatgggggcaggcacctgtaatcccagctactcaggaggctgaagcaggagaattgcttgaactggggaggcagaggttgcagtgagctgagattgcactacagcattccagcctgggggacaagagcgagacttcgtctcaaaaaaaaaaaaaaaaatcaaaagcaaactagttacttccagatacatggggatataggtattgagtaagtatagccattccaaatgggagaaattggccagaacaaaggggttacaggccccatgcaagtctgaaatctagcagggcttctttggagcttaaattttaaagctccaaaatgacctcctttgactccaggtctcacatccaggtcacgctgatgtaagaggcaggttcccatagtctcgggcagctctgcccctggggctttgcagggtacagcctccctcacagctgctttcataggctggctttgagggtctgcagcttttccaggtgcatggtgccaaggtgtcggtggatctaccattctggggtctggaggacagtggccctcttctcacagctccactaggcagtggcccagtagggactctgtgtggtggctccgactacacatttcccttccacactgccctagcaggggttctccatgagggccccgcccttgcagcacacttttccttggacatccaggcattaccatacatcttctgaaatctaggcagaggttccccaatcctcaattcttgacttctgtgtgcccacaggcttaccaccacatggtagctgccaaggcttggggtttgcaccctctgaagccacagcccaggctctgcattggccctttcggccacggctggagcggctgggacacagggcaccaagtccctaggctgcacacagcatgggcaccctgggcctggcccacgaaactactttttcctcttacacctcagggcctgtggtgggaggggctgccgcaaaggtctctgacatgccctggagacattttccctattgtcttggtgattaactttcagctcttcattacttacacaaatttctgcagccagcttgaattatcagaagatgggatttccttttctatcgcatagtcaggctgcaaattttccaaatttttatgctgtttcctttttaaaactgattgccattaacagcacccaagtcacgtcttgaatgctttgctgcttagaaatttcttccatcagataccctaaatcatctctcaagttcaaagttccacaaatctctagggcaggggcaaaatgccaccaatctctttgctaaaacataacagtcacctttgctccagttcccaacaagttccttatctccatctgagaccacctcagcctggaccttattgttcgtatcactaacagcatttttgtcaaagccatttaacaagtctctgggaggttccagacttccccacagtttcctgtcttcttctgagccctccaaactgttctgacctctgcctgttacccagttccaaagtcacttccacggttttgggtatcttttcagcaatgtgccactctactggtaccaatttactgtattagtccgttttcacgctgctgataaagacatacctgagactgggaagaaaaagaggtttaattggacttagagttccacatggctgaggaggcctcagaatcatggcgggaggtgaaaggcacttcttacctggtggcagcaagagaaaatgagcaaaaagcaaaagcagaaactcctgataaacccatcagatctcgtgacatttattcactatcacaagaatagcacagaaaagaccggccactgtgattcaattacctccctctgggtccctcccacaacatgtgggaattctgggagatacaattcaaatgagatttgggtggggacacagccaaaccatatcaaagcgcaaaaccactattactgcttcaggcaggggccagtgccaggcatgctcaccttgtcctaatggtgtgattccctgcaagaaaggtgataaattctccccatgaagccacagagtgcagaagatggggacctgtagcagagctgattctcacaagggaggcctctggtttaccaggtgctgagggcccaagtacaacagcagactctggggacctcttggcagctccacccagaggagtggagttgagccttcacctcctcctgccccaaagcaggtgcatctgacatgcaggatgagctggcctctctcgggcctcagggacccctgaactcagcagagtcagagcacttgcatggtgcccccctgcccaggccttgtcaggaggcaaggtccctggctcctgctcctgtggcctgggacccacagccatccagccaggccctaggtgctgaggaccaagccactagttcttggttttctggccacccaggacccagggtggtaatgcctgggacctgcaccctaggcacagagctcctgggggtcctgagttcccgcccatgcactcctcacctttcagcagccgaccccatggcgacacgggcctggccacccggaagcactccaccctgaaggtcagcgggcacctgtcctccagccacatctctgccttccggttccctggcctccccctgtgcctgctgcggtttcatttgtatcttggccccttgctggacacactttctttagttgtgtccctgccatgagctagttctcatgccccttggccttttacagtttccatcttgcaaaacctcaacttgggattctcccccaagtgccccccaccatccttcaccagacgccatcatcaccctcctcccctcagggatgggggcagtgctcccctcttgaccagctccctgctgagcctctggtccctggcttcgcctccgcagcaccacattctgtccctggttttctctctccgtactgcttatccaacccatggcttccaggcggatggttcagcccactgcctctcctgagcgctgcctgcaggtgcccgcacagaggccccacagcgcctcagaaccaaaccctgtctttgccctcatatctgccgctcttcctctgttccctgttccagagaccggcaccgcccaagccacagacctcttctgacaagagccacatagtaaatatctttggctctgtgggccatacggtctctgtcgcatctaccccactctgccattggagtgttaaaacagccagagacaatatatcaacaaatgagcatggctgggtgccaggaaaactttatgaaaacagaggatgatttgagcgcaggagtccaagaccagcttgggcaacatggcaagaccctgtttctacaaaaaatgtaaaaattagctgggtgtggtgatgcatgcctgtactcccagctactccagaggttgaggtgggaggatcacttgagtccaggacgttgaggctactgtgagccatgtttgcaccactgcactccagcctgggcaacagagcaagaccctgtataaaaagaagaaagacagcagcagtcagattgggcccacaggccacggtttgctgaccctgatctaaaccatgcccagctctcaagccatgtttctgtttttacctccacagaaatccctgaaggaccctggtgcgctttgcgtgtgtctgtgcgtttgtgtacacggctgcctccaacaggagtgccctcagcgtcgcgtcttgggctcgaccaaggctccttcaggaaggcctccttgatgcctcctccccggccgaccttggcccctgcttctctcttgcgccgtcctctgctctctcctttctgggcacagaacttgccatgctgcgctgtgctgggcatggttacctgtgtccccgtgagaccctccgctctctgaggtggacgttcttgctggttttgtgtcgctggcgcctcgtgtagtgcctggtctgctgtcagtctttgatcaggtcaaagcagaattttgtgagcgatggctctgtgcagccgtggcgggtggctgaggtgaccccgcagggctcctgccgggagggctcacggtgcagcagcccacgcaggactgctgcgcttcttgtggcacgaggatgctgagcacagagccacgttgggatgcttcactgcgtttctggctcccctcagttgctctgaaggggccattgccaccctcagccttgtcagggccagaagctgcctgtcccagacccctggctgctcccgaggcagatctgtgaggtctctctggagggcagcatggttccctgctcacgtttcttgccaggatcggggcatttcttcccagaagtatctgaacttgcctctagcagggcctacctttgcctctgaccctctcctgcccctcacaggagaacctcatgctttccatcctgcccaagcacgtggctgacgagatgctgaaagacatgaagaaagacgagagccagaaggaccagcagcagttcaacaccatgtacatgtaccgtcacgagaacgtcaggtacgccggcccggggcgcgggctctgatggcagagcaggctgtggagggctgcatctttgtgggacccgctaggtgctgtgggcttcaagaggttttccagggactagaagcaaggcctcccacagcattcatcagcctggcggaggaagctgccagcagatgttgaagctacagtgtgctctaggctgcttggtccaaccccatcatagaacagatatcacctggagcggggaagggactcctgtgaggtcacccagctgttgagggccagcactggggctagagccctgacctgtgattctaggaagaaggatgagttcagcctgggcaggagtgggcagtgtggggtggtccccaggcaccacagggagggaggcctgcaggggaagtctgctaggacaagtgcaaggtcagagccctgactttacctggaagggtcagggtctcactgtctgggggtcgtgagggaggaccttctcctgccctgatcctggctgccctgtgggttggagagggagctggcagtggggtcgggtacacctggctgcctggagcgtcacccccacggttccttcctcatgcagcatcctctttgccgacatcgtgggctttacccagctgtcttctgcctgcagtgcccaggagcttgtgaagctgctcaacgagctctttgcccgctttgacaagctggcagctgtaagtccctggccccgcctggctctccagcggggcctgccctcatggcctctgcctggcccccatccccggccccatgattttctcccactgtccttcctctgctttcttggccactcctccctcactgaggaggggctggagcacaggccaggccctcccctttcagaaataccaccagctgcggattaagatcctgggcgactgctactactgcatctgcggcttgcctgactaccgggaggaccacgccgtctgctccatcctcatggggctggccatggtggaggccatctcgtaagtgggatgcctctgggagggaggctcccagagcaagggccccggccctggacccagggagaagcaggtcttccgcgctggccatggcccctgggtgggggatctgctggaagcagagactgggacacagcactggttgatgggtggcgcaggctcccgctctagaagctgggatgtggcttaccttcctcacagcccaggggacctgcgaggctcccccagcctgtggggcacacttttccagccttagtccacgtattctctttttgccagaagttgcagttgtgaattttctcacgcctcctcacacttgctgggacccccacaggggctccccatctctcctcagtgttttctcaccgtgacccccgaaggcactgccctctccatctcgtgatgcagtgactgtaagaccctggcagaggggctcagggatgaggctggatcccaccccggcctctgtgctccagccttaggctgtgagggaggcaaactctcctgccctcactgtcccctactcttgcccctgctccaagtgggcttgcagctctcggatgggcagtccctctggttgacttccagcctctgcgggacccggggtgacatcaggcaccaacacggaaagggaagctcctgccgaggcccctcccccatgggatggagtccaggaagttgcctgctctttacccccttctccgagggggcggctttgcatttttaccatcttccaggttaaagcccgtctagtattgccctggaaagaaagcagtgtggcctttaccccaggggtggtagtccaggaactctaacattctctccctgccctgtcagacacgttcaggcagggggctgttcacggctattttcttcacctctgtgtctgcagcaccttgaacgtgcctggcacatacttgatgctcagtgaaatattaactgcacgaatgaataaaagagtaattggcagagagaaactgaggcccctcgggaagtggggatagggaggaaagtcgcttggtgccctcgtcctgctggcctgtgatgcctgactctgggctggccctggcctgccttaccccccacccaacaccaagctgtggggaccttgccaggccccctcttgtggaggggaagaggcccacaatgaatttctcctgcaggagcaggggcagctggctgcctcgtgaaggccacaccctgaccctcctttctgtgtgtacctggcaggtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggtgagtgccattccaagggggcaggtttgaggactggggaggggaccgtcccctccatcccccagggctgtgaccctgatgagggacagggggcctcagagaaggcccccctacaaccccggaacagcattcctcctgtctcgccctggtcctggccctggctaaggccgttctgacctgccttggggtgaggcctctttgggcctgatattggatgtggcttttccttcctggaccctgcagtagcctgtcctcctgtcccctttaccgacttagggggctgcctcccctttacccactaagggggctgccccagctctccttatgccagagcccaggtctccccaaagggagagtaatgagcagtcatcagctagcgggctcgcaggcagcgttttgcaggtcgcagtgcgattacacgtcttacttgagctcccttacaggataatggaggccctgcctttagcagggcgaggctgagggaggatcagcccagccttccccatctgggccagggagcttccttcagtggcatttaggattcttggcctcagtggtgactcctcagaaacaggttttattatctcttggcagcaggggttgcaactgagaaacatgcaaggtgggggataattggatcttgtggctcacgcctgtaatcccagcactttgggaggccgaggtgggtggatcacctgaggtcaagagtttgagaccagcctgaccaacatgacgaaaccccatctctactaaaaatacagaattagtcgggtgtggtggtgtgcacctgtaattccagctactctggaggctgaggcaggagaattgcttgaacccgggaggcagaggttgcactgagccaagatcaagccactgcactccatcctgggcgacagaacaagactctgtctcaaaaaaaaaaaaaaaaaaattccttatcgcatttgatctgctttacagcggatcaaagattgaagaaagattgtactcctgtgtcgtggctccaacactgaggctgagatgggagtaagtgccatacggcccacacagctagttagcggcccacacagctagttagcggcccacacagctagttagtggcagaactgcctccacttggcctctgccccacatgcccgagagacacggggccgagcagcagccggtgcagccgtggtccgtggactgtcccctgggggtgtgagggccacctctggccgacgctcagggcctctctctctgcaatccaggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggtgagttccccaccccaccccacccaccccacccaccccacccctggattagggggttggaaaggaggagattaaggaaagattgcagaagaggtggcaggacccagcagtggctggctgtgagaggtgagtggcaggctggcacccttcccaagggagagctggtttctgggggagatggtgagtgtaattcatggcaggttgcaatggaggtgactgaagcatatcccaagaccacatccaggagggggccgctggagatgtgtcggtggcgcccaggagagcagctgggttggggctcagggtctcctgcatggaggaagtgagtgaagccacaggagtgacgtggatgctcagggagaggctcagagaggagggtgggggtggggtgactggtcatgggggaggaggaccaaggccaggaaggtttcctgagtgggaaatgagggaggaatgagatagaagtaatagagcaggggtgtctaatctttcggcttccctgggccacattggaagaagaagaattgtctcgggccaaacaaaaaatactgtgggttgaacaagcttgcaatcgtgcatcctgtgggcctgccctctggtctttttgtgggatcccccgaatatctacagacctgaagcactcagcagcttccccaggtctgtccaccaacccccaaacacctcctgtcagtctgattagaaaccaccagcagctgttgcagaaatggatccctttaccatcccctgctgaatctggaggttgtcttattttttgtaatctcatgtcaaaaccctttcctccagttatgagagtccatctaacaagacttggaattaaggagcttggtgactgtcagggaagtcgtgtcatttgagactgctctatggctgaggctttgcctaattatggctaaagcaaagcccactctggtgaggctgccggagtgaaggctgatactccccgctgattctaacctcgatgtcagtctcatccagtgtcattttaaaggctgtctctgacaactcccaaatttgtatctccacccccagtgtcttccctgcactcaacatacagccacttgtacgtctccatttgtacatataataggtatcttaaatgccacctgcccaaagctcctgccctccttcccactccataacctgctctccctcggtcttcccatctcagttaatggcagttccatccttttattaacaactgctcagaccaaaaagtttgaaatcatccttgacgcctcactttgcaatccacaagcaagttctgtggcctcagattgctctctaatcccaccgcctcccacgcccttgtcacttccagacctgtccacgccactctcatcccatgcccagatcatggctgagctctcctttcctctaggccctgcccaatggagcaccagcttcctcaaagtccagctcccctgccctcattgagaccaaggagcccaacgggagtgcccacagcagtgggtccacgtcggagaagcccgaggagcaggatgcccaggtatgtgcagggctcagggcagggggtcactgagggccagatgcgggcaggcaccaggaagcaatacgttcctgcagcaggagtcctgtgctggggagacctggccaccacccaggacctgctcctgcttagcactgtaaccatggacaggtcacccctccagccccgcaaaaccccactgtctcctcatcagttacatgccggggtgagtaaggtcaaaagaggtgcttagctcggaggcctttgtagctctgatggcccggaatcctgtagatttgagatcagtgaggacatccatggaaaattatataggatctgagaccattttggaagtgagatatcagacctggactcacccctctggctaggttcaagccccacaagttccatgcaagatgggatatttccttagcccccaaaggcgaggaattagcatgctgtcccagagtgcagggtgcctcttggggagcacccagaactggtccctgaccgcagggcgtctggagcacgttcactgatggaggtcagtgctgcagagatgggatgtctgccctgctcgggctcaccgcgtgagggggacaggagagctggccctggtgccattagagcagatgccgtagaacaagagggtagatggggctcagggtaaattaggtttttcttgagtcccccaacattcagtaacttttccttgttgcagttttcttgatagaaagtgggggtccagactcagggcactcactagcaaggaggacacagatgcagctttagcagcctgatttttcgggccctgatcctcagccagggccacgctgctcccggatctgcttcaggaacaggttcccgctgctgccacagaccatccacgtgattttacagaaggggaagatgtggctggggaaacattatctggggtcaaactgtcaaccagtggcacacctgtgcctgtgcttaagaccagggagtctttttttttttttttgagatggagtcacgctgtcacccaggctggagtgcagtggcgcgatcttggctcactgcaacctctgcctcccgggtgcaagagattctcctgcctcagcctcccaagtagctatgattacaggcgtgtaccaccatgcctggctaatttttgtatttttagtaaagatggagtttcactatgttggccagtctggtctcaaactcctgacctcaagtgatccacccacctcagcctcccagagtgctgggatgacaggcgtgagtcaccgtgcccggccccagggagtcgtgactgtggctcccagatgcactgttgaacccgttcagacagctctcagcccgtctcagtgactattcagactgatggctgtgtcatcacagccaggattcctgtttttggagttgatgctttttctttggaactgggaataaaagggtagtgggtgccccagctccacctacccgccccttgtcagccctctagtgatgaggacattcttctctctcccatcactttccccctcagatcttcctttccaaatgagccagatgtgagttcctttaacagttccctgaagccctagagttgggagccattcatgtccccaggctgccaatgtatatggcccccacatcaatacagcaggaagtgccaggactgcctcagcccagcagctgtctccgattacaggtctcctgctcaggagccaggggctgctccctacaatgctgtcattagcggaccctccctgcagagctctgggtggggggcccggggagccaggaaagactggagctttgggtgtagatccaggccacatggagccacgtgggagcatggggaagacttcccggaaagggattttagagctggagggattggtcctccgagtatgccctcttttgttcctttcctcctccacctctgtctttcccagctcttccccaccactctgtcccatctgccccactcacgctgcctccctggctcacaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtgtaagcgccacccggaagcgtccaggcccaccactcctcccgggccctgacaagggattcaggaaactgagcatcccaaatacggcccccctgctaggccaaggcagatgtggcatttgggattcatggggcttgttcccactgcagagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggtgagggaggggccggggagggccacgagtttcctcggctgcggtggtgccgggcggggggcgggggcaggtgtctcagcgggagcctgatattggggagcaagccagtctctgctccctgacccccactgggacggcccccacaggccccaggagtgctagacggcaccctgggcatccttccttttccctgccccgcgttttggagcagtcctagcgtcagaatggggatctggccaggatcaagagagctgagggacagaggcctccagaaggctggagaccttggctagatgggcccacactgattcttgggacaaagatggggacactgcgtcagtctcagtcaccaaggctgacctggcccctctcttggctcatcttggtaaagatagattttaggctgtgggcacagactgacgccctctctaacgcagcagtaggttctccagggcaaggtgtggcctcctggagtccccagctggtgaagccctgtctgagggtgacgaccactctcttgttctccctttctcccctcggccaatcggggattccccgtcacagaggaggggtctggaaccctgctgggattacagtttgtcaggagccttgggctgggtcacactatctaaggttgcgggtgtgtgaccacgtgcaggccactgcaggctccggcagcatctgtttcctcatctgtgaaatgaggagaacaacccctgccctagcggacactcaggactgtggtgaggctcaaattcactcattccataagtattgattggttgtctgcttcatgcgtggggatcaagggctggggctatggcagcgatgcggcacacagaaacccctgctctcgtgaaacttgggttctggtaggggaagctacaggcaaaagcaattaaacaattaaaatatgcatccatgcgagagtaagtactgcagacacagggaaggcaaggaagggaggcgggtatgctgctggggagctttgttttgttttgtttgcattttgatgtgggatggtcagagcaggacttgctggcaggataatatttcagtaacgcctggaagcgggtgaggggcgagccttctcctatctgggggacacctgcttcggatagaggtgctgaggctggagtggcctggcccctggaggcacagtgaggaggcatcgcattgggaacgggccacaggaagagtagcaggagtccagcacagacgtggggcctcctacacgccactgcagggtgccagcttccactcttaacacaggaggccgccagaacaagggagcagaggagtcccctgttgtgacatatgcctggagaggctcactcctgctgagaacagcgcttagtgagcacagcgggagcagtgagaccaaatagcggcccagacaagccactgtggtggccaggccaggccgaggatagaggagtatcagtggttggattccgtcgatagatgctgaatgtattttggagacagagctgacaggatttgctggcagattggttgtggggcgtgagtgtggagttgaggatgtctcctgggcttctgatctgagcaactggcaggatgggggtgccgttaaccaagatggggacaaggtggaaagatgagagtggagaggcaaagatgaggagtttgctttgggacacgtgaagtttgcagtgcccacaagccaaggaggccagcatccatgatctggagtttggagggcgggtggggttggagacgtgaacctggcatcgccagcatgcaggctgtgctgcaacacgagacttgctgagctcaaggcagcgtgtccagatgcagagacagaaaaggactcaagaaaccaagcgagaaaagtgtctcaaggaggggtgagaggtgactgaaaatgggacatggatttagctaccaggaggcttctggggctcttggcaaggacaccttccagggaggggttaaacgggaatgggtgtgagcagagggtatagagaacaggtttccgggagttgtcaggttaaggtggatgtgttgagtgtgtccactgtgaagctgggggcggctgtcacaggcagactcttagcccccggcagcgagggagtgatgctgctccgtgctctgtcctttcagcacagcgacatggcaggggtgcattcctaagatccctgcccaagtttatcctgggctgtgcccaggccacctgtgagttgttccctctctgggaaatgtcccaggcagcagctgcagctggagagtggcccgctcccaggccggcactcagctggcggcccgtctcatcagggcctttgtcctgttctgcacggcaggcagcagcaattccctggcaccgcgtggagctgtacaggctcgtgctgtgctgagaggcctccccgtcccctgcccccggcccctgtccccttcccccttcccccggtccttgtctgctggcccctgcccccggtccctgtctgctggcccctgcccccggcccctgcccccagtccctgtccgctgccccctggcccctgcccctgtctgctgtcccctggcccctggccactgtccgctgtcccctggcccctgtccgctgtcccctgccccctggcccctgtccactgtcccctgccccctgtccgctgtcccctggcccctgcccccatccccgtcccttcctctcctagcccctcaccccatctcactgtcccctctggcctctcccaattgtcttctctctgtcacaggctaatgacaaactatgtgaccttcatggtgggggagattctgctcctcatcctgaccatctgctccctggctgccatctttccccgggtaagaggcacttttctactgagctcagaagcctctggaagtgagtggcactccctgtaaaactgggcagtgatggagttattctttctgtcaaatctgacaggcagacactcctctgttaggacggtccaggcacttgcccatccattcattcaccatcagcagagcactccctctggctgggccaccaggctgtggcaggctgtggtgggccacggctgggccgtggtgggccttgttgggccgtggcgctgcagcacgtatgagtatggcagagtctgggtaaacaagaacctgggtagagaggaagtggagggccggctggaaggtgggttggccccgatggtgaaggcccttagaagccagactaaagggattaaaactttctcctgtaaggcactgaggtaccaagcagagtttttttttttttttaatcagaatgacaaaggtaaagcagtgtttaggaacataaatctgacaggtggctcgccaggtcacttggagccaggataggcaggagtagctggccagagacgagcagccctgaaaactgttcctgccctggcctcacctcgtcaccacgtctgctgtggaaagggctgcgacctggaggctgtgctgttgaacaggcacatcgaggaggtccaacacagcgtcagaactcccacgccctcttctcagctctgccccttggtcagctgtcaggtgactcccaggcagagtccgttttgaggctcctgggactggaatacgggaccagcctgagttgctgtcagtcacgtcgcaggagaaaggactggcaaaggctcatggcccttgaaattctgttccttctaggcctttcctaagaagcttgtggccttctcaacttggattgaccggacccgctgggccaggaacacctgggccatgctcgccatcttcatcctggtgatggcaaatgtcgtggacatggtgagctcctgctgtccttgttgaagggacgcccctgttctcagtggagaagggcttctgtttgggtcacacaagcagtttctcagtccatccctccaccgtcatgtagctttggagtggctcttaggttcccaaacacatcatccccacctagtggaaggagtcttgtccctgtcatccagggagcctctgggatggacttgtttccttgaagctcctctcccagagtccgagagcacagttccatgtgcccaggcctgtgctaggtaccttatgtatgttgattcatttaatctgtgaaaaagtcctgagcagttgtaccagtatctgcagtttcatagggagaaactaactctcaaaaagggtaattggttgggcgcggtagctcacgcctgtaatcccagcactttgggaggccaaggtgggcggatcacgaggtcaggagttcgaaaccagcctggccaacatggtgaaaccccatctgtactaaaaatacaaaaattagccaggcatggtggtgcacacctgtaatcccagctacttgggaggctgaagcaggagaatcgcttgaacccaggaggcggaggttgcagtgagccgagattgagccgctgcactccagcctaggcaacagacagcaagactccgtctcaaaaaaaaaaaaaaaaggtaattcacttgctctaggtcacacagccaggaagtgacagagtccagaatggaggcagttctaagtcccagtcctgtgtattcttcctccctgagggggcagccaaatgctttcttggggaaaagggacaggagttgggagcccagatctattggtttagaaccactgggcacgtattgagcactacatgcctggagctgtcatcagtgttctcttgtcagttgtcacggcctcctctaattgtggtagtaccatatacactatcttccttttttttcaaatataatgttattgttgtactttaacaattggagcacacggtgccgggcgcagtggctcacgcctgtaatcccagcactttgggaggccaaggcgggcggatcacgaggtcaggagatcgaaatcatcctggctaacacagttgaaaccccgtctctactaaaaatacaaaaaaattagccgggcgtggtggcaggcgcctgtagtcccagctactcaggaggctgaggcaggagaatggcgtgaacccgggaggtggagcttgcagtgagccgagattgtgcactgcactccagcctggcaacagagtgagactttgtctcaaaaaaaaaaaaaaaaaaaaaaaattggagcacacaaatacaaccaacatggagacttattctgccagtggtataagtgaaaaagctccagggctgcagctaatcagaagtccagtggggggccgggcacggtggctcacacttgtaattccagcactttgggaggctgaggcaggcagatcacttgaggtcaggagtttgagaccagcctggccaagatggtgaaaccccgtctctactaaaaatacaaaaattagccagccacaatggcacgagcctgtaattccagctacttgggcagctgaggcaggagaatcgcttgaacctgggaggtggaggttgcagtgagccaagaatgcaccactgcacgccagtctgggcgacagagcgagactccatctcaaaaaaaaaaaaagaaagaaaaaaaagaataagtctactgggaatgaggagttaggggctccagagcctaccttggccaggggttgctggtgcccactacccagggaagagaagccccaggccccctgcatgtcacaacatgcctggaacctggcacccaggtgtggaggtcaccactgcatggggtcctggacactgtacaggacacctggagatgctgtcactcatggaggggtaaaaagctagggaggtgtaacaactgctcatgctagaatgacatggcgggaatcgcgcaagcaagacaaggttgccctgtgggtgaaagttacaaaaagggggggttgattccggttctggatgcgctttctcccggccgcatctgcccagtagcagaaccagtaaagaatccagaaggcagtgaacatccccccaatggaaggatttgggcagagactagctgtcatcacggggaggctgtgagtggggctcatggtcccgtggcccctcctgaagcaacagtgtgatatggggaagaacatgttggatttgaagcctaaagacttggctcctacttttggcttttctgcttgctaattgtgtttgggcaaatctggcccgagttttctgtacaatagggacagtactaaaaatactcgagagagtttttgtgaatgtcaaatgaggcaatggcgaggctcttagctgcagttactaactttcatatgattagtccctggtaaatttccccatctttcccggtatttctgggggagccgcgggaggtggcagctgagcgtgcactaccatgcacagccctctgtgaccagcacctgctgttctcttgaacgtgtgtccctgcccgccgtcctggcctccagctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgagtaagatgaagcgtgactggggatctgtattgtctccttcctcccgcccgcaaagtcctcagttcaagctcatgggcctgtgctgaggtggctttctgccactaggggtcctcaaaggcttgttcaagaaccagttcctggctgctcacagacgtatcactgtttggctaggacctgagaatagattcttcccattctccccgagtggaggacttgggataccccggtgcctggctgggcatcaggctcttgttcccagatggggcctgactgtgctgttatctgtccaacagcttacctatggtggccttagagcagatgcaaggattcaaccctgggctcaatggcactgacaggtaagggccacggcttcccctcctggcctgcactcacagcccttcttctagagacaggaatataacaggcccaagccccgggatctcaccctcccgggaggcacgtgacctgatacgtgcaggttagagaagctggcatgggttcctccaggagggctgcagcagtgcagtgaggagggaaggaaataccaggtggatggcagctgcatgtaactggctggcaggacagacaggcagcaggaaaatgaggagggaggaagacgctttggatttggacctggcttctgagcctgcagcaggcagtaattctctgtgggtcacaggcaggtccgtttccatgagttgcaatttcatctcttgaggaggatactgaaccagaagttctctaaggtccctgccagtgccaaggttttaaaattttatgattccatgacttgaacagaccttcaaggaagtttagaaataaaaagatgacctaatagaagaggggtaaaacctgcatagcccttagcaaaagaagaactctaaatggccactaataaatggcactcaagtaatcaaggaaatgccagttacaccctagtgagataccatcacacacgtaccggtccagataactctgacaatatcaagtacaatagtaactcttacactcctggtgggagtatgagttagtacaaccgtgttagaaaatattttgatctatttagtaaggttgaaaataaacctgtgtcccagcaattccactcctacatacacacccacgcagacgtgtgtatatgtgtatatatatatacacacatcttagagaaattcatgcacatactcatgtcccaggatatatgtatgagaatgtccaaggtggcactgttcgtaatagacataccccctcccccaaaacaaatgaaaacaacccaaatgacatcaacaggaaatggatacataactggtatattcatgcagtgaaataccatacggtaatggaaactaaccacagctccacataaaaatatgtatgaacaaggtaaaaagccatggtgagattgtaccccagtcccatggctatgaaatcccatcactgatgtctcttgcttctccaaattcctgcatggttgtagctacctctgtgatcagtcaggcaatgcagtgtttcttaaatacctggggagcagccctgatgtgaataccaggtgcagccaggaggggccaggggttgcctggctgttggagaggagcccagtgagttaagaaaactttactgcccgggggagcccgacttgatgtgaaagggcctaaggagccggggtgagctctagggctggggtggcaggaagcagcaccatctagttggagggaatcaggccccctccaggaggcagatgacagccctttcagttgcacacgctctgcccagcaggctgcccctggtgccttccaagtactctatgacggtgatggtgttcctcatgatgctcagcttctactacttctcccgccacgtgagtgccgcctgcacgatccccgctctgtgcccacagcccacagggcctcctgagaagcagccccgggacctaagagcccaagctcctaaggaatggggcttcccttcacccagccccacacgtgagcctggtcaggccaccgccttctctattcaggctccttcctcagtcacacaggaagacagttcctcacctcttccgtccgaccccctccaggatggtgaaggaagcatgggagtgaaggtgggaggggatagagtgaaggcacaaacatcttgaatcaaatcaatatcccctaggccaggggctcatggcccccgcactccccgtggcgctgagggacattaacacaactgaccacagagccagaagagaaagagaagggagctgatggactttctgttgggttaaaaggaaaagagaaggccggtgcagtggctcattttgggaggctgagggtggaggatcacttgagtccaggagtctgagaccagcctgggcaatatggtgaaaccctgtctctactaaaaaatacaaaaattagccaggcatggtggcccgcacctgtaatcccagctacttgagaggctgaggcaggaggattgcttgaatctaggaggttgaggctgtagtaagctgagatcacaccactgcactccagcctgggtgacaaagtgagacaccccccccaccccgccacaaccaccgcactcaaccggacaaaaaaggaaaagagaaggaagagagggaagagaaagatcctctgtacttagggcccaatgttagttcaagtgccccctactggctttccagggaagtacagccttcccaagccacttcttacccaaatggcgcctgctagaaagggggactccaccctgagttgggagatccccactgctgccacctccacgagacagacctgcagctgaaattaggtcccaagaggccccctacacacggaaggcctcctggatctctgctgtaactacggaggctgggaaccgcaccactattgggtggccttttgatgaggtgcaatctttgcagggtcttacttcccttgccatttagccatcttccttccagcctttccaaggggagttcctccattcacgttcctgtttttcttctttttttgagactgagtctcactcttttgcccaggctggagtgcagtggtgcgatctcggctcactgcaacctctgcctcctgggttcaagttgattctcctgcctcagcctcccgagtagctgggattacaggtgcccgccaccatgcccggctaatttttgtatttttagtagagacagggtttcaccatgttggtcaggctggtctcgaactcctgacctcaggtgatccgcctgcctcggcctcccaaagtgctgggattacaggcatgaaccgccacgcctggccattcctgtttttcatccttctatccagtggccagcttagagcacatgcctcgccttgtctgtgtctgtaggtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggtgaggggtgtggtctcagcccggaaccatgaggccatttgtctccatctgttctttctttcaggcagcccccgctgggcccaggccttctcagggacaggggactggggcctaggtagggctgaacctaaacagcaaacacaaataagcaaaagaggaatttctccggcctcttataaagtgcactgctgtaggcatcgtgatgtgggccgtacagctctgaggccatgtgtcagaagacaagactttggctagagcccacctttctgttgcctgtgaacttctccaaacagagtggttcccagctctacggtaccctcgtcttcacagctggggctgttagaggaactagagaagctgttttaaaatttattcaaagtagtggctgggcacagtggctcacgcctgtaatcccggcactttgggaggccgaggcgggtggatcatctgaggtcaggagtttgagaccagcctgggcaacaaatagtgaaaccctgtctctactaaaaaatacaaaaattaactggacgcggtggtgcacacctgtcgtcccagctactcgggaaactgagacaggagactcacttgaacccaggaggtggaggttgcagtgagctgagattgtgccactcaactccagcctgggtgacacagcaagactccatctctcaaaaaaaaaaaaaaaaaagtagcgatgagctatttttaaattattcagagttggaataatctacagccgggcatggtgacatgtgtctgtggtcccagatacctggtgttcaaggccgcagtgtgcttcgatcatacctaattgtgcttgtttactgccactgcactccagcctgggaaacacagcaagacccactcttaaaaaaaaaaaaaaaaatgctggaataatctgactgatgtgtgagtccaaaaagctgagtgcacatgtcatgcatggaagatagatgcatttctccaacacatcatccagtcagtcggacatgctttgagcacgttgtccgcacctctttttaggagctgtatagccagacgtatgatgagattggagtcatgtttgcctccctgcccaactttgctgacttctacacagaggagagcatcaacaatggtggtattgagtgtctgcgtttcctcaatgaaatcatctcggattttgactctgtgagtgcccatcccaccctgcactctggccatgaagccggcccattccacatcacatcctacaataggctgcagaggccagagaaactggcttcattttcccagataagccccttccgcaatacatggacttctgcagccacctggaactgctgggctggggaaggggaggtgaggtgggagcccgggaaatcacccacagggtcacaggataaggataaggactggccaagcaacatctcgagacctctctgtcctgggactgtctcctcaaattcagagccggtcagcattgactgggtgacctgtataccagggagaatgcttttacacacgcgcggagcccccctaggagactgccgattttatgtcagtgttgaggttgtggaaacaggcccagaaagttaggaagttctcccaggatcatgtggcagataagcggtagactaagtaacaactttgataggaaagtgtctcttgggtttagtggggtccttgtaaacaggtacatctgtcactgggttgggtcattcctctcccttgactgctgacaattctttcctgaatcctggcctcagctcctggacaatcccaagttccgggtgatcaccaagatcaaaaccattggcagcacgtatatggcggcttcaggagtcacccccgatgtcaacaccaatggctttgccagctccaacaaggtagctaaccccagtagccagagagatgaggctctgcccccaaggcaagagattggcagcccagacctagcatgggggaaataagaactgctgtgcaaagtggtcccagacacacaccaccagcaccacgtaaatataaataagaaatagggtttattgagaaagttcggcaagcagagaaacagaacagacacacaaccccctgctgttcacagctcaggcctaagatggttgtgttctgtggccaggccccctaaggctctgtgctttcataggaactggagagcaattgtcaacaagggaaactgaaagcatggccttcagaactctggctgacggcagcctgttcttttgttaagctaatttagacctttgttcagctaccaggagagaaaattaggtgtaggagccctggtcccaagctctggtcttaaaacaccatcatcctgctttacctctacaaccatcccacggccctattatatggatgaggttaaagaaacacgtccaaggcgggtcatccccctccagtgcttatcacctagttgagggatccaaacaaggacaacctgacaaaacctaaggaccaggaccaggcccagccaaggtgaaggggtccgcctcgtggtcagactcacaggtccgtctcctctgctcaattgcccagtctttgcctagacctgctacgtgaactttgtcacagtggcaagtcagagctagcgtggctgcgactcctttgtgggaggaaaagtaaggccttgaacatctaggtgtagggaatccacccccagaacactgccagggaaggcagcagagcaggctgctgcagtgagcggcccctgacactttctccacggtcccctggcacaggaagacaagtccgagagagagcgctggcagcacctggctgacctggccgacttcgcgctggccatgaaggatacgctcaccaacatcaacaaccagtccttcaataacttcatgctgcgcataggtgagcacccccagctggcctgccccgcagcaggctcccttcccatgcaggggcctggcccaccaccaggagagacatgaggctcaggacaactgaggcaattcgggtggggaggttcacgcactcacagggcaaggagacctgaaagacctttagtccagacgactctagatgactaaaccaaaaacccagctgatgtgatgatccgactatactgtgcctactgttacaatagaagcttggcctgcctggctgagaagtgagtttgtgatccatttccagaggggttgctgtgcctgctgaggacatggcttcccagacaggcctgctctttgaaaggagttaagatcacctgctgcttctactgagggggtatcattcctgagtgaggtcccaggagacttgaaataccagctgtgttagaagctggccactaccatgccgagtaaatctgcatatggggggggggtggcggctgacacctaacaagcacacggataaacaggagatgtgatttccaccctccaatagcatacagccaagttgaatgaggacaatgatgtgttacattaggagctttgtggtacaggtctggagaggagatggcttctgaggcccataacaaggtgtggcctgtggctgtgctgaactttatgcctctaccctaggcatgaacaaaggcggggttctggctggggtcatcggagcccggaaaccacactacgacatctggggcaatacagtcaatgtagccagcaggatggagtccacgggggtcatgggcaacattcaggtatgtccagtggcacagctggcacgtgctcagactcggcatgagaacaaaaccggaacagtgctttcccacgtgcccctgcctcccaccctggccctgaacagtaagtccagaggcagagacgtggggcaagtggaaaagaatctctgcaatagctagcctcagcacaggaagaaacacttccacccatccacaaaatctgggctgaagttctagatgcatatggcctacctttgggtatgaaccttctaataccttgtgatctgtctcagtggcgtctggcagaaaagctccacgaaaggggcaaagggacagaagagcaggcagtggcagtttccaggtaacagtgctgccacccaggtgaccatggccatcctaggagagaagtctctggatgagaggaggcccccagccagtcactccagggttctccttcccacccgctgctcgccacgggtggaagggcttggccctgggaggtttggggagtgtcccgtactgcttgggacccatggatcagtgctcggctccaaccacccaaagcccccacccgccctcagtctaggctccccccgtaacgccacgttcttgctccccctccctctccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagccagacacaggttttcatatctgtgagtgacccacacgccaaggaaccagaggtgccagcaggtcagaggcccatggttacggcaaatcaggacactaaccggagagcctgcaggagagggaagacccggggggcgcctgagtccccctgagtttatgggcagatttctaactaactgtgctttttcagaggggacttcctagtacattcacagctctactaaacttttaggaaacaaaatatgagacacactgaactctgattattttatcctactgctttctcacaccatatttataaagcagtggcctagaatacactgcgcctaaccaaacactgaagaacttccttttcaaaagtttcaaacaggaaaatgaggaaaaattacttaaagctttcataaaagctaaaaatactttccttttttaaaaaaaaaaatattgggtcttccttattatcttcattagtgaatgtgggttatttttccatttatttagatcagtgtttctcaacagaatcaagctattgcagtttgagtggagtgctacatttctgtgagagccctttctgaaaattttaggatttttggcatctctattcctggcattaaattagtagcagttactgtgacaacttaattgcctggtctttcccagaagttaatgccctcaataatttgatatttttccataagtacttcttgagtgatacacctttttcaaaaaatggcttttattgccccacaaatgattttcaactaaaatgtatgatcaactaatacctttaaaaaacatcttgagcattttaagaagggaccaggtgatcatgggaattgttcaaaaatgccagtgtctatactcaaacctgctcttccatccagatgaacaggtaggtgtctgttttcatcagaagggtgatgtacccttcatcagacagtactacccacctggtactgtcttcagtactggttacttacctctgatgtgctcccagtgcagtgaaaacaatctattaggagaccagactcatatccaacttttctccttttcttgtaaatgaggcaaacacttgatgcaagggcttcgtacagaacagagtttcatgagatgctcgttgctcctcccatgaagtggataatacttccactcctaaaaagaaagattccatcaatctcattcagtgcagctgggggaatcggagcctggatcactgatattcaatctcattcagtgcagctgggggaatcggagcctggatcactgatattcaatctcactcagtgcagctgggggaatcggaacctggatcactgatattctggacccactggacccatacagttttttttttttttttttggtctggactaaggctgccccttactggaccaatgcaatctagagactggggactggaatctaactgcgcagagaaatcaaagaccgatggtgtgaaatctggggcagcttcaaaatttctgcctcctaaaaacatttcacccaatttttcattattgcccatgtcacatttaactgaaacaggttcaccaaaaaatctctctctcagccagtctggaaggatttccatttagagactgctccgtagggaggagtaagtgtgtgctgacgtgtcatgtccatttgtcttcacagt

SEQ ID NO: 12318 - DNA, 18102 bp, Human
ttcttttctttttttctttctttttttttttttttttttagatggagtttcacttttattgcccaggctggaggacagtggtgcaatctggggctcactgcaacttctgcctcccgggttaaagcaattctcctgcctcagcctccccagtagctgggattacaggtgcccgcccccatgccgggctaatttttgtatttttagtagagatggggttttgccatgttggccaagctggtctcgaactcctgacctcaggtgatccacccgcctcagcctcccaaagtgctgggattacaggcgtgagccactgcgcctggcttggacagcctttttgtacccctgattcccaggagaactgctgctctattttcccatggcttaccttgaaaagagtaggatactagagaaaaggatggctaatcacgtgtttacaagccatgtttcaggagatgacccttgtagcccggatatttatttgcctcaccaaaattcaggttctaggtgtaagccaggatttgggggatggaactgaaaatgcttctccaaacggtgaaaagcgggcccagcgcagaggctgaggaggaaggatcacttgaagccaggagttcgagaccagcctgggcaacatagagagacctccccccacgccctgcccaccaccgccgtctttacaaaaaaattagccaggcatggtggtgggaccacaggggcacaggctgaggtcagaggattgctccagcccaggagttccaggctgcaatgaatggtgataaacccactgcactctttcctgggcaacagagtgagaccctgtcttaaataaaataaaataaataaataaaaaaaaaagaaaagtgaaggcaacgttaataagtgtccactatgacataataataaccagcatcacacacacacacgaatcttgcatatatcacaaaaatctcagtatggtaattctgtggagaaaaaaaaaaagcccatccaggtaagcatagaaagtgttttttcatcatctccctttgactccaaatgaagaagcagagttcccaatagcatgaactagatgttggcagaggaaaaagcgagtcctcgtcctatcctggtgtaaacttctgattctggacaattctcagtaggattggcaatgactcttctaggcctccttgtgattgttgatatattttttttaatttaaagttccggaatacatgtccaggacgtgcaggtttgttacacaggtaaatgtgtgccatggtggtttgctgtaactatcatcccatcacctaggtattaagctccgcatgtattagctatttatcttgatgctcccctcccccggttatcaggatttttaaacagtttgctctaattcactgacaggattcttttagaatgaatctaaaaaagctgggaatctttaacctgagcgcagatcggatcacgtggaacggtgctggtgtttgttaaaaattcagattgccccgaattttcgactcagagggtctgaagtggggctaagatctgcagattaacgggctccgtgggaggctccctgctggtggccagtcccggggtttagctgttcactgttgctactcgtgctaaaccacggtctaacactaccgacactattaatcgccctggtcctcaagacagccgcgaccccagacgggtgaggccctcatcctctagcaccagatggggcctgggaactgctgcttagcagattcagctacccacgtggtcacccggggcaaccacaaggtcgactcaaaagaccaaaataaatgtataacgaatgccaggaccaaagccggaatatatctaatcattcattttgaggtttaaacttaaaaatgttacataaaaaaataagtaacctgccaaaaaatgcagagtggcggcgggggcggggggagaggtggtgaacgcgaggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgccttcggctgacagcggccctagaagggggatcttgggtgaaggtcagggcttgggcgctagctctccgaggcctgttctgaatcggtgaggttcctctctttcgattcttagggtcgcgtcccgctgaaggtcagaaaactgctgtcagctcttgttgaagctagtcagtggagtctgacattgtgtgaaggtcagcaggcccagcatttcacctctgcctggagctcagtttagaggaaaggaataaatgaaggtggtttttggaatacttacgtaggctttctcttagtgctgaatacgaaacgaccgtgaaaacgtcctgcaggtgcaaagaaccatttcatgtggccagcactgtgacaacagtgaagctggtttctaaattgtctctccggcagagtgtgtgctttgtggcacttggacgtgtttaaagaatttgtccttgagttttccacctggttttgagtaatttttagtgatggagaattcaagtaaaagagaacaaggttggaaaatggctgtaaggattaatacccttcgttatttgtttcccttgaaattaacatgatttcagtgtaaacgcattgacactgacactttttttttgttctaaaagtaatctcaatttgaaaggtgaaataaacatgttggctgttttgctgccttaacaaccgctggtagcatcttgggtttctgttaacaaaaaagcatttttaacggttttcatctagctcctatggaaggtagaggcttcagaattgacagtgaccagtcgcagtattacaacttgaaggagaaactgaaggaagttccaggtggctgcaggatttgttgagagagtaaaataagtccacatgccacaactcttggtttctaatctaactctagcatttattcagtttttgtttgcttgttttttttttttttttttttttgagatggtgtctcgctcagtcgcccaggctggattgcaatggcgtgatctccgcccactgcaaccaccgcctcccaggatcaagtgattctcccacctcagcctcccgagtagctgggattacaggcacccgccgtcatgccctgctactttttgtagtttttcgtagagacggggtttcaccatgttggctaggctggtcttgaactcctgacgtcaggtgatccgcccgcctcggccttctgaagtgctgggattacaagcatgagccgtcgtgcccggccgcttgttgtcgttgttgttgttgttgtttttaagtaaaattggaactactttgagttttgccccttgtaggaagctgtttatcttagaattcctgcaactccattaaaatacatctaaagtcaaaataataaaaattgggtacctttaaagggaaagacacttacattttgttaacagttgctttttttttttttttttgagacggagttttgcttttgtcgcccaggctggagtgcagtggcgcgatcttggctcaccacaacctctgcctcccaggttcaagcgattctcctgcctcagcttcccgagtagctgggattacaggcatgtgccaccacgcccagctaattttgtatttctagtagagacggggtttctccatgttggtcaggctggtctccaactcccgaccttaggtaatccgcccgccttggcctcccaaagtgctgggattacaggcatgagccaccgtgccctgccaatagttgctttttaaaatactgactgccaggccgggtgcagtggctgacgtctgtaattccagcactttgggaggccaaggtgggtgcatcacctgaagtcaggagttcgagatcaacctggccaacatggcgaaaccctgtctctactaaaaataaaaaaattagccgggcatggtggtggtcgcctgtagtcccagctactcaggaggccgaggcatgagaatcgcttgaacctgggaggtgaaggttgcaatgagccaagatcgtgcccctgcactccagcttgggtgacagaatgagactccgtctcagaaggaaaaaaaaaatgtgtgtgtatatatatatttactgcccagtctgggcaatatgatgaaatcctgtctctataaaaaaaataagtacaaaaattagcctggccaggtggcgcactcctgtgatcccacctactggggaggctgaggtgggaggatcacctgagcccaggaagtcgaggctgtagtgagccgtgattgagccactgcactccgacctgggtgacaagagtgagaccctgtcccaaaaaagaaaaaaaaataagccgggtgcggtgctcacgcctatagttctagcactttgggaggccaaggcgggtggatcacttgaggtcaggagttcgagaccagcctggccagcatggtgaaaccccgtctctactaaaaatataaaaaattaacctggtggaggtggcgcacccctgtagtcccagctactcgggaggctgagaatcgcttgagactaggaggtggaggatgcagtgagccgtctcaaaaaaacaataataataaagtacagactgcattttaaaaatatgcgagtgtttactgtgtactaggagctgtataaaaggttttcacatatatcaaaagctactttcccatttgacattttaaacaaaatgctttatatgtaattagcattttcaccagtactttgatcacactaagctggcatttgtttaagcttgtaagttttataaaggctttgttaaaaatcaaatttttaagaatacttttgcactaggtctccagaaatgctttgggttcatctttcattgctgcaaggaacttccatgcctctaacactcatcttcaaaagactggtaagttattatttctcagtctacgccgcacttactagatgaagatataaattacatacatcgtataactgtggtgagttgtttttcatttgttagttttttctctagtttgtatagactctcaggttcttaaaccatattgttaccatttagccctgtcatggttctcttgttatagtcaaatgaactactgttacatatttttcttttgatattagtatggcttctttgttctggtaatggcccttgggtagaaacagaaagaacatacactaggtaatggaatctttgtgacctctggaagacttcctttttccttttctaaaaggcattagaaaaaatgtaagttcttattgataggttttcttattctttttctttttttttgagacagaatcttgctctgtcgccaggctggagtgcagtggcaagatctcggctcactgcaacctctgtctcctgagttcaagcaattctactgcctcagtctcctgactagctgggattacaggcatgcaccaccatgcccggctaattttttgtattttagtagagacaaggtttcaccatgttggccaggatggtctcgatctcctgaccttgtgatatgcctgcctcggcctcccaaagtgctgggattaaaggcgtgagccactgcaccggtccactgataggttttattttttcaaaggcagtagctactagatatttggcaatctgtgaacttgcacattacagatgcagtagagaagtggggaggcaagcataggaagacactataagttggggaatttctttggagatgagtatttggacttttaaaataaaggttaaatatatatgtgtgtgagagtgtgtgtgtatatatgtgtgtgtgtgtgtgtgtgtgtgtgtgtgtgtatgtgtacacacacccccacgttcagcatatatgtttttcttttttcttttttttttgagatggagttttgctcttgttgcccaggctggagtgcagtggcatgatctgggctcactgcagcctctgcctcacgggttcaagtgattctcctgcctcagcctcccgagtagctgggattacaggtgcccaccaccacacccagctaatttttgtattttttgtagagacaaggtttcaccatgttagccaggctggtctcgaactcctgacctcaggtgatccacctgccttggcctcccaaagtggtgggattacagacatgaggcactgtgcgtggcctccttttttttgagactctgttgcccaagctggagtgcagttgcgccatctcagctcactgcaacctccacctcccaggttcaagtgattctcctgagtcagcttccctagtggctaggattacaggcacgcaccaccacacctggctaatttttgtatttttagtagagatagagtttcgccatgttggcctggctgatctcaaagccctgaccccaggggatccgtctaccttggcctcccaaagtgctgggatgtttttttattttgttttgttttgttttttgagacagagtttcgctctgttgcccaagctggggtgcagtagcgtagtcttggctcactggaccctccacctcctgggtttgagtgattctctcctgcctcagcctcccgagtagctggtattacaagcatgcaccaccacagctggctaattttttttttttttttccttagtagagatgggattttgctgtgttggccaggctggtccaaactcttggcctcaagtggtccgcccgcctcccaaagtgctggtattactggcgtgagccactgcacccaacccctgtatgctaagatgaagaataccacctatactaccctgtgtgccttgaaagagaaagacacactttgttaacaggtgatttttattttttattttttatttttttgagatagagtcttgctctgtctccaggctggagtgcagtggggctatctcagctcactgcaacctccttctcccaggttcaagtgattctcgtgcctcagccacccaagtagctgggattacaggcatgcaccaccatgcccggcaaacttttgtgtttttagtagagatgggggtttcaccatgttgcccaggctggtctcgaactcctggcctcaagtgatccaccccctttggcatcccaaagtgctggttttacaggcatgatctaccgtgcctggccaacagttggtttttaaaatatgtttttattgaatttagccaaaaaattcaggttttaacatagttacagatttcttagaaattaaaggagaacatttattttaagggttttacttaatttgattagcttcttgtctggtttacatttgttttgtgtggacttttttttccttaatcacttggttttattttcatagcttttaaaaatagaatctcgtgttacagtgtagaatatatatatataatttttgtgtgtgtgatagtctcactttgtcacctatgctggagtgcagtgacacaatcttggcttactgtgacttccacctcccaggttcaagcagttcttctgtctcagcctcctgagtagctgggactacaggcatgcccgtgcccagctaattttttttttatttttagtggagacggggtttcacaatgttggccaggctggtctcgaactccttacctcaagtgatctgcctgcctcagcctcctaaagtgctagcattaccactgtggctagcgtgagccactgtgctgggtctgtagaatatatttggattattatgatcacaaaactagttttttgttgttgagaaatgggctttgaaaagatccgaggaccagatttttattattattattattattattattattattattattattattattattttgagatggagtttttgcccttgttacccaggcttgagtgcaatggtgtgatttcagctcaccgcaacctccgcctcctgggttcaagcgattcttctgcctcagcctccgcctcccgagtagctgggattacaggcatgtgccaccatgcccagctaattttgtatttttagtagagacagggttctccatgttggtcaggctggtctcaaactcctgcccttaggtgatctgcctgcctcagcctccaaaagtgctgggattacagctgtgagccactgtgcctggcccagattatttttttaattgaattgaattgtcttccatagggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaaggtaaattataaaataagattttggtgttttaggatctaagtcttctcagttattcatttagcgattcaaagattgtatcagatttttaaaaaactttgtcttaatttgcctcagatttttttcttgttattatcatagattgtaaagagaataaacttaagggtttgaattagccaagtttttttactctagggactgatttatacataacttgtagccactggctccaaaatataaaattgaataaactttcaccccaaatccaagaagtttaagtctgttctgtcttgctgttaagattattttatacaaaagcaaagcatttgataacttcaacaaaatttttctggtggaaattggaagtccgtgactttgtatttctagtgagtagacatattgttcaaaggcgagttttggtgtagctatcagaagctctctaatgtaagtctactttgtattgggttgagcctcatctgtcagggtatgagaaataagttgtaggagttagggaaagcagaggatgacatctggataaactagagagagtggaactgtctagtaggcatgcagatatgggaaaagatagtcttgatactcttggtaatgtctactacggaaaaagagccacttgatgtggaagaataattacagagcccaaagttatcattagctgtaagacattggccaatttagcatcttcagtgtacagtatttatctttgaaaggtgaggtcgaaacagattaattctgagttccccttttagcttttgaaatccaagtgtctagaacagtactgtccagtagtattggaaatatgtagtattctgcagtgatgagaatacatctgtgctgtttaatatggtacctactatactatcactattaatcatgtaaaatgtggctagtgtgacaggaactgaatttttaatcttttaaatttgacaaatttaaatagccacatgtggttagtggatgctgtattgaacatcagagatgtaggttaaagtttttggatgtgtaatgatattccatgatactccaagtacttctccagagttttcattattgaccagactattcctggaatagcctttttgcttcagacatgatttaaagatctaaaatatagttttaatgatgagagatgatttggtgctgttatgttatgaaaatttgtatttgattggttacagttaggtagcttttaatttcactttctactaactcgaagagtacaggttttgattaatttttgaaactgtttatggagcttctcacacataaataagatgataatcaaatttgtcttaagatttccatttggccttcatcactttatttcatactgatcacccagcccaagaatcattgccaaagaaaatacagtggaaaaaagcttattaacctgtccaatttctttgcttctgtaatagttatttgaggatatgatagtgagcatattaggcttatcaatgtgctgtcctaagattattcaaaatagcaattttaaaagtcttaatcagagagggttgtttgttagttggaaaagtactcaagaataaaccaggtgaaaaggacaatactgcttccccccccaccccccgactattttcttatgtagtattggtgtatggggaggagtgcccattcagcttcattgatgttcaattgtgtcttttgtgcagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaaggtaggtttaatgttcgttagatatagttgcagcttctaacaaacatcaaaactgattatgcttagggtttttctttttattttttaacagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggtaaagactcaaaagcatattaaaagttctaactaaaatttgctcaatggaaggattatattttagtcttggaatggtaaatggtaatggggacattagaatctaatacgaggattaatagtaaaatttcagctgggaagtgaagggggccagcccctccacacctgtgggtatttctcatcaggtgggacgagctagctcagtcggtagagcatgggactcttaatcccagggtcgtgggtttgagccccatgttgggcaccagatgaagggggccagcccctccacacctgtgagtatttctcgtcaggtgggttgagagactgagaaaataaataagacacagagacaaagtatagagaaagaacagtgggcccaggggaacggcgctcagcatatggaggacccatgccgccactggtctctgagttccctcagtatttattgatcactatctctactatctcggtgtgggggatgtggcaggactgtagggttaatggtggggagagggtcagcaggaaaacgtgagcaaaggtctctgtgtcataaataagtttaaggaaaggtgctgtgccttgatgtgcatgtaggccagatttatgtttgactttacacaaacatctcagtgcagtaaagagcagtattgctgccagcatatctcacctccagccatagggtggttttctcctatctcagtaaatagaatgtacgattgggttttacaccaagacattccattccccgggacaagcaggagacagatgccttcatcttatctcaactgcaaagaggctttcctctttcactaatcctcctcagcacagaccctttacgagtatcgggctgggggatggtcaggtctttcccttcccacgaggccatatctcaggctgtctcagtggggagaaaccttgcacaatacccaggctttattgggcagagggccctgcagccttccacagtgcattgtgtccctgggtactcgagactggagaatggcgatgacttttacgaagtatactgcctgcaaacacatttttaccaaagcacatcctgcacagccctaaatccgttaaaccttaagtcaacacagcacatgtttctgcgagcacagggttggggctatggttacagactaacagcatctcaaggcagaagaatttttcttagtacagaacaaaatggagtttcttatgtcttcttctttctgcatagacacagtaacagtctgatctctctttctttcccccacagggaagtccttttaagtttaggaagatttatatttactttctctttttaaaggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcaggtattaaaagaaatttagtcccattgctattatcttaagtcccattgctgctgattgtagaatagcttctacttaatgaaggcatattttaattacttcctaatgggctgaactttttaatacaaatcagtaggtaagacaatgtaaaacagtagtacatttaaaggttttgttggtttctttaaagtggaagctgtttgattctgattaactctttttttgttgtttgagacggagtttcactcttgttgcccaggctggagtgcgatggcacgatctcagctcactgcaacctctgcctcctgggttcaagcgattctcctgtctcagcctcccgagtagctgggattacaggtgcatgccaccacgtccggctaatttttgtatttttagtagagacggagtttcctcatattggtcaggctggtctcgaactcctgacctcaggtgatcacccgcctagggcctcccaaagtgctgggattacaggcatgagccactgcgcctggcctgattaactcttaatggtaaatatttttagcacttaggtaatttttatagtagcctccaatttaaaaccacaatattgataaaattgtaaaatatattttctcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggtcaaaggaaataaatttttagaatccatttatttgtactgaagtaaaagttcacatatgcaacttctatttaataggttaacttcacaaacctattctgtaccataggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacaggtattattttaatgattaaaagaaatgttaaaaaagatttggataattctaaggcattggttgagactaatggtatattgactgatttgctaaatgcattttactttttattatggaaaatttcaaatacatagaaaagttaggagaatggcatagtgaaaccccatgtatctgtcacccagttattgcatagagtagcatgtttcgttctagtttcatttttaaccactactgttctcccttctagataattttgaatcaaatagaaattatatcacttcatttgtatgtatttcagtataaatatgttgcctattatgtttttttctcatctcatgcacatctcctaattgcagcaataaaatatacaggtcaggtcgtgaaagatttggggtactgatgctttgcattgttaggttttgagtttcagctttttggcataatgacttaaatttgaagatagttgatttcttactttaagcttgctagcgtgcgtatttccttacattatagatcttcttggaaacagaattgttctacaaaggtatccgccctgcaattaacgttggtctgtctgtatctcgtgtcggatccgctgcccaaaccagggctatgaagcaggtaattttgcatcactttggcagtaagggggctatcattagattagcaatatttgtatagtgctctgtgtcactgagttacagtacagtaatttctgtattgcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattgtaagttgttcttttcttcatttggtcaggttcctattgtgtatcagggtcttcccaggcctacagagctgcatcacatatcacggcctgtactacatgttgttatctgttatctttcatcaaaggcacttttacttaaactacatttgttttttgatttttgattttttttttttttttgagacgaagtttcattcttacggcctaggctgaagtgcaatggcgcaaccttggctcattgcaacctccacctcctggattcacgcgattctcctgcctcagcctccttagtagctcggattacaggtgtgagccaccacgcccgactaatttttgtatttttagtagagacagggtttcaccatgttggccaggctggtctcgaactcctgacctcaggtaatccaccctgcctcagcctcccaaagtgctgggattacaggtgtgagcccccatgcccggccctgtattctgttttttaaagagagacagtgtcttgcagtgtcacccaggctggagtgcagtggtgccatcatagctcactgcaggcttgaactcctgggctcaagcagtcctgcagccttagcttcctgagtagctaagactacgggcatgcaataacaagcctgggtaaattttttgtaatttgtaaagaaacacgggtctcactaagttgcccacggctggttttgaaactcctggccttaagccatttttccaccttttaaaatgctggcataaaaggggtgagcccaccaagcccggcctcaaaatattttttttttttttttttttttttttttttttttttttaatacagagtctccttctgtcacccaggctggagtatatttttagtagaaatggtaaaacctctaccattttggccaggctgatcttgaacccctgaccttaagtggtccacccgcctcagagtcctaaagtgctgggattacaggtgtgagttaccatgcccggcccaaactacatttcttattatcatttgagtgtaaatgataggggcttcacaaccaggaaaacttaagtatatttaatgtcttcctttcaggaattaaggcctgttagagtcccctcccccacttggctatatgaatatgtaatttggcagatttaaaagaaagttaatacgtttttattttgtcaagtcatttcagcaaaatatttatactcaaaacagtattaacactgtcagattataaacagtgcttatggactatactgaaagattatgcctcaagccttgaaaatataagaaataactgttttctgtcaggggtgggaggaaggattattaagtggagttctaggtcattgatattgtgaagaatagataatttacagggacatgttaggaattggagaaaaagtaagttttcctgaccttggtaacatggcattcatttctttgagcaactcacttggcattcttcttgtatcttttcagctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcaggtatgaatgcaattgttggcatctttttttaaagttatgtttaagatatgaagttaaaattattttcaaatctgtagttaggctagtcattaaaactttttccaggtcagaacttacgacctgcttttatttccaaatagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttgttttctgtcatttgtgttattctttaaaaccaagatcaaattgagaaattggtaagcaaatgcttcttgatctattttacttgaatattggtacagtcaactgggctagataattcaaggctgagctctttgtaagttttttttttgtttttttttttgagactgattctcactctgtcactgaggctggagtgcagtggcaccctgtcggcccactgcaacctccgtctccgggttcaagcaattctcttgcctcagcctcccacgtagctgggattacaggtgcccaccaccacgcctggctagttttttagtatttttagtagagacggggtttcaccatgttggccaggccggtcacgaactcctgacctcaggtgatccacctgccttggcctacctaccacagtgctgggattacaggtgtgagccaccgcacccggctgctctttgtaagtttctagagtactttgtgtttaagagaaattcctaaactggatatatgtggcaggctgacaatactgaagagcatagctggcttctctgcccagaggatgtacctgcataaagaggtactgtaggcaggaaaataataggacagttaaaattctcagggaaatgaaaaaattgctggaacaaaagctgagaagatagaatgcataggattatgaaaacttgtcaatatctcttttgtttgttttgtgacagggtctccatctctctcacccaggctggagtacagtggtgtgatctcagctcactgcagcttctgccacctgggttcaattgattcttccacctcagcctcctgagtagctggggttacaggcacataccaccacgcccagccaatttttctactttttgtagagggagggtcttgccatgttgtccaggctgatgatgaactccttggctcaagtgatcctcctgccttggtctcccaaagtgctgggattacaggtgtgaactaccatgcccggccatcttttaatattttcacagctactttatttcctctgttactagcttttcatagcctttgctcattcttactgcattaaattttttttactgatttatttatttttttgagacagagtcttgctctgtcacctaggctggagagcagtggcgtaatctcagctcactgcacctttcacctcctgggttcaagcgattctcctgccttagcctcccaattagctgggaccacaggcccatgccaccacacccggctaacattttgtatttttagtagagacaaggtttcaccatgttggccatgctgctcttgagctcctgacctcgtggtctgcccgcctcagcttcccaaagtgctgggattacaggtgtgagccaccacgcccagcctactgatttatttatttacttttaatttttcatagcctttgctcattcttaatgtgttacctttttttttacttagttatttatttatttgagatggagtctccgtcgtccaggctggagtgcagtgacctgatcttggctcactgcaacctctgcctccaggttcaagcaattctcctgcctcagcctcccgagaagctggaactacaggcacccaccaccatgccctgctaatttttgtatttttagtagaggcggggtttcaccatattggccaggctggtctcgaactcctgaccttgtgatctgcctgccttggcctcccacagtgctgggattacaggtgtgagccaccacacctggccttttttttttttttttgagacggagtctcactgtctcccaggctggagtgcagtggtgcgatgtcggctcactgcaagctctgccccctgggtttgcgccgttctcctgcctcagcctcccgattagctggtactacaggcgcctgccatcacgcccagctaatttttttttttttgtatttttagtagagacggggtttcaccatgttcgccaggatggtctcgatctcctgacctcatgatccacctacctc

SEQ ID NO: 12319 - DNA, 15003 bp, Human
cacctgcatggcctggggcttctggggtctggctcgttcctggcttcaaagctgtgcatgagccttctctttcagggagccctctttaactgcagcctgtatgtgggcttctcccttgcccctgcttctctagtctagaacttgtagctctgcatctgaatagtcagcttgggcgctgtagggtgctgcttcccatgatcccctgtgcccatcccagaacccagtacctggtagggactcaataaatgtcaactgagccaggcgcggtggggttcctgggccatggaagacctggcacttactcaaatggtcccaaggcccctccaggacaggggggcctggtgttgagattactgtggctgccaccctgaccaggtccttgccagcttctcttctgaccctgggcaggtacctgagcctcttcaagcctcagtgtcctcatctgttagatggagactattgtggcacctctagtgagagtgcagtgggaactgagcgaggtggaactgagcaaaatcctgagccagggttcactattgaccacagcaggtggctgagaagaatgttggatccccagctccacggcccaccagccatctgggactggcaaacccacaggaacggaaggttcctcagggaccacaaagcccatgtgaggtccctgctgctgaagggattctgaggacaggaggagccaaattacctatccagggtcacccagccaaggtgggttaggacctgagtttggtggctctcaggtctggccaatttctttctttctttttttttttttttttttttttttggtagagtcttgctcgttgggtcgggcaggagtgcagtggctggcacgatcttggcccactgcaatctccatctcccaggttcaagtgattcttaggcctcagcctcctgagtagctgggattacaggcatgtgtcatgacgcccagataagtttctttgtttgtttttcccagactgagtttcactctaatgctcaggctggagtgcagtggtgtgctcttgcctcactgcaatgtctgcctcccaggttcaagtgattcttgtgcctcagcctcccaagtagctgggataacaggtgcgtgctaccacgcccagctaatttttgtatttttagtagagatgggggtttcaccatgttggccaggctggtctcgaactcctgacctcaggtgatctgcccgcctcagcctcccaaagtgctgggattacaggcgtgagccactgtgcccagcccctggccagtttctgcacaccagtggctgaggagggagctggcctgggaggaacaccgggaggggaggggcgagccaggagccaggaccccgggaccctccgaggagcggattagtgcctccctcagagttaggacatggccttgggtccaacaggcctaagtctgagtgtgtgtgttgtgtggccttaaacacatcactccccctcctgcaccctccagcctctgttttccaccttctgttttctcattgataagataggcctgaccaggtcattcagggaatgaaatggaagtgcttagcaagacctctgtaagtggaggctgctgctgtcactgttgccattatcctccctctccgctccacccacctcctgctcctcttctttaaccctcagcccttcctgagtcagactttaacctggccaagtcagggctctgtctcaggacgcatggagccagggctggaagtctccactgggcaggcgccaggcagcccctgcaggctggggaggtggaggctgctggagtcaagaggaaccaggtgagggtgttggagcataacaggcttgggaggcaggcagaaacctgcccttctgcaaactctatctcttccccctcctgggagcagacaggatggcgctgtggcctgaaagcagctgtccctcctgtgtgcaagctcggactgctgcacccagacagattccatctctgaccttccacttgttcgtctccagctcgccatggccaaacagctgcaggcccgaaggctagacgggatcgactacaacccctggtgagccagctgggctggggaggtgtgtgggtgtcccctcgggcatgggttggccatccctgggtttacagcaactcagtagtactccagatggtggcggtacacagactgccagattccagccatagctcaggagagacagggcccgagggagtaggcttggttcaaatctcagctttcttctgcatgactgtgccactaggacaggtgacatacctgctctgagcctcatctccccagctgcaaaatgaagagttatacccacctggagagcgttggggaggaaaaagtaaaatgctgtccaaagccattctacccaggcaccaagctaaggcctttccagggatgactctttctcacttggtatagagtcagataaactaagataagtaaaataagcaagtaagatacagtcagctcttcaccagacatttgcagaggttgatattgttttcttttttgacttgttttattttcattttatttttgagacggagttttgcccttgtcgcccaggctggagtgcaatggtgcggtctcggctcactgcaacctctgcctcctgggttcaaatgattctcctgcttcagcctccaagtagctgggattacaggcgtgcaacacaacgcccagctaattttttttctttttcttttcccccgcaagacagaatcttactctgtcacccaggctggagtgcagtggcatgatctcggctcactgcaacctccccctcacaggttcaagcaattctcctgcctcagcctcccaagtagctgggattacaggcgtgcgccaccacgcccagctaattttttttttttttttgtatttttagtagagatgagatttcaccatgtttgccaggctggtctcgaactcctgacctcgtgatccacccgcctcagcctcccaaagtactgggattacaggcatgagccactgtgcctggccctaatttttatatctttagagaaaatggggtttcagcatgttgtccaggctggtctcaaactcctgacctcaagggatctgccctcctcggccttccaaagtgctggggaatacaggcataagccaccgggcccagccaaaaatgacacattttagacatatttattggtatgcaaattcaactcagccaggtcttcactctgctccaaactagccccaaaccacataccagcctcttcatccagcttcccagcctttctcccacctggagaggtggcccccaggcagggccagaacagaggattatgggtccagagatgatgtgtgcctgggctggtggggccctgttctgcccagagtagggtcaagagcatcaaactttgcttgagatggaagtagaaaggctggctggctgtgccttgtactagctgggaggctttaggcaagtcactccactccttatccccacagtggtccaggaacaagacgtgcctcacaggccattgtgaaggctatatgagcagagcgtttaactgtggtgttgacgaatccaaggaggagtcatgcaatctgtacagggggtctcaactagtatttggaaagaatagagtaggataggacaggacagaaaatactgcagtagattgcaccaagaaggatgaagcttccattccatgtttgtgctccacagggttgatgatgcaaaggtgatttcttggccggtagtggtggctcacgcctgtactgctagcactttgggaggccaaggggggcggtggatcacctgaggtcaggagttcgagaccagcctggccaacatagcaaaaccccatctgtactaaaaatacaaaaattagctgggcgtggtggcgggtgcctgtaatcccagctactcaggaggctgaggcatgagaatcgcttgacctcgggaggcggaggttgcagtgagttgagattgcaccactgcactccagcctaggggatagagcgaaactctgtcaaaaaaaaaaaaaaaagatgatttcttcctatgggtcatggtggaagaacttggaaagcccctgggctgattcctgcgattaacaatgtgcctgactgacctaatctcaatgtaggggaccagctgtgacacttaggcagatcttcaggccaggacagttgctgattgtctagtttttgtttttcttgtgtgtgtatgtgtgtgttttttgttttttgtttttgtttttttaagacagaatctcactcttgttatccaggctgcagtgcaatggtgcgatctcggctcacttcaacctccggttcccgggttcaagtgattcttctgcctcagccttccaagtagctgggattacaggcccctgccaccatgcctgactaacttttgtatttttagtgaagacagagtttcaccatgttggccaggctggtctcaaactcctgacctcaggtgatccgcccacctcggcctcccaaagtgctgggattacaggcgtgagccaccacacctggccggttgtccagtttttctaaacaggccgaagtccaggtcaccatggagggctgggctggtgctgattctccatttgttacccagggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttgtgagtctccccatctctcgtggaggcactgggggaggaaggggacagggctttctggacttcaagcccacacagctgtcaggcttcaggggacagagccaggggattctgtatgaccatagttcagtgtttactgagcgtatcctctgtcccagagccttcgcctcgtggtctagtggggatggcagacaagaagccagtaacgacaggcagttgatacatgatgtgatggaggaggatgggatatcgtgcgagtaagaaagagggaatgaaacctggggagggggctggagagatgcacgaagacttcctggaggaggtgacacttaaaccaagtcctgaaagatgagctactggttggattacacaataaatccaaacgttttccggaaaggaccacatagtaaatatgtgacactgcttggattagaacagtggttctttttttctttttcttttttgagacaaggtctcactctgttatccaggctggagtgcaatggtgcgatcatggtccactgcagccttgaccctgccagtctcaagtggtcctcccacctcagcctctggagtaactgggactacaggtgtgcatcaccatgcccagctaattttatttatatatttatttatttatttttgagtcagggtctcactcctgtcacctaggctagagtgtagtgacatgatcacggctcactgcagcctgtacctcatggggctcacatgatatgccatttcctggggctcatgtgatcctcccacctcagcctctagagttgctgggacaacaggggcatgccacctcacccagctaatttagagacagggtttcaccatgttgctcagactggtctgaaactcctgggctcaagtgatcctgccacctcggcctccaaaagtgctgggattacaggcgtgagccactgaaccctcattcttttttttttttttttttttgagatggagtctccctctgtcgccaggctggagtgcaggggcgcaatctcggctcactgcaacctccccctcccaggttcaagagattctcctgcctcagcctcccgagtagctgggactataggggtgcgcccccacgcccagctaatttttgttttgttttttttttaagacagtctcgcactgtcgccccggctggagtctggagtgcagcggcacgatctcggctcactgcaacctccgcctccgcctccgcctccgcctcctgggttcaagccattctcctgcctcagcctcttgagtagttgggattacaggcgcccgccaccatgcccagctaatttttgtatttttagtagagacggggtttcaccatgttggccaggctggtctcaaactcccgacctcgtgattcgcctgcctcggcctcccaaagtgctgggattacaggcgtgagccaccgcacctggccattttttgtatttttagtggatactgggtttcaccatgttagtccggttggtctcgatctcttgacctcgtgatccacccacctcagcctcccagagtgctgggattacaggcgtgagccaccgcacccgaccgcactcgttctttttaatggctgcatactgttctgttgcctggatgtgccataatttatttaagcagttctgcactgatggactgcttctgctatctcaatatcataagcaatgccacagcaaatatccctgtgtggacatctttgtatacatatgtatttctctaagataaattcctggaggtaaaactagcaaaagaaagactataaatatttataaatacaataggtggatattgttaagaaacagtgtgtgcctataatcccagctacttgggagtctgaggcaggaagattgtttgagcccaggagtttgaggccagtgcaacatagtgagatcctgtctgaaaaataaacaaacaactaagtaaataattgccctccagtaaggtttactcatttacatccctgccaataggctggtctcagagctggttggaaagttccttctttgatccaaaaaaaaaaaaaatcatttgggtatgtatctttttcttttctttctttctttcttttttttttcttttaactagagacaaaagctgggtacggtggctcacatctgtaatcccagcactttgggaggccaaagcaggcagattacccaaggtcagaagttcgaaaccagtctggccaacatggtgaaaccccgtctccactaaaaatacaaaaattaaccaggcatggtggtgcgtgcctgtagtcccagctacttgggaggctgaggcaggagaatcacttgaacccaggaggcggaggttgcagggagccgcgattgtgccactgcactccagcctgggtgacatgagtgagaccctgtctcaaaataaataaataaataaataaataaataaataaataaataaataaataaaagcctctcccgcaaagctgctgggaggatcaagtgggcacaaacatgcttcttaaacttacagatgtggaaagtggggagtttctactgccttgtgggctcttggactgaggttcatggaggcaagcacttcctctggttctctgctaaatccccgccctgggcttcgggcctggcacagaacaggccctgtggcaaatgctggtggaggagatggaagagcttagcactggatatctgagtcagtgcaggcctggtggttggcaccctggagtctgggaccatatagattgtgtgacctttacctcccagagtacacaggatcacaatagcacctgcctctgggttgttgagaggatgagatcaaagaaatcccacaaatagcttggtgtgtagaggaatccagagtgttgaaagctgatctattccacgtcccctggggcccaggctaccagtacctgactttgcccccaggcctgctgctggaaggtgctagaattgcctggatacagctgggccggaggatgggcccaggctgagctggacagttaacccctgctgtcctggcagggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtgagtgggcaagacttgggctgagtgggactgagaggtcagggccatgctgactccagctgatttgacccttatatcaggtcatcatcatcgaacccttttttgactgctacgagcccatgacaatgatggcagggggtcgtcctgtgtttgtgtccctgaagccggtaaggatgctaggtagaggatggatgggcagagggatccaaggcgtgggctgagttggaccctgggagttggaaaaggaggaaagaagtgaaggaagccagttcctctaagctgggagggcagaggggaggtgtgtgtgttgggatcccaggggagagaaggtggggatagatgctggggaagacctgcatgtcaggtggttaagtggtaccaccccgtgccacctgctcttgcagggtcccatccagaatggagaactgggttccagcagcaactggcagctggaccccatggagctggccggcaaattcacatcacgcaccaaagccctggtcctcaacacccccaacaaccccctgggcaaggtactggagggacctccttccctggccccctgcggacctggtcatgtctcctgcactgttactgagttgctgctgtggggcctccgtttcttcgtttgtgtgtgggagggccacacacaatgagcactgaggaccaagactccagaggtcccaggacaggggcaagaatccccagggaaggcctgagggctgggacagtgaactgggctgggagccaccatcacttcccagtgaccctggaatagtgactatgcctctcgaagtatctcatctgtaatgtgggaacctgagggaactgacctcatggtcagtgttgcagggatccaatgtgatggtgcagaacagcccttagcactgggcttggctgtattcgccatttatttatttttttgagacggagtctcgctctgtctcccaggctggagtgcagtggtgtgatcttggctcattgcaacctctgcctcctgggttcaagcaattctcctgcctcagcctcccgagtagctgggattacaggcacccgccaccatgcccagctaatttttgtgtttttagtagagacggggtttctccatgttggccaggctggtcttaaactcctgacctccagtgttccgcccgcctcggcctcccaaagtgctaggattacaggcgtgagccaccgcacctggccgcagctgtgttctttaacctctctgagtaggcctctgtgtttggggacggtcccagctgcaggtctgtgctctccttgggcatctgcaggtgttctccagggaagagctggagctggtggccagcctttgccagcagcatgacgtggtgtgtatcactgatgaagtctaccagtggatggtctacgacgggcaccagcacatcagcattggtgagccaagccagcctggggcccctcccctgcacattggtgggagggccttgaccccacctgagagtcagcacaggcctggtagttagaacccagggttatggagccctgcagatcctgtgacctttgcctcccagagtacacagtgtcacagtagcacctgcctccctggttgtcgaaaggttgaggtcaaagaaatcctatgccgagcatggtgggtcacacctgtaatcccagcactttgggaggctgaggctggcagatcacttgaggtcaggagtttgagaccagcctggccaacatggtgaaaccccgtctgtactaaaagtacaaaaattagctgggcatggtggcacgtgcctgtagtcccagctactcaggaagctgaggtaggaggatcactggaacctgggaggcggaggttgcagtgaggcaagatggcgccattgcattcctgcctgggcaacagagcgagactccatctcaaaaaaaaaaaaacaaagaaagaaatggggggtggagggagggagggagagagagagagagagaaagaaggaaggaaggaaggaaaggaaaggaagaaagaaagaaaaaaaattgtgcaaataacttagtatgtagaggaatccagggtgtcaaaagcctatgcgtgtcccctggggcccagaccaccatcctcccccgtccccctcaccccagtctcagcagctgttctgttcggccttgggcagccagcctccctggcatgtgggaacggaccctgaccatcggcagcgccggcaagaccttcagcgccactggctggaaggtgagttgctgagggtgggaggtcaccaccccctgcaagatccttggcaagtgaggtgggcctgagaatgaagaaggctttagccaggtctggaaggacctctccccctacctgcgcccctgctgcaggtgggctgggtcctgggtccagatcacatcatgaagcacctgcggaccgtgcaccagaactccgtcttccactgccccacgcagagccaggtgaagaggggcaggacgtcacgggggagtggggggacaacaaaagagcccaggctggcccccgcgtcagggaacagctgatctatctgtgtgtccatctgccctgcccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcagtgagtgagacttgccggtctgggcagggcgcaggggctggaggctgcagggggctcagtgtggcctctgtctcccagagaggaagatgcctgacttgcctggagctgtggatgagccctatgacagacgcttcgtcaagtggatgatcaagaacaaggtgggctgggcctctgccaggcagccatgtatggtttcacaggttgtgtgctgctcaagggtgcccaggcaagaggctcctgggctagatcttagtccagcctctgccgtcaaccttggggcagggttgtatccacttcagagaatgaggaggctgtttctttttttctttcttttttttttttggttgagatggagtctcactcttgcccaggctggagtgcagtggcgcgatcttggctcactgcaagctctgccccccaggttcacgccattctcctgcctcagcctcccgagtagctgggaccacaggctacttttttttgcccggctaattttttttgtatttttggtagagacggggtttcaccatgttagccaggttggtcttgatctcctgaccttgtaatccgcctgcctcggcctcccaaagtgctgggattacaggcgtgagccactgctcctggcctttttttttttttttttttttttgagacagagtctcactctgtcgcctaggtgggagtgcagtggcgcaatctcagcacactgcaacctccacctccagggttcaagcgattctcctcccttagcctcctgagtagttgggtaactgggattacaggcatgtacaaccacgcctggctaatttttgtatttttagtagagacggggtttcaccatgttggtcaggctagtctccaactcctgacctcagatgatccactccccttggcctcccaaagtgctgggattacaggcgtgagccaccgtgcctggcctgaggaacctgtttctaacttgcacagagatgctgtgtgggctggcaggatttcctgcctctttggatctccatcttcccatctgtacagtgaggagttggcccattaactcttgagttcatccaggtttgatctgtgactctaaggctttgttcttctctggctctgccctgacctgctccatgatcctccctctgtcagcctccctctgccctctatacccagggagggacttggaatgatgttctgggattcttttcttctgactttgtgtttgtttttgttttggatggattttctctctttcgcccaggctgcggtgaagtggcgcaatctggctcactgcaacctccacccccgggttcaagcaattctcctgcctcagcctcccaagtagctgggattacaggcatgcgccaccacacccggccaatttttgtatttttggtagagacggggtttagccatgttggccaggctggtcttgaactcctgacctcaggtgatccacccgtctcagcctcccaaagtgctgggattataggcgtgagccaccgcacctggccttgttcctctgactttgatgcagctctaggtgctggattggagctaactctccttccccgcctggtcgtgggaacctctctgtcccctccggagccaaggcctgctgggccacgaggccgtgttgagacatgtccttcctcctccccagggcttggtggccatccctgtctccatcttctatagtgtgccacatcagaagcactttgaccactatatccgcttctgttttgtgaaggtaaagggcagggctgggggaggaaagacctcacagagcttcccaaggccggctgggcacatggggagagtgtaggactaatctgtgctggcgcaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttattgacggcttctctctgcttcacactcatgctgatggctgatctaacttgtgaagaatgcccagaagaacctcagacacccccacaactttgtacaaatggttactgtagtcacatagtggcacaaccaggcctagcacccaaggccctcaaatgaattcctcactattaatctttgttgttgttgttgttgttgttgttgttgttgttgttgtttttgaaacagagtctcgctctgtcccccaggctggagtgcagtggcatgatcttggctcattgcaacctccacctcctgggttcaagcaattctcctgcctcagcctcctgagtagctgggactacaggcacctgccaccacgcccggctaatttttgtgtttttgtagagatggggtttcaccatgttggctgggctggactcaaactcctgacctcaggtcatctgctcgcctcggcctcccaaagtgctgggattacagacgtgagccaccatagctggcctctcatattaatctgatggtagcagttattggtgctgggtgtggtggctggggtgggggtgtcatatgtgtttgtgtgtgtgtgtgtgtgtggagaggattggggttcgtgacaaggaagacatggacattcccacaggggtgagagaacagcacagtgggggccaggaggaccagggacttaaataattctcaggaggaggactgaatgttgatcgtgcaagccctacctgcgaggcactcagacgcacatcatcttacacaaccctctgagactgagacctgagttatctccagttcacaagagaggaaagcactctggaggtgaggtgaagtggtgtgcccaggccttctagctggccccgattgagtctcactggatagcaatagtagctcctgaatttctttggaaggtggtgttaggggcctggtcttgaagttgcatttgcatagcaagcgcatgggtttggctcatatcatatgtttaactgggggagctgataggaatatatcatataataaaatacatatttggtgtttgcccctggtccttagtaaagaattcctaaaatccttggagtttctggaagataggcatgtcttgttagtcacatggaatccctctgcactgtacgattacggggtcagaacttttagcccatcgggccccctccatctctgcctccatggaggtgtgagggactagactttgagcccaatcacatggtccatgtctgtttgttattgttgttttggggggatttttgtgtttgttttttcaaatggccaatgtcttaatcagtcatgcctacaaaataaacctgtcaaaaatcacaacaaatttagtataagatctaagttcgagaccaggcacggtggctcacacctgtaatcccggcactttgggaggccgaggcgggtggatcacgaggtcaggagatcgagaccatcctggctaacacggtgaaaccctgtctctactaaaaatataaaaaattagccgggtgcagtggcgggcacctgtagtcccagctactcgggaagctgaggcaggagaatggcatgaacccaggaggcggagcttgcagtgagcggagatcacgccactgcactctagcctgggcgacagagcagagcgagactgtctcaaaaaaaaaaaaatctaagttcgagaccgggcacggtggctgacacctgtaattccagcactttgggaggccgaggcgggtggatcacctgaggtcgggagttcaagaccaacctgaccaacatggagaatcccgtctctactaaaaatacaaaaattagccgggcttggtggcaggcgcctgtaatcccagctacttgggagcttgaggcaggagaattgcttgaacctgggaggcagaggttgcagtgagccgagatcatgccactgcacttcagcctgagcaacagagtgagactagatctcaaaaaataaaaggcattaatggctcaagtctata

SEQ ID NO: 12320 - DNA, 10554 bp, Human
tgattaaataacttgctgaaagtcacataacaagttatgagctattcctggatatgaatataagtttattttattctaaagtctatgtgtttatattgcccacaggttacatgttctacaaggacgggtaccagtctaatttgttctccactggcctatgctatgtgttcaataaatattagttaatttattcgtgcttttgattgctataaagaatttttttttttttagaccaagtcttgctctgttgcccaggctggagtgcagtggcaccatctcggctcactgcaacctctacctcccaggttcaagcgattctcctgcctcagcctcccgagtagctgggattacaggcacgtgccaccatgcccagctaatttttgtattttcagtagagacggggtttcaccatgttggccaggttggtctcaaactcctgacctcaggtaatccacccgcctctgcctcccaaagtgctgggattataggtgtgggccaccgcgcccagcctgccataaagattttatgattttttagccattttttttaaaaattgtgcatatacattcctaattttaggaattaggaataataggaactaaaagccaaaaggagaaactacatttataaactcacacattacagcaaaaagtatttttaaataaaatcacttgttaaaggttataaattgccaatttatattcactaggtaagcttttattttcaaaaggaacaaaggcctcttccccatttgagccccagtttcttaaactgacctgattatgtggctaaggtattattgtgaggtattgatgttttctcctgtttttccttccccttcctccccaccccttttccccctttccagagttttgttctgtggcattgccttgggtaagtacacggcagggcaaatagcagagtgacggcaaatctttcagattttcactttttcaaagtaagagagaccgaactggggccatgagaacagagacatccaactactgtgtaattcataagagtttagaaatgactccttgtgcaccctttttcaggcccttttactaatggacttttctcacttgtgatgatctgggagagtgagagtgaggagagtctaagaagagttcaggctaattattttcccactaatctggcataggagaggctcacagagattaaattcattatggtaaatacaaagagtaatactgctttacactcgggtctgtagactgagattcacactcaccacaattattcctgttaacagtctgccacatacctttcattttaagcaactgaaaaattgtaccaacttttctctttaaatttgctttaaaagcaaattcagaaaattggtagagggtcaagaaattacacagtccaactccattatttgataaattgtataaaaagcaaactaaggcaagaatcaactgacttccaaagttcacgaagagagcactctggaagttgataaaccaccaaaccatataaattccaccacctctttatctgtaattaaaaatcaaaggttgacttttttttttttaactactcactgtatttttagaaagatggggcagaaccactgtagaactcctaaaccccacagaacaaacagtacattctggaatgatacgccggccaatccggctggcagccgattgacctgacccaggcgagggttgctgcaccgagtatttagtttggccccctactgaatgaagacactttgttaaattctccaatgagagacgcttagaggtaggggcgtggaagggggccggggaatttgaggccagataacgggaagtgtgagccgattggccggacttctcactccacggcccagccgtttacggatcgcggaggccatccatcaaaagaattacaccaatcagcggcgaaaatgcccccttctcgcgagaaagccccgccctccaatatattcctcgttagggcaggcgcggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaaggtgagtgggactgcgcgggagttgaccgccaggtgcgggtggggagctgggttgggggcgcggggcgaggagtaggtctggcccgcgcccttttccacactaaactctaccgctgttgtgagcacaagcccaggctagtccgaggctggaggggcggagccggatccggcctcctgaggtgcctttcgtgtctgccgacccagtcccagggactagcctggggaggaagaatggaacccctgcagttagaggttcctcacatgactagctctgaagacctcctgccttcctgtctttagttggtgtgggagggaccttccatgtatccagggcttagcttgtgcccgggacatggttgtgttatgcacacttaaatcaatggaattcccaggttcatctttcagactaggttagcaacaacccaccgcacccccccgccccaatacgtgctcctaatgtcaccttttaagtttcctttcctaacaacaataaaagttaagtaatattgagtattgtgtgccaagcactgtgctatactctttaagtggtgaatcatcttgttcagtcttcacattcagcgacagatattgttaccctcattttataaatctagaaagaagctcaagctcattattattgttcagtgttttttaagcgtctactgtatgtgctaagctctttacgtgatttcattttaactcacaaatctgtgaggtaggtcataaaccttatccctactttatcaatgtggaactaagtacaattaagtaacttgaacagttcattttgttaatatgtggcagaatacttaactaccatctgcttttcactttcggtatcctgtcttacggtgtttattcgtggttatctattgacagtgaataacttgaacaagtatttcttgaagatttgcattttatttttctaaaaagcatggttccgaccgggcgcggtggctcacgcctgtaatcccggcactttggaaggccgaggcgggcagatcacaaggccaggagaccgagaccatcctggccaacatggtgaaaccccgtctctactaaaaatataaaaattagctgggcgcggtggcgcatgcctgtaatcccagctcctcgggaggctgaggcaggagaatcgcttgaaccagggagtcggaggttgcagtgagccaagatcgtgccactgtactccagcctggcaacagagcgagactccttctcaaaaaaaaaaaaaaaaagcatggttccttccctctaggaactcaatttaggatgtgaccaacttgtagaagggaaataaataacagatggcactttgcaatgacttagatgcactagccgcattgggggatgggaggcttataaatcatttcttggcccagtgcaaagatggccaaggaaagcaggaaggactactcttacactccttgctggtctttttttctatatatagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtatgtttgaagctacatttttgtaattttgctcagtgtgttttggagatggaattgttaccttttggctggtattcataaacttgaccttttttttttcagcacgtagccaaaacattaattttgtctactacagcattaatatttcttatcataatcaagagtagtacatcaggtattagacttaaattctgaaatgaaaaatagtctaatatcaagtaacaaattgcagtttcctagtaagaaaattggctgtttttaaaaaacccttcttgataggttggatttgtccatttatttactatttttagatataaacaaatttattagtggcagaaatttattagaggctacattgtggctaagaattaagatatatttgttaatcactacccatatataaaattgtaaatgttttagccttagacctagtcaagacttgcttatgcttggcatttccagcttcagtgtacatgcagtagggaggagagtgtgtctgaaggaggagcaactattttcctatactagataaacaagactgtcactttcagagcttaactgttacaaatgcatctgcctttcctgtacacccatggtcactggaggaaaataagatgatgtgacaattggaaggaaactcatattttagtcctcggtatctaacacagtgcatcataaaaaaggacttcaatatttgttgaagattcaagaaatttgcttcaacagactaattaagctctttagacatttcacatgtagtcattacctttgaatctgtaaatgttgcacaaatgaataatatacagctattcctcaggtataattcagtcttatgtgagaataagatcgttgctcttatgtacaagtcataataagaaaaataactacattatgcctttaaagaggcataagtgtactgctgaagagtttacaagaagagagagagcacagagatattaatactggtaaaagcttagtttcatgtgagctggaagtaaactggataaagttttgactgtgtctcatacggcagacattcagaaaattaaatgataaagattagtagtggatagaactcttagaggcagagtaaacagtatatgccatagtattttaaaactgttttatatgtgttcccacaaagacaagagcctggaaaaaatacaacatcctgcaaagaaatggcttattttgtaaataagccataaagtatttcagtcctcatatatctttgactagttaacttatttgatcaaactagaacaatgtttacttatagttctacagtgattaataaaaacacactttttctatgctgagccaaacattatactgaaactcagtccagttactcaaaaattggttctaagtggggtccatagtgttgacaggctatagtttaggtatgagtggattgtgttaagtccatcacagctgagaaataaacctcaaatatacattttcaaaatgttgggtcggagttctagattatcctttatgttttaattgaaataaggtagagtcatgggcttactggttttgtttttgattttttaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggtaagtgacctttgttttgaacaagagacatttggaaatcagaatggtattgtatggatattgcataaaatcagtatcctcatagaattctaataaaaataagtaaaatgacagctgtggctccttgaactttaatgtccatcataagtgagaaaatgttccattgtcaatagcttcgttaaagctaattcttgggattaaagtacattttgactttatagaacctagtaggaaagcatctaacacaaatttatggaaaaaaaggaccttcagtggatgttgaaatatttattaaaactaaaagaaaataaatcttgtatttgtggcatagtactattcattttaattttttggcccaaatcatctaaaactcccatatggtgcctttagaagttagtatctctgatggaaggggaattcctttcaatagttcatttgctatgttaagtgtgcataagctttactttaaaaattgacttcaatgtttttctaaaaacatcttttgactagatgtagtattacctaataaaagtaataccattttctttttaaaggagaaatagcattaattttgaaagactagaagctcaactgaaggcatgtcattgcaggatcatattttctaaagcaaaggtaaatattttataaagattatgcctattgatatgatctgtttttatatttggcatttactttaaatttatctcttttagccttctgtgttggcattgtctatcattgcattagagatccaagcacagaagtgtgtagagttaacagaaggaatagaatgtcttcagaaacattccaaggtatgtgaaggacatagcctaaatcctattaacagctgtaaaagaaactaaaccccttctatctcctgaagtaaaatgagatgtcatatgtttatttgaaacttaagtagctatcctcaaatgtttttaatgagcaaagacacatgttcataggattgcatttattaatgtagttaaataaggtgggacttacttggagtaataattttttaaaatttatgtatgtacagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggtaaatttggtccgttattattctccagatagagaacattttccaatgccataattttcaactaaagaagagtaattatcttcaaaataaacaaaatggagttggaatagtaaagggggagatgacatcactgatctagtcagctaatatttgaaggcctttactatatacaaggtacaacatcttaggagtaaggaattatccaacctctgatacatacgttagccatttcattaaattttcagcttagagaacagcatcctccttgtagcactaaaatcatgcttttttttaattgcacatgatcttgctgtatgtatctgactgatttaaaattacataagctgagcaggacaacagcaccaaaagtctgaaccaagtatgaactaatttgagactgttagcttataagcaaaatcaatatgaacttggatattgtacttaaaagaaaaaaaagtaggccggatgcagtggctcacgcctgtaatcccagcactttgggaggccaaggcgggcggatcacgaggtcaggagatcgagaccatcctggctaacacgatgaaaccccgtctctgctaaaaaatacaaaaaaatttagccagtcgcggtggcgggcgcctgtagtcccagctactcgggaggctgaggcaggagaatggtgggaacccgggaggcggagtttgcagtgagctgagatcgcgccactacactccagcctgggcgacagagcaagactccgccacaaaaaaaaaaaaaaaaagaaaaaaagtaggatatgatagatggtctctacattgggtatctggaaactgccagagtgtgtcaacactatactaacctatcattgctatagcagctggactactgcaaagtagttatatgcataaaaaatgtaaacttgctttctgcatatgtgatatacattcttgccatataaatttcctaactcagtgatgatttattctactcaaaactaaatgttaacatttaatacatctacatgtgattatgaatattagatatgaacatttcaattttcttagtagtatttaggcagactggcttctgttaagttggattttgtttgttttctttatttaaataggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaatcctttgctgggtggcttttttctcctctgatttaattaactcttttagcaatgtgttaacagaacattataaaaagctatctctactcagtatatttaaatttagtactaaagttagatgcatagtaccagaaacaataaaatccctattaataatatgactattagatgacactttactttgttttttctgaaacattataaaaagctctctctactcagtatatttaaatttagtactaaagttagatgcatagtaccagaaacaataaaatccccattaataatatgactattagctgacactttgttttgttttttctgaaacattataaaaagctctctctacccagtatatttaaatttagtactaaagttagatgcatagtaccagaaacaataaaatccctattaatagtatgactattagctgacactttactttttgttttttctgagacagggtcactcttgtcacccaggctggagtgcagtggcgcgatcttggctcattgcagccttggcagcccaggctcaagagatcctcccaccttagcttccgaaatagctaggattataggcacatgccaccgcacccagctaatttttttttttttttttttttttgtagaggcagtgttgtcactgtgttgcccaggcggatctcaaactcttgggctcaagtgatctgcccacctcgttctcccaaagtgctgagattacaggcataagccaccgtgcctagcctctaatgtttttttaatagacatagaatgatgacaaataattgtttaatgtgtattaaaagttggtgtttatgcattattaatcccttttatcacttagattcatcactgctatggatgctatccttaatatatatttacttttagtttcagcccacttgaagttttgtgccagccttcttacctaattaaacaacacttcagcagcgtggttgctaatgccaggtaaccaccatgtgttatgttagcctgcttggatcaattgtaattattactggaattgaattaattaatatgattttgaacagttcatgttcaaactaacatcctgtaaagtagacactgcaaggagttactgatgaaagaaaagttgttcataaaagaagcctccttttataattgacttgcc

SEQ ID NO: 12321 - DNA, 5159 bp, Human
caggtagtgatatatggctaattaaatgtgccatgtaaacaatatctgaccactaattttaaaaaacagtttgtaaaacattcctggcatcatttaatcttttggggttttcacttgttgtattcagaaggtattttaggaccaaccttaattgtcatgcattcattcaacgaatatttattaacctacctactgtgttgtatccagcactgttttgttttgttgttgtttgtttttttggggacagaatctcactctgttgcctagggtggagtgcaggggcacaatatctgctcactgcaacctccgcctcctgggttcaagcgattcccgtgcctcatactcccaagtagctgggattacagttgtgcgcagcaactctcagctaattttcgtatttttcatagagacagggtttcaccttgttggccaggctggtcttgaactcctgacctcaggtgatcctcccgccttggcctcccaaattactgggattacaggtgtgacccactgcacccagccataaaactctttaacacaaactcttcaaagtgacatcttttgtaaccttcataggttacaaaaggtattgatatattaatagattgagatttgattgcgggggggcggggcagggggagaatgctaaaaaaataagtcagctttcttttctgtaactatttaaaagaatgcaaagtaattctacaggcaattccttggtgggcttatttggtaattttttttttcttttccattttcctcttgctctttggtttgtaggagaaccgctttattcccaggaggcaattttgagtcccaacatgtcctgcatcatctcctgtgcccattgccaaaggaaggcgaccagagcgtgggtttcagcacagctctgattggatgataagcaaggagagtaatgtgctgctaggaggttagagaaaagaaaatactagaatataccagaatgtagtgtttccacttccctccctccaaatcaaaagcctcatgaatgaaattatgaccattattcaagtgcaattatactgagtatgtaaaatggaaacactgaaagtaaatcatacatttggatattacatttcatatttgagaacatgccagaaacattgtattattgttgagtgtaatgtcaggagacaaacttctacgcattttatacataaatttttccattttctctgtttcccatttatgtcaagttgaacacatggtatgacttttaatattctctcttccttctccttccccacattgaatgtcaagtgatcacactcaatcttgattatcctaaatttacccttaggacctgtcaccccattgggtgttgccgccagaacaagagggttttttaattggtataaaaaggagaggccaggcttggtagctcatgcctgtaattctagcactttgggaggctggggcgggaaatcccttgatcccaggagtttcagaccagcctgggcaacatggtgagactctgtctctataaaaaaaaaaatttttttttttaatttagctgggtgtggtggcatgccctgtagtctcagctactatggaggctgaggtgggaggatcacttgatcctggaaggtggaggctgcagtaagctgagtggcaccagtgcactcctgtcaaaagagagagaggagagagagagagagaaagaggaagagtccctaaagaaacctataaaactggggtcttatggatgctagcacatatcttggaaagaactgccagcgccagtggattacagaagacaactgtggctacaggctgttcttgccagctcaggcgtcaactcgtggaaaccggttaatgacccgaggggacagcggattctcgcctaagcaagatcccgcagatgggagggcgtaggaagaggttccccgggccggctccaggccccagcgggcgtgggcgttggcagtgagcgaggggtggtcccgcgccgcgccggcggggggcgcccgaatgagagcgcggggcggtgccgttgggaccacggcggccagagcggcaggatggcttccggcttcaagaagcccagcgctgcctccaccggccaaaagagaaaggtggcacctaagcccgagctcactgaggatcagaagcaagaagttcgggaagcatttgacctcttcgacgtggacggaagtgggaccatcgacgcgaaggagctgaaggtggccatgagagcgctgggcttcgaacccaggaaggaagagatgaagaaaatgatctccgaggtggacagggaaggcacggggaagatcagcttcaatgacttcctggccgtgatgacgcagaagatgtccgagaaggacaccaaagaagaaatcctgaaggccttcaggctctttgatgacgatgagaccgggaagatctcgttcaaaaacctgaagcgtgtggccaacgagctgggggagaacctcacggatgaggagctgcaggagatgatcgacgaagctgatcgggatggggacggcgaagtgaacgaggaggagttccttcggatcatgaagaagaccagcctttactgaagtcggttcagaagctaaagtgactctctgggttgcctgcttccattttgtgaaaccttagaggacagcggctgcctgtcccttcttcaccccctcacccccataatttgtctagatctatttccatatctctagttcaataatagaatttgaaagatgcttgtaatgtgagttttgggttttaattctcaagagtcaacctggagcacatgaggttaaacaaagggccctgaagtttgagtgcgccctccatttgccctgtgctgaacttgcagagacatctgttgatctggaggcaggacagcttctgggacacacaaaaatgtggttccctttgtcacttctttggtggtcttaaattatcttgcttcatatatcattccttaaattccagtcattgttccagcataatgagatggaatctgccagtagatttgcctagcctgtccacttagctgaataccagtttgaaggaaaacagggtggccacttacaaacttacggagctcaggacagataatcttataaagaatagacttgcttgggtggtagtacgttgtgcaattttgactattcactggctttatacctgcaaatgattcttcgttcatgtgtaaattgtccaccatgggtttatctagggctagtatgtatacctgggctacagaataaaaataaaatctaatactggcccaagcaaagtataatttgcttaagaggttacgctaacaaacgattttgagtaaatatttacaaatgtaggatcttagtttaggaaattataacaaataccttaatataacattttaagctacttatagtccttggaaatagcaacaaatatcttagttattggactattataaccttagtcatcttattactgcttgattatgagacactctccctgctaatccttagaacatcttggttcttggtacttgacttttagcccctctgacatatagttgatgtcagagtgtctggcatttcagtagtgctctattttacaaatcccagtaaactgctccactgtggcttgtttatgtgttaatactgcttgttttctgttataaattattttttgctttggagtaagatatcatcattttgcatagctacaaatctgaagttaaagaaaattttaaaaatgtaattgtgggaaaataacaaatagatctgctgagatggaggctttgactaatgttttaataacaggcaacaaaacaaagaggcaggatattttggtcacaactaaacctaaattaaatcctcatacaaagccccattaagataaatgctcaaattctgggaacatttcacttgctttgccagcaattttacccttcagagggtgtggatctaatcaggggaacaaactaccctgggcttaattctcattaacagggactaatttgtcaaagcggcagtactagctgaagtgatgggtatggaagcattcactgtgaggattttgctgaggtgcctggcacagggtaggggaactcacccaggctgcaagatgctaacagttcaggttcaaggtcttagtgtggactaaggtgcagtcaggatgggaacaggtgcaacttgggccaacatcagtatgaagggcctgatctgagggcaggggaaggagggggcattctgggaagcaagagttcctggtatcctgttgaccagagtcttggcccaaggatcaacgtatgaattaaagtagaaataccagaaacaaagaaagttggcagaaactaggagaagcagagtctcagccaactggactgggctcagccttggctactggcccggcagatgatagaagagaaaaccaggaacccaggctgaagcccagtggttgggctggccacacaccatgcatagccttaaaggggtggcctaagggcatggtccgctccaaaaaaggaaagggggccccagaatatttctgaatcccactcactgccagggaagaacctctcaattcactcaatagtgcattctcctgcttctcaataggctaatactctagagaatatggggacaaggggaggagggtctagtggaacaggtctaaactggcgtttgaattttaagataagttaatcatacattggctgggtcagccatgtctcttagtctttacaaaagtagaacacaaaaaaattcaatggaaatctacagacacctatttgcagatgaggaaacacggctatgaagattgggaagattgggaagaactggccaggtgtggtggctcacgcctgtaatcccagcactttgggaggccgaggctggtggatcacttgaggtcaggagttggagaccagcctgggcaacatagtaaaaccctgtctctactcaaattacaaaaatcagcagggcgttgtggtgcccacctgtaatcccagctatgcaggaggctgaggcaggacaatcacttgaacctggtaggcggaggttgcagtgagccaaaatcacgccactgtactccagcctgggtgacagagcaagactttgtttaaaaaaaaaaaaaaaaagggaagaactaaaaatgtaattttcaaggggctatcacaaatggtcccaataaagagaaag

SEQ ID NO: 12322 - DNA, 16672 bp, Human
tctctctctgtcccccaggctggagtgcagtggcacgatctcggctcactgcaacctccatctccagggttcaagtgcttctcctgcctcagcctcccaagtagctggtattacaggcaagtgctaccaagcccggccaatttttgtatttttattagaggtgctgtttcgccacgttgggcaggctggtctcgaactcctgacctcaggtgatctgcctgccttggcattccaaagtgctgagattactggagtgagccaccatgcctggcatgctttgttcttattagggccaatctcccctcagtactaatagtaataactttattgactgcttaccatctgtcatgttctaggtaatgaagatacagttatcagacagggtccctgccctcaacaactcactacctaatgagagatctagacaaacatacacacatactcatagggcaaataaaataatttttaaaatgtaataaaggccatttaaaaaatcacgcctgtaatctcaatactttgggaggtggaggagggaggatcgcttgagctcaggagttcaagagcagcctaggcaacatagcaagaccctgtctctacaaaaagtacaaaaaattagccaggtgtgacggcatgtgtatgtagtctcagctactcgggaggctgaagtgggaggatcacttgagcccagcaggttgaggcttcagtgagctgagatcatgccactgcgctacagcctgggtgaccaagggagaccctctttcagaaaaaagcaaaaacaaagacacaccaaaaaaacactaaactaactgctgacctggagggttttttttttttttgacagagtttcgctcttgtcattccagctagggtgcaatggtgtgatctcggctcactgcaacctctgcctcccaggttcaagcaattctcctgcctcagcttcccgagttgctgggattacaggcacctgccatcacacccagctaatttttatatttttagtagaaatggtttcaccgtgttggccatgctggtctcgaagtcctgaccttaggtgatccacccacctcagcttctcaaagtgctgggattacaagcatgggccatcatgcccccgccaaactagagatttttttttttttttggagtctctctctattgcccaggctggagtgcagtggcgagatctgggctcactgcaacctctgcctccgggcttcaagtgattctcctgcctcagcctcccgagtagctgggactacaggtgcgcaccaccatgcctggctaattttttgtatttttagtagagatggggtttcgccatgctggctaggctggtctcgaactcctaaccaagtgatctgcctgcctcggactcccaaagtgctgggattacaggagtaagccaccgcgccgggccggttcaaatttatgcttttaaactgttgtctcccgagagacacacgcaacgtattttaagcaaaacactggcttggtgttgtggtggctcatgcctgtaatcctggtgatttggaaggctgagggtcgcttgaagctgagttcgagatcaacctaggcaatatatctagacccctgtctctatttttaaaaaaattaaagaaatcactggatgaggaatggaaagacattttctatctccccaggacagttttttaaaatttaaaactactattcccagcatgcccttctcccctgggtggggggaggggacctaagagaactacatttccctgaatgcaacgccttcaccgctggttcttcagcatctcgggaattgtagtcctctgtaaagatgtttgtccacaaatcccagcatgcacttgggatctgactcgtttggtaggaaaaggactggctctgactcttcacccatcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatggtaacgggggagcgctacgccggggactggcggagggggggcccacgcgtaaatagccgaggctggatcgggcgctgacaagtcccttctctgccgcggatggtctgggtcaggcgcgggctctggggattgggaccgatccagggccgggaaggagggcacagggcggtgattctgcgcgcgggggttaccaggggtctcgcggcgacgggcattgggggtggtgttccaaggggaaagggctgtgcaggtgggaaacgttgtagatggttggaagctttgaaacgagaggaaactcgtgagacacagtcttgtgggtagcgagaaggcattggaggtggggagagggcgtccgaaagaggaaggcgctctggaagtgtggcgggagcgctgggacgagaacgcgagaccttggaaaaggggagggaggttttcttgatgggaggagtctctagagacaaggatctgattgcaggtggagaggggatgttgagacaggggcaggagactgcctgtgagagagggatgatctcaagaagagacctggcacaggaaaccaaaaggaggcaactgtagggaatgaaacttaagggtctgggaaagcgctgtaaaaggagagaggacctggaggtaagatggacactcggaaagaatggggagcaactgaataggtctttccaagaggagagatcttgtggggtggggagtaggcttgaaagtgtgagacctggggaggaatctttgttggggcaaagactcaacattggatttaggagtgcccctatcccccaggttggggctttggatctaggaaagggttctttgggctggaagttgggaaagaaaacgaatgagaaagagtgtcagagcgggggcggagtctcctccaggaacagggtccttggaggcaaaatgtgaccttttgaagaagggaggaagcttgggagtgggacaagggatgtcaccagtaaaaagcccattgaggccccaaggaggggaactgagactgagaaagtggaggtcaaaagggaacaactccagaggagggggattggagacagggaaggttggggggcatctagaggggacagcagaggcgtgaggatgcagagattcaggacggaggggacttgagattccaaatgggaagaaaacagggagaggtatacaagggaatttgggagtaagaggcagagctttttgtcaactctgtgggtttgcttctagttctcctaactgtgtgaatatgtctccggctctgctcccaggctgtggctgcctggtgtaggccccccaacgtcccttcctgcctgggacccctgccctgctaggaagtggttttccctggctcagcaggagttcttggaaggagagtgtaacatcctgttccggtccagtttggttggttgggggagggaggatagagtgtgtggagaatgaggcttaggaaagactctcaggctggggcggtgactcatgcctgtaatcccagcactttgggaggctgaggcaggcggatcacataaggtcaggagttcgagaccagcctggccaacgtggtgagaccccgtctctactaaaaatacaaaaataagccaggtgtggtggtggatgcctgtaatcccagctacttgggaggctgaggcaggagaatcgcttgaacccgggaggcagaggctgcagtgagccgagattgtgccactggcctaggcgacagagtgagactctgtctcaaaaaaaaaaaaaaaaaaaggctgggcgcagtgactcgcgcctgtaaccccagcactttgggaggctgaggcaggcagatcacaaggtcaggagttcgagaccagcctgaccaacatggtgaaaccctgtctctactaaaaatacaaaaattagccgggcatggtggcatgcgcctgtaatcccaggtacttaggaggctgaggcaggagaatcgcttgaacctggaggtagaggttgcagtgaaccgagacagtgccactgcactccagcctaggcaacagagtgagactgtctgaaaacaaaaaagaaaagaaaaagacaggactagagggctctctttcctaagagagaaggctcccacaagttggggtcaggtggttcagagcaaagcctttggactcccacctctgctttctggctgtgagacttcctttccctaaatctcagtttcctcatctataaaatgggcatgagcatgcctgtctcagacagaaatgggcccagaacttctaatggagtaagctttggccatggttttctgaacatcacataatggaaaatataatgctgctaagagctggttcttatgtaacacttagtacgtgccagtcactgtactatacctctatgtttttgtttttgtttttttgagacagcgtctcgctctgtcacccaggctggagagcaatggtgcaatgtcagctcactgcaacctctgcctcctgggttcaagtgattctcatgcctcagcctcccgagtagctgggattatagccgcctcccccctgccccccatcacacctggctaatttttgtatttttagtacagatggggtttcaccatgttggccaaactggtctcgaactcctgacctcaagtgatctgcccgccttggcctcccaaagtgctgggattacaggtgtgagccaccgtgaccggccaggaatatcctttactcctcacagtaaactcaggcaccaaagtggcaccaaagttaagtcatgaaagtggcagacgctttggaaaacggtttagcaattcctgagaaagttaaacatagcgttaccctatgagccagcaatctcactcttaggtatatacccaagagaaatgatccatccacacgaaaactcatacacgaatgttcatagcagtattattcataatagccctaaagcagaaacaacccaaatgcccgaagtacggccttatccatccaacagaggatcactcagccacggaaaggaattgcagctctgccgcttgccaccccacagatgagcctggaaaacgtcacgctgagtgaaggaagccagacacgaaagccacagagtgcatgattccactcatatacaatgtccagaacagacacatccacagagacagaaaggagactcgtggctgccaggccctgggggaacggagagtgactgctaatgggtggggagttttttggggggagatgatgaaaatgttctggtattagataataaattagatagtggtgatattaggtggggtgcagtggctcacgcctgatgcagcactttggggggatgaggtgggtggatcgcttgaggccaggagttcgagaccagcctggacaacatggtgaaacactgtctctactaaaaatacaaaaagttagctgggcgtggtggtgtgcacctgcggtcccagctacctgggaggcctgcacccaggaggtggaggttgcagtgaggcgggatcgcgccactgcactctagcctgggcaacagagctagaacctgtctcaaaaaaaaaaaaaaaagtggtgatttttacacaactgtgaatatatactaagtgaatataccaaaaaccatttaactgtctacattttaagtggatggattttatggtgtgtgaattacatttcaattttataaaaagttaggaagcaaagagaaaaaaagaagtggcagagctgagacttagcccaaaggagtctgaacctcaaatgtttattgagtatctaccacctaccagccaccgaactaagtttataaactttttttttaacctttaaaaaaaccctggctgactgggcgtggtggcccatgcctataaccccacactttgggaggcagaggcgggcggatcacctgaggtcagaagtttgagaccagcctggccaacatggtgaaaccccgtctctaccaaaaatacaaacattttccaggcgtggtggcgggtgcctgtagtcccagctactcaggacactgaggcaggagaatcgcttgaacctgggaggcggaggttgcagtgagccgagattgcgccatcgcactccagcctgggtgacagaatgagacactgtctgaaaatttaaaaataacaaaaaatataatgaaaaaaccaccctggtgagatgaatcttcttgggagacttgttttgctggtgaggaaacaggcctagaggggcagacaaagcagggcacagtggctcacacctgtgatcccagcagtttgggaggccgaggtgggagaattgcttgagtccaggagtttgagaccagcaacgtagcaagactctgtctctacaaaaaaaaaaaaaaaaaaaaacagagagagataagaggtggtggaggagcctgggactcggggccctggagctgactccagagttggagacttgtggaagggaagtcactccacaggggtgctggagggacccgggatgaagcgtgtggccaggccggcctggcttgggtctggggagcagccgagacccctggaagtcaggcagcagggaggccctgagccctatctcccctctgggtggatgggtggggccgttgggcagcacccaacccgccctctctgcctctctcacttcctccttctcctcctgctgcccccagatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtgacgcccgctccatgcctcctgcaccccgctgcttcctcgtgccctacttcgccactccctgcccagcttctagttgcaagaaccccttggaccctctatccatcctatatcattcactcaacctgctttgagcttgcttgcttcttcccttcctttacttgtacttttcattgtgaaaaatcataaacatacagattagtacaatgaaagaaaagtagattggagattcgtatacctactacccagatttaatcagtattaatattttgcctttttgttctgcattgttattattaattttttttgcctacgattaaaaaagaatttttttttttggtcaaattttttttgctggtgcgtttttcaaacttcctatagaatgttcaaacacagaaaagtagagagaataggccaggtgcagtggctcatgcctgtaatcccagcactttgggaagccaaggtgggaggattgcttgagcccaggtgttcaagaccagcctgggcaatgtagcaagaccttgtctttattttttatttgattgaattgaattaattaattaattaattaattaattactttttttgagacagagtcttactctgtcacccaggctggagtgcagtggcatgatctcagctcactgcaacctccacctcccaggttcaagcaattctcctgcctcagcctcccaaatagctgggattacaggcgtgcaccacaacaccaggctaattttgtatttttggtagagacgaggtttcaccatgttggccaggctggtctcgaactcctgaccttgtaatccaccctcctcggccttccaaagtgctgggattacaggcatgagccactgcgcctggccttttttgcctttttttttttttttttctgaaatggagtctgtctcagtcacccaggctggagtgcaatgggggcaatcttggctcactgcaacctcctccagggttcaagctattctctgcctcagcctccctaggagctgggattacaggtgctcgccaccacgcctggctaatttttgtatttttagtagagatggggtttcaccatgttggtcagactggtcttgacctcctgatctcaagtgatccacccgccttggcctcccaaagtgctgggattacaggcgtgagccaccatgcctgtccctctttaaaaaattttttttgaaacaggagctcattctgtcacccaggcgggagtgcagtggcacgaacatggctcacagcagccttgacttcctatgttcaagctaccctcccacctcagcctcctgagtagctgggactacaggcttgtgcactaccaagcccagctaatatttgtatttttggtagcgatggggtctcaccatgttgcccaggctggtctcaaactcttgagctcaagtgatctgcctgcttcggcctcccaaagtgctgggattacaggcatgagccactgcgcccagccaggatgcaggtttaaatggtttggttaggatggcattgctgaaaaggtgacattggagccaagacctgaaggacttgacggggaggaaggagccaatgtctgagaggaacatttcaagccaagggaacagcaagtgtaaagtccctggggcaggagaatacttagggcgttccagggatagcaggaatgcagccaggaaggggaggagatgaaagagagaagataacagggtaatctcttggtgcagggctgcagggaagacttgggctcttactatgagtcagatgggagccgtagaaaagttgtttttgccggccgggcgcggtggctcactcctgtaatcccagcactttgggaggccaaggtgggtggatcacaaggtcaggagaccagcctgaccaacatgatgaaatctcgtctctactaaaaatacaaaaattagccgggcctggtcgtgggtgcctgtagtcccagctactcgggaggctgaagcaggagaatcgcttgaatccaggaggcagaggttgcagtgagccgagatcgtgccattgcactccagcctgggcaacagaacaagactcctctcaaaaaaaaaagaaaggttgtttttgttttttggtgttttttagagacacggtcttgctctgtctcccaggctagagtacagtggtgcaattacagctcactgtaccctcccaggctcaagcaagcctcccacctcagcttgccaagtggctgggactacaggcatgcacctccatgcccatctaatttttaaatttttttttcttttcaggtgggttctcactctgttacctaggctagagtgcagtggtgcgatctcagctcactgcaacctctgcctctcggggtcaagcaattctcccacctcagcctcccgagtagctgggaccattggcatgtgccaccaatgccgtactaatttttgtatttttggtagagacagggtttcgccatgttgcccaggctggtctcgaactcctgagctccagcgatccgcccaccgcagcttcccaaagtcctaggattacagccatgagtgaccacgcctggctaatttttaaatttttcgtagagatggggtattgctatgttgtccaggctggtcttgaaccatggagggttttgagcagagcatggccattggccgacttgaggctgcgctatagggcaagagcatagaggagactgctcggagagaggtggctgcagtggtccaggtgggagatgctggtgactggaccagcatggaagccgtcggtgtggccaggagcgttttggaggtggacccagctgaatggccaagaattggatgtggaatgtgagagaaagcagagccagggcgacaattagatttcccacttgagcccccgggtaggatggagctgtcattatctgatatgggcagatgggaagggcaggcggaggtgaagatcaggagggaagtgttgggggtctggccccgagtatcgtccacatcccagcagagatgtccaggaagaagtgacgagtcagggttcttggagagagctgggtaggatatggaaacggcatttctgcacatagagggaaaccgaggccaaggagctcaccggggaagtgaggatagaccgaggagagcaccagagggccacgtctgcaggcagagagatgagggagaggagaaccaagagattgggtgtcccagcagccaggagggggacagggttggacttacctctccaggaggaggtcactggtggtgtcaccaagagcagcaggtgggaagggggagaggaactgggtgtcgggtgttctggctgtgtgggcaccttgctgctaatgtagtggctggtcctgtgctgagggctggggcgcgggaggggtcagtgaggcccaatgatacaggggcagccggaaagtccggctgggcaaatgagaatgttacagaggaggctgaccctcaggtcttgagttcctccatgcctccaggatccaggcccgcccattcattcagttgttcctttgtgcatgtattcacctaatgtttctgtgtgcctcctctgtgatcagcccagtgctaggttcacagcagcactgagacagccttgtgctgctttgggactcatagcccaggaaggaacacaagcctgtcctagacagtgacaaccacagtaggcagggctgggatcgaggagcctggctgggggagggcacctgacccagcctgggggtctggagggcttcctggaggggacttgtgagtgaagatcaaagggaggagtaggcaactggaagatgcgggctatccctcttgttattattattattatttgagacagggtctcactctgtgccccaggccggagtgcagtggtgcaatcatagctcactgcagcctccgcctcccaggctcaagggatcctcccacctcagactcctgagtagctgggactacagggacctgccaccacgcccaactaattttttgtatgttttatagagatgggtcttgatatgttgcctaaactgctcttgaactcctgagatcaagccttggcctcccaaagtgctgggatgataggcatgaggcccggcacctggccgtcgtccaatctctgtctgactcgcactgtcccgcctcccgctttcctttattagcagcccagtgaggacattggtcccgcctgaaccatccaggattatcgccccatctcatgcttcttaacttcgtcacaagttgagactgcagagtccctttttgccatataaggtcccatattcacagggtgtgggattaggatgtggatgtctttgggggccattacctgtgccagccctttgcagggcaacatggaggacacagtgtgacagctccagcttcccccacaggctcagtccaatggggagacagacccatccccagacagtggcgaccagcagtggtcaggctggggcagggcaggggtggggcagtggcgtgggatgttcagaggggacacctgccccagcctgcaggatgagagaatgtgcttctctgagagaatgtagctggaggagagatgggggtctgcagcagatccctgagaagcctcgaaatttaaaacaggaagggaggctggaaagatggagcagtagctggaggcggaggagggtgagagccagaaaagctggattgcaagaagagaggagcactgatgatcagtgtcagctcatttacccgtggattacatgtaggccttactgtaatcacaccagaaaacatactcaggctgggctcacgcctgtaatcccagcactttgggaggcagaggcaggtggatcatctgaggtcaggagttggagaccagcctggccaacatggtaaaacctcatctctactaaaaatacaaaaattagccaggcgtggtggtgcacacctgtattcctagctactcaggaggctgaggcaggagaattgcttgaacctgggaggcagaggttgcagtgagccaagattgcgccgctgcactctggcctgggcgacagagtgagactgtctcaaaaaaaccaaaaaacaaaaaaaaccctgaaaacatgcttggagtatagcaatgaacaagagattgagctgaaaaaatgagtaaaaagctattagctgggtgtggtggcgcgcctgtaatcccagctactcgggagactgaggcaggagaatcgcttgaacccaagaggcagagattgcagtgagccgagatcgagccactgctctccagcctgggcgtcagagccagactcaaaaaaaaaaaaaaaaaaaaaaaatgccgaagactgatgctggcactcatagctgtcagcaggtggcgacacaggcacaccccagacctaaagctgctgtttttttgtgttttttgagacagggtctcccgggctggagtgcagtgatgggaacgtggctcacagcagctttgacctcccaggctcaggtcatctccccacctcagcctcccgagtagctgggaccacaggtacacgccaccatacccagctaagttttgtacttttgtatagatggggtttcaccatgttgcccaagctggcctgaaactcctgggctcaagtgatcctctcgcccggcctcctggagtgctgggattttttttttttttttttttttgtaatgaacctgacattgagaacatatagaactgaactggattttcaggttttggccaaagacattgtactttgcaacccagtatgcatatatatctgtctttgtctacttaacacgcgcataaaatgagaatccatgtccctgatcctggcatgtttgttcacggtgtgtgtctgtgttactattgctaactgtgtatatcgcatttcagtgagggcaggacaaggacccaggatcgtcttggtggcagtggtaaccctcctccccacactgcctatcacaggcctggcatagagtagctgctcaggaagtatttgttaaataattgagttaattaattccaggctaagggatgtgactgtctccagaggtagcaggaagtcacagaagggagtggcaaggttgcatggacactattgaacacgtcaggctcccgcccagccccgggcttttgctatctgcttagaacattcctgcctatcctccagctctcagctccgataccccctcctccaggaagccctcctgactctccaggatcagagggggttaggcaccctctttgggctctcacagcccatcctgtccattctggggatgcctgcccccgctgcactgtgagcagggttagggctgtctcggtcactgctgtgaccccagcacagggccaggcacagagctgggcctcgggaccacgtatggagtgaaggagtgaatgttttggccccactctgtctggcacgttaggtcctggcaagctccgttgctgacagcctctctgttctgcagttccggaactttaagatcatttaccgccgctatgctggcctctacttctgcatctgtgtggatgtcaatgacaacaacctggcttacctggaggccattcacaacttcgtggaggtacggcgggagagggatgtaaggtggggaggcgggtgggcagccctggagtggcccccaaggcctgggaaccctccctggtccctcctgagccctccctctgcagtgactgggactctccctctccatttcttttttttctttttcttttttttttttttttttttttttttttttgagacggagtcttgttctgtcgcccaggctggagtgcagtggtgcaatcttggctcattgcagcctccacctcccaggttcaagtgattctcctgcctcagcctcttgagtagctgggattacaggcacacgccacgatgcccagctaatttttgtatttttagtagagatggggtttcaccatgttggccaggctggtcttgcactcctaacttcaagtcatccttctgccttagcctcccaaagtgctgggattacaggtgtgagccaccgcgcctgaccttttgccatctctttgcatcgaactttgcttttgtttctctctgtgtgtctccttgcctctctccctgtcactgtctctctctctcccctgcctcccccttggtctctttttttgctgtctctttctgatgaccttgttcccatctctgtgcgtgtgtggctctctccctgcccatctcttaccatctctgccttcctctcccaggtcttaaacgaatatttccacaatgtctgtgaactggacctggtgttcaacttctacaaggtaggctcctggtgaagaggaggctgaaggagccagaggagggggacgggggggacccgtggtgcactagccacccggagcctctgctgaggtctgtgtcccagctcgaggggcatcagagccccagcttccagggtccgggccagcatcctggggggcctcgtctcaccccagggtctcccctcacacaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggccttgccgtctttgagcccttgcctgtctcccctgggaaccagatacctaggatgccttgccttcagtccatcagtcagtcagtcaacaaacgcccctcattgtgctgagcaaggtgagacacccaggtgctcttcagacctgctcctgctcaccaagggcccccaggctggaaggggtgatgggtttagattccaggcacttgctactaaaataacaatactcagctaatgctgaagggcactcaccctctcccaggcattgttctaagcaattgacatgtcttaccttacttaaagctcactagattataagtctgggactattttttttttttttgagacatggtctcactctattgcccaggctggagtgcagtggcaggatcatggctcactgccgccttgacctcctgggctcagttgatcctcccacctcagcctcccaagtagctgggactacagatgtgtgccaccatacctggttaatttttttttttttttttgagatggagtttcgctctttttgcccaggctggagtgcaatagcgctagctcggctcactgcaacctctgcctcccagtttcaagtgattctcctgcctcagcctccaaagtagctgagattacaggtgcgtgccaccatgcccagctaagttttttttttttgagatggagtcttgctctgttgcccaggctggagtgatctcctggctcaagtgatcttcctgccttggcctcccagagttctgggattacaggcgtgagccactctatccggccaaggacaggactgttattatccccattttccaagtgagaacattgttccaggaatgtttcaggaacattaaaagacttgaccaggctgggcgcagcggctcacgcctgtaatcccagcactttgggaggctgaggcgggtcaagagattgagaccatcctggccaacatggtgaaaccctgtctctactaaaaatataaaaattagctgggcatggtggcatgcacctgtaatcccagctactcaggaggctgaggcaggagaattgcttgaacccgggaggcagaggttgcagtgagccgagattgtgccactgcattccagcctgggcaacagagcgagactccatctaaaaaaaaaagacgacttgaccaaggtctgtagctagtcagtagccaagccaggtttgttttgagccagttttgaagccaggtgggtagctccagaaccctcatttttatctgctcgccccggtggttgttggaaatgtaggcactgggcttgatgatttgtgtttcttggcaacagcactgctggcatttgggccaggacaatccctcattgtgaggctgctccagaagtggatggacttttgacttccacccaccaagtgccagaagtggccttctggccattgtgatgatagaagccacccctgagtgtttctagggccctctgaagttaaggggcccccgatgcccactgagagcagagtgtgggggctgctggccacacctatgcctggcatccttcgcaagctgagaacaccctggcccctgtcagtttctttccttccttccttcctttctttttgacagggtcttattctgtcactccccaggctggagtgcaatggcacaatcttggctcactgccacctctacctcccaggctcaagtgattctcctgcctcagcctcccgagtaactgggactacaggcgcctgccaccatgcccggctaatttttgtatttttagtagagacggggtttcaccatgttggccaggctggtctcgaactcctgagctcaaatggtccgcccgcctcagcctccaaattgctgggattgcaagcctgaaccatggtgctcagcctctttttataaatataaactagcatgttagttttttattgctgctgtaacaaattatcacaaacttagcggcttaaaacaacacaattttattctcaatgaaatctgaaatgggtttcagtgggct

SEQ ID NO: 12323 - DNA, 20059 bp, Human
tctcttaaatgtttcaaaacaaaataattaagatgaatctcagtaaacaaccatgaaattcagtgaggtatttcctttattttttaatggttacagactcagggtctgtcatggaaatagctgcatagttttgactctgccaaatcactcactgaaattacatcacaggagggctgccagtgccctgtgggggctctgaatagcatctacccctttggccatttgggacctgcctgctgagctgtgaagtggcaggttttttccagcgtacagactcttcctaattatatagcatcatgacaatttgtccagcctaattaggggaggttatccaaccctgattgaggacactcaataaacaataatggaaaagacagctttaattgtcctgaggcttgaaatttctcccatggaaaatatcaggggcagtggctagattactggatttctaagaaaagggtaattctctataccagggaagggagtaaatcttgaaagcagccatgaaaataaacatcaaaaacctcccagccctcaaatgttatttggtctctttccctccagaagacattcaggtagtaaagggaatgaaatcaacactccttagttgcctgatacaaatactaagtcattccaatcaggaagatagttgtaattaagactactacactagttgacttccaggtgatggtggtgtatttgtttctcagtataaaatggcatgggaatacttttcaacaataaaaagaaaggaagtactgttctataatgcctcatggatgaacctcaaaaacattctgtgcagtgaaggaagccgcacaatgtataatcccatctataagaaacgaccactaagaaaaatctatagagacaggaaataggttagtgattgcctaggactaggagtgggagaagagactgactgacaatggcgaggagatcattttggggaggatgaacctgttctgaaattggcttgtggtgatggttgtacagctctgaaaatttactaaacatcattgaactgtacactcaaaacggatggattttatggcatgtaaattgtaactaaataaggctatttgaaaaagtttatattgtaccagaaaggttagcgtctgggcctgggtctggttcttccgctgccatgcaggtcgcctgtcactaacactcctcaagaattctgctccttctccatttccatttgtaaaacgttagcaggatggtgcggggagaaggagaacacattatcaaatctgagattctgtgcagtcacaagacaccaagtctgggaatttcgaaaggcaatcaggcataaattcttcctgaggtgagaaagaagcaaaggtaccggctgctggggtcagggccgtctcacacgcgtggctctaggcaggagcacaaatggaaccactggggaaagtaggactccagcagaaacgaaggcgcaaggccgaatccctaaggtccaacgagctagcagtcagttgacagggtttctaacaaaaacgcggcatgcgtttaccaaacctagggtggttttatttcagaagtaggaactctttccacgagagcaccaagttgagaagttcggttctcaggccgcgtggacctgacagctctcagaagctccaggcctcgctgggtggggcgggtagcggccgccgctgcctcagcagccctggtcccggcagagcagggctggcgaggccgctgctgccgccgtcggggccgccggccctccacactcgttgagacgccggcacggggaccttcgtgcccctctagggactggcgccgcgtccaggtggccgagcctgcgctgctggaggaggcgcctccgcgccggcctcaccccggggccggcagggggcgaaggcggagctggaagtcgccgccgggccccgggggaccggctcccgcgcttcctcccgcgccccccgcacagtgctcatgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgggtgcgcgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgcaggggctgagcaccagcgggtacaagcgggactcagatccagccccttgggcttcagcccgaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagcactaggaagaaggcctcctccaggcccacccacagccccagaccccgggcccgctgagcgccggcagcaggaggtcgaggaaggaggactccttgagcctcaccgaggagcgcaccagtcctgggctctgctgcgtttgggggtggaggagaagccgcccagacccgacttcaggttgccgtagccgagagagagggaggcgaacgtcgctgtcccaccttgtttgactcgctagctatgtttctaggtgtaacccctataatcagaagcactcgcggtctcactctacacgctagagagtttaaaaagtttgtaccacgtgtagaggtccgggtatgggtgtgtggtttggtgtattttccagtgtaaaaggcaacgctttcctaagagctaccgtttgttttccttgaaagtaggaatgagggttaagtatccctcatggctgtatttctcccgctctacttaacaaaagtcagtgttcgcaactaaaggcggtcggtcttggcaccggattccgatgccgcccccatctcagcggaaaatgggaggaaggattaaggctgtttgatgataggtatgaggctgtttaggggtaaggattttaacctctcagctctctagactgcttcagagctaagaaatgggcattgcgcctgcatccttccttctcttccatggaatgtaaggtacctgtcaccacaaagggcacagaggagggtgcttgtcacaggcaaggtactcagttggacagtatggccagaaagtattcctctgccttggaaaaaaaaggtttttaaaattaatatatgttttaaaaaggtttggataactacaacttcccatgtttgaaaaatagcatttaataacattaatctcaatttagtatcgacagtaaattcacaaattaacatgttgtattatgttatcttgttacttgttgccaagagcttgtctcttcctagcatcatttatagtaaaaactgattctttgttaggttgacagtgtaaaacttgagaatattaacagtgctttctaaaaatgcatccgctgcttgataaatctcactggacagatctggagcagaaataatcaggttcaattaagataaaaatgctgtattctgaagggattcacttttctgttttctgtccttcgggagttgtagaatgttgtttgggcaaattaaccccacggctttaattttctcatctataaaatgaacaatcaagttagataactttctgtgaatctaagcatctttttgttggcttccttaatgtgtgagtttaaggatctgcatttgtaggctaactaggataaatggtcctatgaaggaaaggatggctttgatttgtgcacatgtctatgaaaatgttccacaaaggctcaatccagatttactatctttacctcaagcaactgtgtacatagcgtcatcaaagttgagatttaaaaatttttttttttcttctggagacaagatcttattctgtaacccaggatggagtgcagtgatgcaatcatagctcattgcaagcttgaactcccgggctcaagcaatcctcccacctcagcctctccagtggcggagagtacaggcatgcaccaccacgtgtggccatttaaaaaaaattttttttttttagaagagatgaggtcttgctatgttgtccagactggtcttgacctcctggactcaagcaaatcctcttgtcttggcctgctaaagtgctgggattataggcatgagtcaccacgcccagccaagattttttatatttctataattaatattaaatgacttttattttctagttcagatatagttccaattatgtatttccaacctggttaagaactgagaagccaggcacagtggcacacctgtaatcccagctactagggagttggaggtggatcacttgagctcgggaatttgagcctagcttgggcaacttggcgagtccccatttcaaaaacaaaaacgaaataaaaacccagaactttcacattagagttttatagtggctggggactatattaaattggaaaacaaccttgtggcttgccaaaatctggaatggtatggaagggtatataagtcaatagtcataactagaagtgtagaaattagggaagtaaaacttaaatctcacactgtagtctccccaccactatgccccaagaagtcctaagaatgcttacaatattatctcctttttcttcagctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggtaagcccaaacacaccagggtgggagagaaatgcagacgtgattatttcctttcctgctttacccatctggatccctttcctccctgcattctttcttttgttgccattgtggccacagaaaatggatatattttcacggttctcctggatatacttgaaacaccaaatacacatggaaagctttctgacaaaaggcaaatagcattacctcttgatggctagattgctatgattccaaaacattcctaatcatgtgatatattactgagttattactatgtgccacctattgttttaacttccaccacaactctacaaggtaggtagaattttactccagttacagatgaagaaactgaactcagagagttgtcaagtatcttgcccaaggtgactattgttagcaagtgccatgctatcctgtagtagaatagccagtataatacttctaaaaaaattcagtccaaaggcatgtagctaaagtgagtatcttaggaaaattgtttggtgctctgaatttctaagttgtgggtaatgggatattacaaatgtgttcttatcaacacttaagaagttcaacagcacaaaaccatttttttccaggcaaattttgttcttgtgtaagcaagtttttaaaaggctagcagcagctgggagtggtggctcacacctgtaatcccaccactttgggaggctgaggcggatggaccacttgaggtcaggagttcgagacctagccaacatggtgaaaccctgtctctactaaaaatacaaaaattagccaggtatggtggtgcatgcctgtaatcccagctacttgggaggctgaggcaggagaatcacttgaatcctggaggtggaggttgcagtgagccgagatcgcgccactgcactccatcctgggctacagagcgagacgccatcaaataaataaataaataaagcagaatctttagatgacttccctgatgagctattttcttgattaatcaaagcaatagatacaacatggcactataagtcagtgggatgccctgaaaaagtgtggatagcatctcagctgctattcttgtgttacaggggagtaatcagcaactcagggggacctgtacgagtctatagcctacctggtcgagaaaactattcctcagtagatgccaatggcatccagtctcaaatgctttctagatggtctgcttctttcacagtaactagtaggtataattattgttctcattctgtaatattctcccaccccccaaacgttttctgctttttttagctcagcctctttaaccttgatggaaaaacctgtgatcaagactaaagctgacctatagaggtaaactgtaggttagactgaggggtcaagtacccactgaagccaaatttgggtgaatagaagacaatcttactgacagatgatggcaatagaaacttgaattatttgcagtcagaatgcccggacacttaccaaggaactgaaaaactactaaatacatttttgatgatcctttgaagatataatggataagcattttggttctctgaaactagcatgcagcaggatgtttgtaactacaatcaccattaccctattacatttgtcattgtagagagctctaaattagattcataatactttggtaaagaaggaaaaggaaaaaaataagcttatttttattttaacagaaggcaaaagtagtacacaggaggccacaggacaagcagtgtccacagcacatccaccaacaggtatgaactatgaaacctatctcctagttgcccggcacagcatttggaagttatgaataaacgtgttgttggtagaagcttttcttaaagaaatttgatattaaagagaaacaaagcaaataccttaagtttactggtatattacatatggaaacattcattatgtgtatattttaaagacagggtctcactctgttgctcaggctggagtacagtggtgcaatcatagctcactgcagccttaaactcctaggctcaagcaatcttctcaccttggcctcctgagtaggtggtactacaggcacatgccaccacacccagccaatttttttgatttttaattttttttatttttatttttttagacaggtctagctatgatgcccaggctggttttgaactcctgacctcaggcagtcctcccacttcagcctcccaaagttcagggattacaggcatgagccactgcacccagcctaataattctctaaaagtcctattttctcccagatttgataaaccacgcctaagaactggtcaaagtaccatgaacttctagttccatttgcttcattaaattcctttaattactgcactgtcatgtgactaaaaggaatgtgtgtctattgtaagaaatagccagggatccccttttgtatgacgatggcagttttaaagtcaaagatattaagaacattaggatttaatgttgagttcctgcctcacctgtgggtttggggtattaaagtcctggattagggcatatcaaatatgtaggcctacatactgatttgtttatttgttgggtcattgctttccctagtccagaaaatcctgaggaaattaatttttttaaaaaagtcctttcaagaatggcactctgttgttatgagcttctccccatgtgggtttcttgctatgtaactgtcttccttttgttaatgccaagtgcatcttttatttcaggtaaacgactaaagaaaacacccgagaagaaaactggcaataaaggtaagaatcaagatctccatttgggaaggtagcattttccctccctcctcttgagactgctaatgaggggactggtttggttgttcgcagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccaggtaccaaccttgttaaaatgggagatttaaaaaaaaaattattttgtaattgacacataataattatatatacttatggggtacatagtgatgttttcatacatacaatgtatagtggtcaaatcagagtaattagcatatccatcacctcaaacattgatcatttctttgtgttggatacattcaaaatcaaatgaggccgggtgcagtggctcacgcctgtaattccagcactttggaggccaagtgggtgtgtggatcacctgaggtcaggagttcaaaaccagtctggccaacatgtgaaacaccgtctctactaaaaatacaaaaattagccagatgtggtggcatgcacctgtaatcctagctacttgggaggctgaggcaggagaatcacttggactcgggaggcagaggttacaatgagccgagattgcaccactgcactccagcctgggcaacagtgagactatgtctcaaaaaaaaaaaaaaaaaagaaaaaaatcaaatgagaggagatttgaatgagtcttgaatgatgacaaatgatcagttcttttagtgggtacatgtcagttcagtataaacatttgagttatggacacactgggttcccaaactgtaagttcaggatctaagactgcctgggcagactgagtagatctgagtgcctcctttttggaataaaagaatttagaaaactgtgtgctatctatataagaaccagaaggtagactggagagtcctgttgcttacacaagtcacctctgcttatctactctgctcaattcctaatttctctcttctgaaggaagaagcagtgatatgtctattccacctccctattctgttattctttttagctctttccatattctcttggttggtgatctgaagcacgacctttctattttattcatttaaaaatatttattaattgctggccaggtgcggtggctcacgcctgtaatcccagcactttgggaggccgaggcggatggatcacggggtcaggagattgagaccatcctggctaacacggggaaaccccgtctctactaaaaatacaaaaaaaaaaaattagccgggcgtggtggcaggcgcctgtagtcccagctactcgggaggctgaggcaggagaatggcgtgaacccaggaggtggagcttgcagtgagccaagatcgtgccactgcactccagcctgggcaacagagcaagactctgtttcaaaaaataaaaataaaaataaataaataaataaatatttatttattaattgcttttagaaatagaatatgctcattatagaaagcttgaaaatacatagagcacaaaaaaagaaatgctctaaatcatatgccctagagataatcactataaaatggtttttttttttttttttttttttttttgagacggagttttgctctgtcaccgaggctggaatgcaatggcacgatctttgttcactacaacctctgcctcctggatttaagtgattctcctgcctcagcctcctgagtagctgggatcacaggtgtgcactactacgcctggctaatttttgtatttttagtagagacaaggtttcaccatgttggccagcctggtctcgagctcctgacctcaggtgatccacctgcctcggactcccaaagtgctaggattacaggtgtgagctaccacgcctggccccttcagtattttaaggaaatatttgactgtattatttttaaaaaactcagactattaaaaatgccctgcatcctgtttttttcatcctttagtatttttagcattttctcatatcacaaatattcatcaaaaatatttcataatattccgctgcatgattagtcattcttattatttcttcactacattacacactacactgtgatgaacatccttatatcatctttgtgcccatctctgattatttcatcaggttagatttctaaaagtgaggttctgacttaaagcctctgatataaatagtgaaattgagccatgcacagtggctcatgcctgtagtgccagctgctcaggaggctgaggtgtgaggatctctcaagcccaggagttcaaagctgcagtgagctatgatggcaccactctactccagcctggacaacagagaaagaccccatctctaaaaaaacaaataaatagcgaaattgcttcctagaaaggtgaagtagtttaaactactatcagcagtgtgtaaggttgtataaacagtgctattacaaatattaatttccatttcatttctgttattttttacaagtggctctgctcttagattagatagaatttttttggcatgagaagaaaatttaactgttttaacataatttaaccatttgtctctcacccttaaaaaaaatgtgttccttgtttcattgacttatggtatcacatttatacctgagtttgagcaagtctatttctttgattcatatgctaatccttacatatttttttctacgctgctttgattatcacagttttattgcacattttaacatcccatgaggcaaattcccctgcagtactttttgtcttgtacttttttctgactactttgacccaattctttttgaagatgaattcttcattaccttgtagactcatacaaagttttgtagtttttctgttttagaaagaccattagaataggtaaaccatgtcaagtttatatgtatgtaagtcaaagaacagaatatatcaaggatacaaaaatgagactaatttcataagtcataatctggatagttgaaaagtgaccacaagtgaaaaggttttcaacccatgaaatctgattttatgacccaatattccatcaggtatgtatgcagaaatacagtcagtgttctacttctccctcaaaaaatcttgaataaaatggctactgataatgctaagatcttaaattttgcactaggaaatactgactcatctagaaactaaacacaacagattgtgctgtggttgtttatactcaaaacggtctctgctgaacacagagtagttatataaaagtgagctgaaattcctttaatattaaatataggaaatgagatctcaaaactcttacaatacacataattttaaggtgcacaaatgtcattgtcattataagaaaaactcaatattgtaactttataattcatttcacctttgtccctttaaaaaaatgttgacggtcacatcaatgaaattgtttctcctgaacagagagctctgagttaatagatccacactacttagagcctctggggtcccacactggaacagaccctagtctcatacccagccacttcctcatttagtttagctacctggtgcccaactctgcggacttctgttaaacccgaggctctgagccaagcccgatttcaagttctccgtatagtttaggcatggactttgcagccagacaacttgaacttaaaatgcagctgtgtttcatcaggcaaactccctaaatgctctgagactcagtttcttcatttacataattgggataattccaaccttatagagctatgatgaaatgaggttttacatgtgttatgcttttggcttattacccagaatataataaatcctcaatatggcaattatttgttacacctctgaaatatctccaataattcaagtaaggatgcaatgcctcagttgactatgtactatggaattaagaaagaaacttgtgtgttgtctggttttaaaactgttttttaaggcatgtaatgttgcttattttacctttttaattctccctgaataacattttctttcttccactcagtgaacatcccaaaatagaattttacttgaaaaactttacatcagccaaagatgttttgtttgccataaaggaagtaggtttcagagggggtaattccaatacaggtaagtagactttgatacctgggatgtaacataggagagggttatcagtgatcagacatgtaaaacagtattatgctattttatatgagcagatgtgaaatcctcctggaactgaaatcttggctaggtctgcatttgatcatctgagataaattttcaatttataatggaagtataccaaagtgttgatatttcttattttaaaaaatataaagcatggtgatttagaattctcatacattggattgactagatataacattggagaagtatctctttgtaatgctaaaaagaagtgaaaatcaacagacttatctaatgaatgcagatgtggcagaaagaatgagtagcactaccgttgactctgaagagagacttcttagaggtactaatcagtcaccaaagggctacatagagagcacatgcatggaagtgggaatcagttttgtgtttctaactggcgattgatgtggggtaaacaaatgtgaggcttctaggaggtggagggggatctaatatggcttgtgaagataaataggcctggtagataattaaactttcccagctgatgcatctgttacagaactgggttctatataattcttttttgtgtgccccgccccactgccagttctatatataattcttaaactttgcagcatcaaatgctacagggaaacagaaatgtggtttgagcagtggtaaaggctatttgtttgcttctttttcaaatttaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggtaaagtggtgagggttatcttctgttacagtgatgggtattccattttggacctctaagtgcagtgctgactgcctcttatctagattaacttgaaacattcaggattttccagtttttaagaagaaacaacttttgatccttttggatatcttttatgtgtctcccccattaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggtaaggtccttgttctttataggagaagggaacagaaaaaacggttcagtgaatttaggagtaaataaaaatttaagcatttatttcattaaacaaacacctgtggctttacccaatattaactgttaaagcagccctactcatctcattctacagataaggaagcaaacttcctggaaatgacatttctagtaagtggcaaggccaagatccaaacccaggcattctggctccagagtgcacattcctaaccactgtattgttgggagaattgccatgagaaccatgtcacattaaggaaatatgcttatacatatacaattaaggtgctcatatttagctcaaacttggactatatctccaaatagccagcttataacctaccatgaatctgccattcagtaatttatcctaactttcttgtgtatgaaacaggtaattgctctgtcaccaggctggagtgcagtggcatgtagtgagctacaacctccaactattgggctcaagcaatcctcctgtgtcagccttccaaatagctaggacgacaggcacatgccactgcccctggctaatttttaaattttttttgggagagacgggggtctcactttgttgcccaggctgatctcaaactcctgggctcaagcgatcctcacaccttggcctcccaaagtgctgggattacaggcataagccaccacacccaaccctaacttttattttagtcaagttttgtctggcatgagtttcctaagataaggtctcccatagactttacctatcccatcaaaatttccttggccaggtgcagtggctcacatctgtaattcagcactttgggaggctgaggtgggcgggatcacctgaggtcaggagttcaagaccagccgggccaacatggtaaaacccagtctctattaaaaatacaaaaattagctgggtgtggtaacatacacctgtaatcccagctactcaggaggctgaggcacgagaatcacttgaacccaggaggcagaggttgcaatgaactgagatcgtgccattgtactccagcctgggcgacagagtgagactctgtctcaaaaagaaaaaaaaaaaaaacaaaaaactttttcccccccgcttaagataataaaaacacactctggtgttataaaagggtataagaagggtttctttcttcctcaccccagccttaatattacttttggcacaggcctcgttcctgaagacattaacgtaatgtgttagagatcaaataggccaacaaaaagctaagattccctttctgaggatataactgagtgacaggagggaagaatcaatggacttgttttttttaacactcttctgtacctcattttccctacttaattcctaatgacataacctttttcctttctacacattagtacctctgccaatgtactcacatatttttacagatactgatgaaagattattcttaaaacagagaacacatgcaatttaagttccacatctagcttgtaaaaagtattttttatacatcagcaactagcctgtgaagtaaagacctgtttactatcatattccttaatacttagcttactgaacttatagttaacaggattgtattcaggctataaagtgattaggttgattaaagttcaggaggctggactacaccaatattgattcgtgaaaattatcccttagtgatattgaaagttgcaaaagccagaaaatagggtaggattttaggggtagatcacaacagtttttatttattttcagggtcttgctctgtcacccaggctggagtacagtggtgtgattatttttttttttaactgtaattatatgctgggcttgagctaaacaatctgaactagaatgtagaactgaaaagaagtgaggaaaactgagggggaggaaaaaaatattttgactttttttttttttaaccagggagtgagagtcaggaaaaggagactggaacaattggacattgttccaagtagcttttacatcatctaaacctgctgcatatcttaggtatttaccactctgagcactgtataccactagaaggggaatgaaaccttagatctgtagaggaaaactattacagaaactccaaaagttatagaaaattgcacccagcattagatagatggtactctacactaagaatctgctaaatgaggccaggtgtggtggcttatgcctgttaatcccagcactttgggaggccgaggcagatggatcgcttgagccctggagttcgagatgagaccagcctgaacaacatggtgaaaccccatctctacaaagaaatttaaaaattagctgggcttagtggcatgcgcttgtagtcccagctacttgaggatgggggtgctgaggaggatagtttgagcccaggaagttgaggctgcagtgagccttgattgtaccactgcactccagcatgggcaaaagagccagaccctgtctgagaaaaaaaaaaaaaaaagattaaatgaaaacttctacaattgggattggggtgaatccaactaatgtattattaccctaaatgtacagttgtactaaaagccttctagtaactaaagtgaatggaaatagaatacctcaatgaaactggaagaaattactccagtttcataagatccctcttgggcagtactttttagtcactagttttgctttgggattataggctgacattttctgattattagacagtttgccaatataaagattgaaatggaagaggatttttcattatcagaggactagtcaccattcctcaaacaatgcaacctttgaacacttttgctatttacttatcccatctcttgtgccattcttccttgctttaatggattgtgactctgactccagtatactgtttgatgcaggccaacctcatacggaaaattttcaccatccgcatttactgtaggattttaaaaaagatactgtggatcaggttaaaagtcttcttctattcctagtttataggtgtgttctgtcattaatggatattgaactttatcaaattatttcttatcagtgatgacttacctgttactgtggtgaattacagatatagcagagtttctggtttggaccactcttttgccactctcgtcacaatgactgtgaaaacttaatttgttcaggggatttaattgtccagaaattagtaagcagttttcgctgcaactatgtaacagtgtatggaaaacatatagacataattccatatattagctagacctgattttcaattcactttaaaatgttttcattgtaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgtaagctggcttacttttattactgctagtgtctcccctgaggatatggtaaaaattcatgtggaaagaccaatctgaattgttttttaaatcatgtaataataccaagaatattttttctttgattcaattatttattgaggccaagcacagtggctcatgcctgtaatcccagcactttgggaggctgaagcaggaggactgcttgaggccaagaattcaagaccagcctgggcaacatagtgagaaccccctctacaaaaaagaaaaaaaaattagccgggtgggatggtgcatgtctgtagtctgagctacttgggaggctgaggtgggaggactgcttgagccgaggaggtcaaggctacagtgagccatgatcacaccactgcactccagcttgggtgacagagcaagaccctatctccaaaataaaaaaaaaaataaaaagacacaagtttattgaatacctactgtcctaggcattatacacagccactacctgattaaacagtataagatatttttgagtacttgcttcaccagaaatgttttgtaattgacatcattttttacttaaaaatgcttgtgaagttggttcctatgaaaggagaacatcaggactcccttaatgtgacttagatgattcgcttaccaaggcctctcccaaaagacagaggtgctctatcatcccaccttgtctgtcttttctaaagataggtcctatctcctcctctcatccacctaagccccctgaaatgtgttaactggttagaataatatactccagtaaatcttctgagtcttacaattttataccctgcataagaggaataaaaggactacatgcagggagaaacaaactggaattgactttttcactacataaaaatttgaatttgaaaatagagtttgagaagacaacctccccttttataaaatgcttcaaacatgactgaatcatgtaacagggataattttaattaaacatcataaaaactgggtttagcatagtatgatttttccccagtaagtagaccaaaaactctcagctaggagtacaaccccttggaaaattaagctctaatgaaaacccagctaccactcattagcccttttaagaaagtggttttttctttaattttataaaggaccaagttttgagtcacctgaagtaaccagggaatagcagcaagacagcagaaatcagaactgtaggttactatcaataattatgtaagtaaacataatcaggataaaggttatttacaggagacagagtaaaaaggaaatacgtattacaatccaacttaagcaaacatgcttagatttcaaatatgctggcccatttataacttaatgcattaaatgcaatgttagtcttcaacaggtaagttacctagtttgaaataatgagaaaaacaacatgaaatgagaggcagaatatgattaactattgaagaaatcaacatattaagatttgtataaagtactatttaatagtgaaattaatctaatttcccatgtgtcaaatggaagcacacataatgaaaataagacattatttttgcatacctttagtctcttccaaatgtttaatactgcagagaaaaatacaaccaaaggagatagaacaaaataaacatatatactaatttttatccatttcagttttaatacattccaaaatacgtcaatgtttatgcattccaataatcatcacatttcagatcaatgataatgtactgggttggaataggtgctagaaacaattctagctttggaaaagcttattctttatttcaaaaaagaagaaacagaagaggagaaaagtaccccctttaatttgtcctttagttgaatgttcagttcagaaaaacaaaaaaaatggtatttaaaaaaaacttgctgggcacggtggctcacgcctgtaatcccagccagcactttgggaggccgaggcgggtggatcacctgaggtgactcaggagtttgagacctgcct

SEQ ID NO: 12324 - DNA, 47818 bp, Human
  misc_feature (1)...(47818): n = A,T,C or G
tgaaagaaaacaaggtgttttaccatatgcatttttaaatttagcgtagtggatactttgttttaaaaatacataatttgtagaattactgcccagtttgtgtttgaaacataaatcctggggtggacggcattaaattgaaaaaaaacgtgggcatacagtatattttaatttttcatactgaatcgtacatttgcactgtgccttatttctaccgtgttcttcctactgttggacatataaaaagattttccttggaactgtgacttgattagatgctgcagtatgctggatccgggtcggtggaccgcagagcgctcgagatgcggagaagcaaagctggccgctagtgggcgctgtggctccgtggaagtcacggacgagcgtcagcaccggcgctcgaccgggaaagtagcgaggagttcctgccagctctgctctggggtcttgcagacgccgagtgagaagcacatgccttgacttttccatctcacaccctctaaatctctggtcactttgggaagcgcgcgtgtctcctagaggctagtgagacggtccccgcgtcgtgcctgtgccggcgacacgcggggaaagctccaggggcgccaccttcccggggggccaggagggaagggagacgcccgcagagaaggcgggaggcgacgatgctcaggccctgattagagctgcaaattccggcgccgcgtcgcaggaatcgtcttgcaattcccggccccactgactgaaactgagccgtaggcgattggtaccaaaatcaagtgagaagccctcgccgagaggcgtcgggagaagcgcgcagaagccgggagctctaagggtgcgcgcggagtgcaagtcttgcacgcggggcagcgccgcatctgcggagaagggacgccgagcggagcctgctgccttccgcactgctcgagggaaagccgcgccctctgattccgccgagggggaaggcgcccccgggcgcggagacaggtggcccgctactcggccgtcgctgtttccacgtctgcaccgcgcccagaaggcctctcgccgccccgggggcgccctgtgcacgcgctgagcgcttctcctgcccggcttctgctccgctcccgccgcccgcgggagccaggggcggggctcacctgtcagcccgagccccgcctcgcggcacccaatgtcgggaggggatggcggacggacggaccggccgtccaaccagcgcgcggccgcggagccgcgggccaatgggcttcgcgcggcggggcggggccccgcgtttatagcgctctgacagcgcggcggccgcgctgactctcctcggcggggaccgcggcgccggccggagcgaggagctgcgcacgcagcgggtcccggcgccctccccgcacacaaaggcccgcgcgcgtccggagcccgcggcggggaccgagctccctctttcctgccctgggggccgggagccgcgcggactgagaaggctcctgcgcgcccggaggcgccctactccgctccgtgctccgggacatggaaccgcgccgacgcggcgcccgcgcgctcgggccgctgcccgctgcactggatctatagtcacaggcggccccgctcggggcgcagcgcccgccgcccgcgccggtcgtctccgctccgggtctttgtgtcccagcccgcacccgccccgcgcccacccgccagccgcggccggcccggcaccctggagccgcacgggagtcggccgtccgagctgcgtccggcgcggcgccccggaaccccgagtccgccgcgccgccgcgccccgcgcgtgcgctcccgccccgcgccctgagggccccggagagcgagcgcacctggcccggcgaccgctggagctgcgcagcgcgcctcggagctgcctgcgggcgcacgccgtcttccccgccagtctgccccggaggattgggggtcccagcctgcgtcccgtcagtcccttcttggcccggagtgcgcggagctgggagtggcttcgccatggctgtgagaagggactccgtgtggaagtactgctggggtgttttgatggttttatgcagaactgcgatttccaaatcgatagttttagagcctatctattggaattccctcgaactccaagtaagtggcgtccgcgatccccctatgtccccgccccggggtccgccgcgccgtccgggcgggaggaggggtcagtccgcggggcctcggagcctgtttctggaacctcggttccccgtcccccacccccaacccccgccccatttaacttaggtggagactcctcgctcggctttccaacccgagccccgctggaacggacggtctctccgcctttcctcccccgaacgctcccaggcgctaaaagctactatcggctcgggtgtcaagtccgggaaggtgtccgatggcgatacctgaccctctcctgttttcgaggacgaaggacatggccacaatctaggctggccggcacgcggggactggtgggctctggagagaggcggagatgctgcattcgcggggagcgcgggcggcgtggtccggggcccgcgggcgggcgaccggggtggcaggacgctggcagcgaagcgcgttctggagaggggagcctggagtcgctacgctgcccgcagagccctggagccggggcgccttggcaccgcgccgccagcccgagggtgcgcggggagctcgcctgcttcgcaggagaactcgggcgtcgagccctttcctccgcgccggggagacgggccttaggcttctccctgagggcccgccgcacctcggcctcccgcttcgttcataagccggtagccccggagtatgcggtctcgatggccgacctgattgtaatgcacttcctataaaagcttagggccctgcccagtcgacactgctcctgaagccttctccctcgggaccctggtaggaatgggatccttaggatcagatttgctcttaccggactctacagccgggagcgagccaggccttgtggagagtaactttcagtttgggccaccagagtgcattcagaatttagaaaatcccatccatccctaaatctgtgtggtcataactcgtagtcatctgggtattcagtactgtgtatccccttatttcgaatcacagccaaaacatattttacagaatcttggaattgtagtctcgggaaacttggagaagaagtatgcagacattagctggtttctggagaaaacgtttgagatcagaagcaaaatcaatggcctaattgaagttgagcaagttgggcctggttttaggagaaaagaaatgggggattgatttagaaatcacgtcttaaaggagtgtgtccattctcttaaaagtgtcaaatttcaaattcactaacatgttaaccaagaatcccttcatgaaaagggcgaaaacgtcggttacaaatcggtttaaacaaatgtttgtatgatgctagaaggcactttcaacaccgctcatacggagaagttacttagctctgcctccttccatgtagtctgctcttgcatggattatatttttaatgtaaattgttgtatttgctgatgaagtactggcggcggcatctttgcatcgatgccggctcgggaggcgccaggtggtgccggaaggagccgggctaggacctcgcgcagcagcgggtcccggagtccgggagaggcgggcgggcgggcgaggcggtcgcggggaggatnnnnnnnnnnnnnnnnnnnngtcactcttccatgcggaatcgcgcagcgccaggcctcgcccctcccccaggccgcctgctccagccactctgcactttcactgaccggttctctttgaggctgttttttttttttcttatgaggatttaatatttctgtttaaatctagttgaaagcaattccgttagcctcttcagcgtttagttcggtgtgtgtatctttatctttgcgctatattaactattagtttgtgtgtatccggtaggagaattagaaatacctagttgggagaaaaagaaaagtagaacaatagttatttcaacctaaggtttagacgttaataacttctttttgtaatgtgtcgagatggggggtcctggggggaggtgacaggtactcaccactccccccccccattctgatgatgaagatgagtctgtctttccagctatgtccagacctgcgagggccctgcgtttctggaagcctgccgtttgcgcggttgaggttgctgctgctgtcttgtcctccacagcagcatttcttttaaaattctcctgataacggcctgcctggatgactggataatgtgtgcctggaaaaggtctcccttgcagctgaatgctagctccagagatcagaaagatttcttcctgtaggagccataggaaagagtcctctctaagtttttgagaatgcatacaaccccctgatgacagggggtcgctttccttggggaagttttatatttatttccagaggaaagtttgaatcggtaaatatgatgtggcaggaaggtaatcaaatgcattgaagtttcacatcagttcctatgaactgtggaacaattcatttgtaatgaagccgccatcagtaattagatttgtttcattcagaggtcagcttttttagcaggtggtcgacacagggagcatgcagcagctgtttggatacagggtccagaaaaccctttgtaaattcagcgtctccgtaactactttaatcacattgtcggctctcccgtccctgactgtatgtaataatggaaagatgtcctgcgtgctgaaacagtagctgccctgttaggttattcacattgctttgatacgttctggtagagttgggtccgttgtagccattttggttgtttaaagttttggttttttttttgttttttttttaattcagcagagaacagtaatgcctagcttccgtttttaacttaacacttcagtagaacattttcttccaagagggagattttggcctaagtaaagtagtgggctcttttttaaaaaaaaattaattttactttaatgtgagcaaatctgtattggtatggtgttctgcaatgcattacactgactttgaaaatttcgagtactaatgccttatgtctggggttaccattccctgtgcatcacatactagttagttaacatagcattttgcttttcccatgtaattttttccctatataatactggattcctgatactaattgacttgatacaaaagaatggctggatgatatccagataacgtataatacatgggcttcaccacaatcaggctctgaataaatacagacctgtcagagattgataaaataaactacaatggatagtgctgtttaaacagtccattcaataacatatataagccagcctgccttccattgtgtctgaaattcttatttttgtaggtaaacaaatgcacattcagcactgattgaatagccccttgaactatgctccacagtttgcgtttgggttaatcttgtcggttttaatatagagagaaaaaagctcaaagcaccaggggtggaattgttagtgctttcacatccacattcctcacattttgtcaggatgataaactgtaggtaatggactgtcgttgttctgcaggacaactgagccaggcagagcacaaagactaagctaaagcgatacctcacaacatgcttggtagccttcttttcagatgagaatttatttgagaatcatgtgtctagggactgcacatcttaacctcaacagttacagcttcaagccccagaaacaggagctggaggttaagatgatttgctaagcacctggttctaaatcttttacaaagcataagctgttgacgctggttctgccgacgcaaagacatgcagatgactccaacatttccagaggcttctgacttaagctaaagtgtgtggacaggtgaattcgccatgggcctggagaccagcttgctaaaaactatgtgtttgaatggttcctccagacagagtcagctgaagaacaattggtggatttatattaaaacctcttgtctgtaaacttactgaggtgcatccttcggttggtggatcagtgagataattgccttcagatggacattgcaactggagcaactaaatccttgctgtctttccttcctctgaaatcttccaggtagctcccgagagcttcagtatgacaccaaacttcgggcgacgttttagagtgcgttcacctaatgggaaactattcgagatcccagcgtgactgcagtaatgcgtcataggaatgggagtggcaggggaaaaggaaatacagattgtagaccctaataaaaaaatttttaggaaagatatttctttaacgttttatgagaacttcattcttaaaatacttaattgcaaattagacaaatagaagtgctcttctaaggaaggtgattaaactggtcctcctatcagcctaatctctgcctgcctttgctgctgacataaagaacctgtttttcaggtcacttaatatacatctacatagatttgcttatgagctcaccctttgtgtagcggagtagagccttaaagaggagtgctcaactgtttaaaatattttgattaaaatatgcagaacccatagaactataagcttctagtcaggaattagctctttcagggaacagctccccccttctttttaaggggggaattagaaggaggctgggggaggaatataagaacagcaaagaaggaaggatagcaaatgggacatgttccgaacagcttggaaaaactcctgtggcttcattgtctctataaagccaaagaatacaaagacataagcaattcagcccttctcccatgatggaagatgtaaaccgttgacatgcctcccctgtttaacttgtttaattctcattttaaattcagcacgatactagccgtgtgaactctgaagatttctttagtaatccattttgtagttccgaatcaaaaacaaagtgaaagggtctgacacaatttgcttttatttttaggcaaatcaaccctggtcatagttaataaggggattacaactcagactaggtctttacagatgtgatgtaaatcaagggcagagtataaagaaactgatcccttttgattgaagtatagtaaaaaggcatagagaaactagcagcagtaatctgattgtatggcaataaaaccaccattttctgtctttcagataaaaataatgtggtaaatccatgcagttcataagatgtaaaggcagataaagggtgaagccatggcaacatatagattagcttgatgttagaaatgacacgtctctgaaaagggcgcgggacgaaggcccttgcctccaggctgttgggcattatgtgagaaccacacagacttggaaactgggattaggaagtatgaaagctctacttgtggtctgggatggctgaggcagtaaagaaaagctgctcagttcttgctcattggtggtggataatatggcaaaggtagatttcattgactgccttttttatagattgagattggggctgattaaaacttcagatcactgcagttgttagggcctgggagattttcctttttaactcctggcctaacagcagcagccgttctgtaggattaactgcacttcgcggtcgttgccttaatctatttgggcttcaggcagggacatgctgggaaggaacagagaccagaggggataggtagggctggggttatctgaaaagaaaacagagaccttttgatttcagccatcttttcagacccagctccctctcccgctgcatgggagaagcaaaggtaaacaggacacattgtccctctccctcagccacagagctcttctgtgagttttgtctttcccaccctggaaaaaaagataaaatacaatttttaaaaggggagggaggaatttagttttaattcaaatgagtagtaatccaatatgccaaaagcagtgggctctacctagatgtaattttactcgtaaatgtgagtcttaaactttgagttgaatggggcaggctgttagaggtggtgtaaattacaggattataaaaatgttagtgctgcccagccttaaagtcaaaaacagaaaaatctctgtgctgttgagtcttcccgccctctctcctgaacaaccttgtaagtaagctagacttttgtttttgccttccatactttccatttcagccattaaacaaaataagccattgaaaccacgattgggttccatgcagagtgacatccgcaatcgggtcaagccagaaggaaatacttgctcgattgccccctatttggcattacaggaaagtctccacactttggaagagtctgaactctcaagacattgaaaatgccaaaggctgcaaacaccctgtgtctttcttgatggagtgcatcttggtgtgttttacaaaggggaattcagtgctgtttttttgttgttgttgttgttttttttttttaaagagcagcatagggcccttctagactcttggattctgtgtctgacaaaaatggtcattaaatgagcaatattataatttagacccatttcactgattttgttccaaattctcaactgacttgagcatctgtttggggctgtagatacattgcccttgttgactgtttttctcgtttctatgggaattactgtagccattactatgtagctttcatagactcaaaacatttttaaagtattgcatataggctggccatatccagtgcctgttactttaccttctttttctaacttaatgcagcagtctgtattaacagatccatttcatttgtctagcttcatcagagagaggctaccccctgatttacaggctgctcacatccaagcaccttgcattctacacttgacagtgattgctaatggcccattcaactaaagtatttgcttgttaacagggaacagaacatgataaatgtccagcaagcttgctgcctccttcagcttttcaaacgcagactggtgcatatttatggcaggcaaatgacaaaagaaaaagctgaattgccctggcctccagctttctatcagaaacagggttaaagtgattaaagcaatcattcaagaaagccctgccgtttgtttactaaccttcatccaacatttagctttgtagtctacctgtgagaagatatttcagaagtattagagataaggaaggaggatctagcaaaccagtgaaaagagtaggtgaccagttataaaatgctttccatgcacattgaatgccaggcgaacctatttctgttattccagcagacaatcagcagtggctctagattattaacatattttcctttcatgtataaattcaaatatgtaattctagtccaaagcattctgtggctggtaagcacatacttgctgatttcaaataagaaaacatagcaagggaaagctccattaaacaagttgtttctgcccttagtaattctctaaacaagataggaagaaaaagtggacagtagtggagtattaatagtgtgctcttttcattctctaaagcacgagtaagtaagcgttcaaactactctgtggtgggcatacatttagagcgctgtgaatgaaccactgctgttctgccatacttaatttatttatattattatttttattttattgttgtttttatgtattattataattatttatttatattactaatttattttctcaatttaaatcctgttgcatccaattttaattacagtttttgtatctgccttcccatacttgctacccacgtccccattgccactgcggccttatccatgttttctgtgtacaccactctcgtatcaccccagaataattatgagtgctacccagacttttgaaaccactagagtcaacatgtttgtctttgaggaaagccaatgatgctttagcatttttggcaggggtggatgtgtgtttaagtggggtgggtgcagctccttattgtctgcctattctactgttgttcccaatccacattccctgcggggcacctaacctgtgtgcatagcaaagaatttccgaccttcagagccagaagtgtttctcaattgatctcttccagcctagggttatagctgatgaattataatccttgctctttccacacctttacctgggcttaccatggccctaaaacatttgcccagaatcagaattgtctcatgagtgagtggggcaaggcaaatcctgttccagaccagctgagaatgtacctagctgcagaagaagttagaaagtgtcatcttttacttatctaccagaactatattcgaggtacattttagatttaaaaaaaaagcaagttctcgtaggccttgaatcccccccttgctatgggaaaatggatcattattataatggactgtccagtaaagttcatgatttctcctagacatgttctctctctttatgacctagatcaagagtgatctctttaagtcttttcttcataatcccacagcactttgtacttagatgtacttagaaagaaccatatacacggtacgtcatgattgatatgcaagccttcaccactctacctgtcctaaaagtcagggacacaccttcttcatttcatcagtccctacttctatccagcattggcatccagtaagtattagtggaatggacagacaacccgaatttgtgctgatggcagtttaccctgttttaactgtcatccttctgctactagacatggatgagacctgagacgatgggactgctcagaggtccctggctcttgaactttagggcaccagaatcccctgcagggcttgagaaaacaggggtttctgggccccacccccagagttcctgattcctgaggtctggggtggggcttgaagatggacatgtttaacaagctcccaggtgacgctggcaactgctgcctcagggccatgctgagaaccctcgccctacacaaacctttctgggaaaacaactcaacattaaagctgtttggggatctctgaagaaatctgtagtccttgccttgttgggggagcatcagggatctaaccattgatggtggagtatttgttgttaattcagcaagcaactattaagtgttaggcctgttactcggctctaacaatacaaggcagagtgacctgtaccctcgagatttaaagtctaagtcctgtagagagaagcccaggtgggagcaagcacatttagagttaggtgcttggtgcaaggtggggacacagaagaagggaatggcatttgcctctggaggggtccggaaacagcctagggaggaggagcttgagtcttgaaatactgtgggcatctctaagcaaagtcacagtagacagctgaaataaagaaaatagtaagcaagccaaagaaacagtatttcagccaagggcagcgtgtgtctatcacgtccacctgtgaacacgtcccaggattctctgcatccggccattgctcaagacagatccctcacaggaacagctaagccactgatttcagctacctgttcacgtgagaattatcagtacctactgcttttcaaaatgagtatgatcatggataggtgaggcaattcagtttcgcagagacagtagggcaagtgccactgtagtttagttaagggcacatgctttagagtttggctatgtgagtccaatcccagtttagccatttattagctgggtagctttaggagcagtagccttagtgtctctcagttgtcccatctctataatagggacaataacataatagtgctgaataaaagagtaacaaaattttggtcaacatttaatgtatttaaagagctaagctccgtgattggcacaatgaaccaatcaatcaaacaccagttgttattaataaaagtcagttgaatatgtactgtgtgcctggccgtggttcaatttgcctttgcatacaaggaaaaaattaaaatactctgttaataaagactatagcataatactttcaccttaaacttcttgatgttaatttattttgtttacctgccaaacttctactcattccttatgactttctgctacatgaaacaccctttgtaattcttttgtcctattaaattaagttctctctcctctgctttcctgcttttggtgctttctaataacacttttaaccctggactttctcattcagctgtgcaactgtggactgagaggaggctctttgaattcattttgtatattctagtagagagtactgtgagcagttgggttgttgaatgaatacattaattcaacctggagggatgggcagtattgcattttttacattgatattacatgatatttagaaaactgcttaactggtggacgttgttttattaacagcattttgtgtatagcactcactatgtgccagctgctattctaactgcctgacaaatactcctgaaaccttcatggtaaccatatgagggaagcacttttaatatatccataataccaacggggagactgtggccaaattggttaattaacttagccaaagtcatattgaactaataagtggatttaaacccagctagtctggggccagggtccctcttttaatcttctgcctcctgcttatgctgttgcatggagtagtctttatcatataactaaattaagcatgcatttgcttaaagcagtgcatacatgatggatcaaaaagtttgtggtataattggtttaattctgtcattatccattttgatttatagtcactttcttatgatggtcgtgtagttttaaatggaacctttgaatctttgatataataaggttatgtcaaatcttgggtataataaggttatacccaatggaaacagaataatgatcagcccatttaaaggatgactggagagttattacaatacataatagtcatgcatatattgagtagtattcctttggtaacattttccttttaaaaattgtaacatttgattgttccttgttgggagaaaaggaggtcagatttttgaggggagatccatttggtgagatgctgagtgtgtgtcaagctaaggagatagtatgacatcttttttagagtctagtcacaattaaatgccattttattttggattttgggatccgtgccagcttccagcttgtcagagctgagaagactcaaatcaagtccaggcttatttctacagcaaactgggattctggcttcttgccggtggattcattcagtacagcccatctggcttttgatgttctgcaagtttggagccatttgttgaaggaagccaggcggtgaatattggtggtcctggggttctcttgactccaagtggtgccccttggtttgcattttcaccatgcttagcatctgcttacctggagaccatgcagccgccggccagaggtctccaacaaccaaatcttcatgccttttagaactcagagtccccagcacatcctccttcctcctccttgtccaattactttcatgcagttctcagtagctgcttgtttgaatcacttatagtatttaacttctagggtgtttttgggttttggtcaaggtaattccaggctgaatgtggtgactaagcaggaaataaatgggtcgtcctcaaagttacagtggagcgctgtttctattttcctaaggtacacagttgtgggggcgatccgtatggaagtcaggaacccagtctgattttgcttccttttgatggtagcagtacagacctggctgttttgtagcctgctttgtttttcttccttttcttccctaacttcacgggctgtggcaaagccctgagacgtgcaggaaaatgtctcctgtcatacgcccacagcagacctagccctgaccctcctctgaagcccaggaaggaggtatctgtgaagcagcctgcttgtaaagcaattgcacacagccttgtaaactgtgttactgggctgattatacttgattggcaaggtgaatctcttatagcaaaagagaacttggagagttttatctcatcttatgccttattaatttgttcattctttaattacacagccacctattgagcaccctatttatgcaaggtacctggtcgggggtcagagggagggtcccatggtaaacgagacagactcaatcctggaggagcaggaatggcagcccctcgctgggctgttggccccaccaaaagggaaaggtttcattttaataatacatgggtgaatcatttttgtcaataggcaaaattctttgtagttaaaaaaaaatatgatggtaggaaggaaagggatgggcagagggttaaaacaaaagatatgctctccctaactctagattgtagtattgttatgcttgtcactgtagctgaattccatttctttgagttttttcaatgccaaggcattccctgtatgacttacgtgagcctttcatctccgcgatttttcccattcaggtaaatgagcaaatggatttgaacactcatatctaaaacaagagagaaccagctggaaatgccctttgaatttctttctctatgtaaaccatttttctttctggtgcctcacctataaataacaggagttccaccttcctttatagactcttgctgaaagcatggtttggaacaagaccgtacaggtgcacacaaattacagttgggaaagaagcctgcagtgcatcttgtctctgaaggttatgaaatcctccttttagtaatggagctggcgtgatcaagccagcaggatgaaatttggcatttgtgagatcaccccccttctcacttgcccactgtacatagcatcccagccttactcttcaaatctccacattttttcttatctagctacaaaattcataggctgatttttttggggtgcgtgtgtggttttttttttgtttttttggtaaataaagacctgcatttttattttgatataggtggttgagttttgtctttaatttcatgacagagatttaactagtctcaacttttgaaaagacaacaatgatatttggggatcacacacttaaagttagatttctagatgattaataccaaagtagatgattttttagcctcagccatttataggtatgcccttctgtgaattttttatgacagtgaaaatcatggcacagataaaaattaaataaatacttctgttattttcctgaagaaaaaaaaaaaaagcttaaactatgagaatactgtctttgagcactttaaaataaaattgacttcagccagcaggattttgagcattacatcacaaataaaaaacaagattaacatcaaaaggagtcagttttcattcaattgtgcagcactgtgggctgtgaaatttaatattattttgactcatatgctaattgtagactgacagaggaaaatggattgtgtttaaataaaaggatacacagcatcacacgcagctgtatcaaatacaagttgaggtctttgggccaggaactgggggccctctagctctgttattgcagattcaagtttgacaaataaaactttcctttagactgtagtttaattactttttttcaaaggtatgcgtgatgaagaggcacaaatacacctcaccttgaagagttgctaaactggtttgtgtgccgatcagttcaccgtgtgtttgaatttctgtgcttctcatctttccttttcttgaaaagattttgcttgtcattggtgtgaattgtaccccccacccccacccatctagtctttgctctcagatttataacactttaatggttccaaattgtatagcctgctcttagaccccttttcttttccttgaataaatcaggttcatgttgcagacgatatttgttttaggaaagtgtgaaagaaggggcacctgtgaaaacacgcaattgttccaacacacatatacatccaaattaaagcagaaaatgtcaaagcctccaatcactaccttatttcttggaggtttaaagccgctgagaagatagtggtgccctcgctggaagttttaaggtaattactttttactctaagcagtagtatctggtaacctaattccgtataaacctgacaccctatcgctacaccccagtatttctctgatttcagaataagtctgcgtagaaacttgttctgatgttaaagtgcaaaagggggcagtaaagtgctatccacaaaaaaggaaaaacattttccaagtatttcttattactgcctgtgtctttcgtaggccctgcctttatttattcattttataacaaaactcttatgtttggggcattcagagaataccttattaagctgttgcagcaatctagcattaaatggaagacatgcaagactgaagatcctgcctgtttatgaagtgtgccatcaaattcacatgctcatgatgcagagtccttctttgggagtattcgtattcccaagtgcacagagcacttcggaaaggagccttggtctttggtgttaatgctctcctagctccgtatagatgtggcaggcccaaagtacatggtggggtgaagggtcaagggtttgggcttatccagagcagcgtgcatcctttgtcaggaggtgactggaaacaccagccaattacagcagaactgcagactgctcatctgcattcggaattgcagatgaaccagtttgtactcgacttctcttcttcactgtaggctttgacatttaattaaaaattaaagccttttatggaaaaagtacatgttttccaaaatggggtaaattcgaagtatacttgatacagaacactggcttgggaataaacctgtgatattacatgacttttggtttgcaactgctaggctgagcctctttgtaaagctgggatttagaatctttgaaatgtttgtacagttcaatgattaagcataaattgtatatattccctttttttcacttatttgagtaaacaagtttgttactacagcttctgtggactcagagatttatgtattaaataggccacaacttcaactaggataattttatttatctgcttgttagggaattgcatcaaaagtttaagtctgtaggcattaaatattttaaatgcttatttttaaagtcaattatgaaagatagcacaaagtttttctgaaactacattaaaaaaataatgttttaatcttatcacaaaagcattgactatttattgcaaagaaaacacagaaagctaaaaatcattctaagtccaccattcagtagcccaaagtggtctcaggtaaaggcggtgtgtgtgaccatttgtttatggttgtctccgtgcagtcagcaaaataaacagaacaacatgccatatattattgatgtgtatattttcaactgaaattagccatctgcttacaatgatcatatacactaatggtataattttgaaatgaaaagaaaaataaaataattctttgtggagagtaatgcgaattgacttatgaatctcgccctgcttggcagtttgctctagaggtagaagagctttatgtgtgggcctcctccccccccacacatttattctgctcacacttgcaccagcatccatgtcaggactcaccttgtcctgttacatgagtaacatggccctgattctcaagtgcatgataactgccataattacacataaatattaaatatttaaatagatctttacgtgtgtaatattaggtagaagtggctctggatcgaatctgatgctttttaaatagaagctttcccacaacatttccaagcactgtcatcgtgtctgtctcgatttggggtttacctggcctagttatctgtctgggtgtagaaactggtagttcctgtttgtatcttttttgttctgatctctttattctgtgtcagctaaatattcttgcagtcagttactaacatattaactcatccttgtttggaaactttggcatatccttccatggtttccttccgtggacctgtcgcgtctctcaggagagccaccaggtatattgtcacacatttcgcatgtattttcagagactacagcagcatcaagtggccccccagcgatttgggttttcttctcggttaatctacactctttggccaaccgtgagaaaacttgtaagaaggcatcagatgtttgtgctaaggtgcgtgtagtatggtcagaggaagaaagaagcagggaaaatggagtggccgtgggtgggaggggaagcagggagtgcaatttcgggttcactacacagctctccataaacttctccactgctggcttcccacggatcctcctattacactgggcaaagtgcagaaatagatcaggcgaccactgcctccgtccatttcccaggcaccctgtgagacccgataatgcaatacaggtcagcagaaaagtccagacttgacatcccaacgtgccatggtctggtctgtgaatgaaaatcacatgaggtgacctctgaactctaagtggctggtttatgttttcagtgtattaggcccgtgttttaaacaagcatgtgctcgtagtgtaggttaaaactttctgttgtcttcattaattatgctgtgttctagtctattaatattaaagaatattgtgttgcataatgactaatttttttattttttggagacggagtcttgctctgtcacccaggctggagtgcagtagtgcgatctcggctcactgcaacctccgcctctcggattcaagcaattctctgtctcagcctccgagtaactaggactacaggcgcccgccaccatgcccagctaagtgttgtatttttaatagagacggggttttaccatcttggccaggctggtcttgaactcctgacctcgtgatccacccgcctcagcctcccaaagtgctgggattataggcgtgagccaccacgcctggcaacataaggactattttttaaagtttttacaattatgactgtgaagttgaaatgtctaaattattagagatccagtttagattactaaatatttatgtctaattgagatgattagacttagccaaagtatccatgtagaagtattagagtctagattggtgaaaaacttgaaaaagcttggcttaagttcaataggtaatccaagagtaaaaacagattccaatatcagatcttttcaccatagtcatgttaagtttggaagccctacttgagtgtttccagttttttccacattatattgtgtctatatttgattcaaaggcagggcatctattgtcttgcttaggactgattcactgggaaaagccactggagttgcctatttccactcagtatgcctcactcttagagtagcttcccatggttcccaggcaggccctccagtgagaatgcaccaagccacacgccatggcctgggaagcagtcctgaacctggagattgtcttgatggaaaggaagaggcagccttcccctcccaggaagatagtagagagcctgctctgacttcgctcagggatggaactggtctggctcagttctctctcctgtgtgggacatgaatcactcttggtggtctttgctttttatttgggcttaaaatcagcagactttattaaatgacacctctctctaaccactctctgtctgggcgaagtttaacaagaacagcctccccccatgtggtatgggttgtaactgtggcggtttccctctgctgtttttggttacaagatgaacattatctgaacacacagaaagaaatctgtatttggcatccataatggaaagtcagtttagtaatttaaacttagccagttatcatcatcataattctttttaacactttcaaagtcagcataggagaagtgtattgttgaatattacaaaatatttagggcatagatagatgtgctgtgtagtttgatttgttaatgtgtctaagcaatcaaagcaacagaattcaaatataaaccccatcacttccaaaataggaactctgtttactgacttgattataacatatggaactcaattgttttccattaaaaaatgatactattaggaaactcaccccattttcttttcatatatattctgctatttgcataattgtctggagtccatatgtaatattaaatgtaaaacacaaatgccatgtagctggtctgtttcttcctcaccttttggttcctggcctcctggggaagggttgcacatctgagccgtggtctcagatgactgcctcggaagaagcctcttcccttcaggcaccactgatgtgtgcttggtgtggagctagactttccctggctctccatgtgacgctcacatgtgcgtgtcttgatttcccttaacttcatggcttatctatgaacagcttgatttgggggaaaaaaatgtgtttcccaatgctggagttataattgaatgtgctgcagtcaaaactgaaatgtgtgcagagaaagggggcttttcctgtcatgctcattgggcaccagtgtgtcttcacctgttttgtgtgttaggtccatgcgtcatgctgaaatgaagaacatgggatgtatggggctttggacagtgctgagccaaaagcaagtgctcaaaagcagctgtgtttgtattattagtggttctggaggtggctgattgccttgcattttaagtagagagggattgtagaagactgccaatacttagaactttttccagagaggaagggtcagaaactgcatctgcagggctccttgctctccagaaatgccagtgtgcctgggagggcatcttcagaaatccagtctctcctcctcagtgtgtcctgtaccgactcagtggttctgtcttcagaattcctatcatgtctgtgatctgcaaatagtggtatttaatttgacttcaatttgtataaatgttagcttctatttgttcattcctattttttgttcaattaatacattatttattgagcatctactctgtgtcagccccttgggtgtttaatactgaattagtcacatgtgggacttgcctgccctcagggagctagactataaattcctaatgatcagtggtctccacttttctgtcactcataatgtctggcacaacataggttacttgagttgttacactcacagtactgttgtttgctgccatggtgctttaggaagtgtgagagttcccgggaggcagagtcaataatgcagactacacgtagtgaaaacatggccaggagagctgtagttcaggctctcagctcaactgcactctgtccactgagaagccataatttcttcacttaaagtgactgtgcgctatggctgtttatatatacgcttaaaaagtaaaagctgctaaaccactcaaggattggggccttttgtattgatttaattaaaggaacaatcattgttttaatgagctctagaaacaattacttttgaagagccgaggatcaaattcttgcctcacgttttgccacagtgtgttctgaaaggtgaattaatgcttttggaatcatcaggaatagtgagctttgtcacgatttactttttacaagcgtatctaatatgcatattgaaatgtgagcctccccaccacacttccgctttgataagcatcccccggattgccgtcactgaccattatagatttttaacaaagttggacagtacacactgaatgaaaactttacatcaaggaaggcctggcgtgtttgtaaaatgaattaaaaggctcattaaatgatttatatgacttacgccttctgaaaatatggcctcaaacacagagatccccaaagccacaccgacccctgcgtcccatgttctcgacctcaccgcatcagcaccagcaagaactgtcgctgagacggtgagtgatgagagtcaagaggagtgacttgcatggcctgggaggaaacctcctgtgaatctttagttaagcaggaaaaaaaaaatcctcatgaaggaaacaggatcttgggagcattttgaatgaagaaggagcttagtgagccaaacttgagacatagggtgtaatgtgggagagttttaagatttgcagagatgtacagcttgggagggggtgtaatgcattttcttaaaagagctgaatgaatggttgaggaaatgggtacatctggtttggttaaggatcctaatctctgaagcctgggatgcccccagggcttgtaatttaggaatacttcccctaatagtagctaacccttatatagtgctgtctgtgcaggctacaaaaggagcagattaaggatagaaaaggtttggagtgtatgagaaaccctaggcaggaattgactcctggtgtttgtaaaccttaaagatgtcctaaaaaggtcaaggaataagacaggagaaaaaggaaatgtcaggaagatgatcaatttaatgtttatggaatttagtttgtacttactgcccggcatcttgcctgaggtttttaacctcagcagcacatcagaattactgtgtgtgtgttggaggggctgggggagataaagaaattagcctcatcccaaacattctgattcagtctgttacttgagaaactgaattgtgttttgtccataaagaagatgaaattgtctacagagaacacattgccattcacaaggttgaggggataccacagagaggctcccactgtgatttgcatttgtcaaaagttctagagaattcttcaacagtacacacatggttgttttaaatatatcattgttataaaaattcgttttgagttctgtttcacagaaagtttttttgaatgaatgaatgtcatatatccttgctaaaggagctcagttaaaaaaaaagggaccatccttctcttttgggggttgtacagtaacacattcccaagaaagaggtaacagccacatacatttttcttcccaataaagagtgtgggtttttaatatgaatccatagtatgatttctgttatgttttgtgctgcttcataaccacactcatgcacttttcagaaaattaataccattcattagcataaatcataaactattcccttggtatgggtttgaaattgggggtgccctatcatccttgctttatctcttagtgaattatgaccctgtagtcatcatggctggtgggcgtctctggttaaagaaagggttggattggaaggattcagaggcgattctttgttcttaggctttaatattttaatgagcctgcaggcttggctgcttacgaaacgagctgagatttctaagtgtgttgttagtgttagcacttgtagaaggatgttcattaggaagttcttgtttcagtttttcagagaaactccccattaagaaagatcattcaggaacatggctaccaagaaagaggaaagggaggagggaggctttcagctataagcattaaggggatattgtatcagtagtcttagttctaaagatttgcttctgagaattaattggagcaaatacatctcaagggaagaaaaaaaaagatttatagggcagggacagtagttgtccttgcaagtagaggacacttcattttgcagctgaatcaataccacaactaattatttctggttatcttttacgcatttgtaagacattgcttttgttcagtgtaataaaaaacccattgtttgatcagtgactgactaattatgataagtaatttgaaacattcttgatgaaacttgtctgttaattaacatcaacagcacagggaaactaacaggacaacaaagtattagtggatccactgttccctccaattgacgagctttctctgtggcatgcccaataaactaaagctgccaatggttaaaaaataacaaacatgtgggagatctgactcaccacggaggaagagttatggtaaagttacacaaaggagtactgaaatattacaagcgagggggtggtaaagaaatgtcagcaggtagcctgatcctacagcttagagtaaggaaagtggtttctttctgtctttcctttttcttttaaagcttaattccaaaatacattcatcccatattgatctgaagtaagagacttttgataaattaaagtgtgaatctgaaaatgtgtagtttgggattatgggcattgcctggctatcttgtaactgtcattaatactgttaatttttatcaactcaatggcttttttttcttatgcttttagatttctacctggacaaggactggtactatacccacagataggagacaaattggatattatttgccccaaagtggactctaaaactgttggccagtatgaatattataaagtttatatggttgataaagaccaagcagacagatgcactattaagaaggaaaatacccctctcctcaactgtgccaaaccagaccaagatatcaaattcaccatcaagtttcaagaattcagccctaacctctggggtctagaatttcagaagaacaaagattattacattatatgtaagtataattttattcatttattttatagaaattaagataagctatataggtttgtatcaattttttgtttccttaaaattattgtgacaaataatttgatgaaaatctatgtggaaaaattgtcccccccccctttttttttttcaaagaaaacttcattgaatttgggaccctgtgctaccagtattcattaagtatacatacccaaagagaaaaaaaaaacactagaattcttaatagtattgaaataaatgtattatatgaatatattcagcatctctactgacaaaaccatttttaaggaccattggtggattttgataggtaaatcttgtgcattgccttttctcttcacccatccatccattcattcactcattcatttcgtatttattctgtgccagagactgtgcttaagggctagggattcagcagtgaaaggtggtaaaatagcatgttttcctcaagaagttaacagtctagagaagatggagctcataaattcgaaagatggggatgacaggtcacattaaaaccagattcagaagaaaaagacgaaacttggtttgcttagtacattactcttttttgcatacatatatataatttgacacgctgtttcaagaagagatggtacgtatcccttgggtcatatctgaggctgacttgtgaggatgtgaagtcagctgatgagcacatttggagcccacgcctactatgtgcagatctctcgtcagcgtcattcccagggccccaggtggtgttaaagtctaggtgactcagacagctgttcgcgtcattcaagcaatgaagtcttttttcttaatttctttggtttaaaattatactcataattaattgggttgaattttccagtggcttggttaccatagacttcagtttattagggaactgctatctgccactggtttattatttgccccaaggtggactctaaaactttaggtaggagactcttggtgatcaaactgaaactcttgcatctcaacctatgagccgcactttattgttattttatttttttagagacagggtctagctttgttgccgaggctggcgtgcagtggcatgatcacagctcactgtagccttgaactccagggctcaagtgatcctcccacctcagcctccaagtagctcggactacaggcatgtgccactgcacccagctcaagagctacacttcaaagcacagaatgaaaacctatttttaaagccaacttgatacatagagtagcttaccaagaattagtaacaacaacaacaagaaaaaaaagagagaatgtggtagagtatatacttagtaaggagtaattattataaaataaaagcattctgaaatgaaacaggtagatggggtggccaagtatgcagcatagtagggaaatctttgaaaatgtaaaatagttaccaggtaaaataaatggaaactttaagcttttggaagcctaacaatgtatttatattagtaaagactttatttttttattttattttattttatttttgagacggagtctctctctttcgtcaggctggagtgcagtggcgtgatctcggctcactgcaacctccacctcctgggttcaagtgattctcctgcctcagcctcccaagtagctgggactacaggtgtgcgctaatttttgtatttttagtcaagacggggtttcaccatgttggccaggatcatctggatctcttgaccttgtgatccttccgccttggcctcccaaagtactgggattccaggcgtgagccaccgcgcctggccttagtaaagacttttaaagtaagactttttcagtgaaagctactgttaggcatgacatttacaggcaactgaaactgatcagatgcatttattaagaaggttaatgcccctaggtggggtgggagaaagaaggtcgtggtacgggaagaggggacacactagagatgagatgccctagggcagtgaacgcatgtccctaatgcgtggatgcagcccacgtccaccgataatgccgacacacccagagtctctcttcttactttagcttatgacttcacgaagaatgctttgcaaattctaagttcgcactgggcgcaagtggaattttagtaaacattaagagtttaacctttagtgtgaaataatatgcaagatatgcaaataattgtttaccaacatctctttgcttaatgtggtgagcatttaataattgctttttattaatacatgagagatttgtatttagaagcagtttaatttataattataatattaatctacacaataacgacatctattattttctttttttggaaactcttcataccacactaacaggttcattgcagttactgaactactctggccatcagagctctccttagagttacgatttaccatgcaaaagcatatggtagcctgggataaatgaatctttcttaatacagaattgagggtctcaagtttgaaactacgagaggctatttgaatgttgctttgggggactgtcataagggctgggtggaggactcagggctaagaagtttgccaggaagtccagttgagactttcagcagagttgaaagacttccacgatggcgtaggcagaggaaggcgtttcagatacttgggaaaatatagaagccaatttctcacccaccctacagcaaagctcattgatctacaagtttccctagaaaggaaatgggaaatgcagagaacaaatgttaaaatagttttagaaattaatattgactttgtattgcttctgcataagttccaagacaccaaaacaatgaatggattttaaaaagtcactactttgcatatcagacaaatgcacacacacacacacacacacacacacacacacacacacacacagtcaagctctgtactggcttttttgagaaggaaagtgtttgaagttagtaatttttatatcagtacatttataaatagtgctaggtagcatgacggaaagtattaaaatttacatgtatatttttaacacttcaaatcgttggttcactttgagacagtaaataatattagcatttgagttcagctttaataaattctacatgggtttaaccccaaatctgagtgtctagttggtaagcgccttcagaacgagcagtgttataataaatatgttattgtgtgctggtttctttccatggagaggaaaaagagacctgatgctttggaggagtgcttgacttttccccagtgaggagtagtccagagggactgacttgcattggggagtaccctacatgaacagcatttcagaagaattaaaccaggaacctagagtcctacttgctagtcctgcttcctaagcttaatgagaaagtcaattttatttctttgaactttaatttatttccctaaaaaacgcttttagtattgtcattgttctggctaatgatggcggtctcctccagtttcaagccaccttagggctgggcatacaaatgcaatataggatcacttgttagtgtggtttcaaatggacatgatcctctgtaaattctttaaaaacatttaatttgatttgtggtgttacctgctttaaaatatagtcatcacacttgtgagtttcagacgtgaatatgaatttttaatttgaactgtatttttaaacacactaagtattaactaagtccccttaggagatatgtggcaaactgatatgcatcctcattcattcttctcatagatggttatttgttttttaacttgtggcaaaattatatatgaatggtcaccgacttacaatagttccacttaaatttttcaactttctgatgggtttattggagtattaaatgtattttcaatttaatgatattttcagcttaccttgtgcttatcaagtatcaagacatagccccacctaagtcatggagcatctgtatatgggtttttattcttgtttagaattgactttttcaagtgacctatttcagtaattagccctgggcctgatttgcataatgagatctcctaatcttcaagtaatgcaaagatggagatattatggccatgtggtctgaagagaccttttctttattatgttcagatctttaattgccttaaaaatagagtagctaatttacctaacctctagttattttattattgtctttaaagttttttttaatgttcatgaaataactgttctgaaattgcctattttcaagggaagctgtgtcttagacttactaaatgctccagttgatactgggaaagccttcttgtgttcgtagcctttatccgtagagttttctttgcagcattttctgtgcctggtttagtttcttttcagaggcgacacccagagctgaatgagtcagcaggtttggtgtgtcgaccctttgcaacagctgtccttacgaaggttctgtgggctggttattctaccttcgcataaaaccttgcaaaataacccacaaagaggttttcgtcacactaccaaaatcatgtgagtcagagatggatgaaaaatgaatgccattgtgttcatacttttccagtgaacagtagctacagcagagctgttagacaaagaaaaccgtattaatgaagcgcctcccaatttagcttcatatggcttttgcattattttgctgcaaatccatagctaagacacatcttgtggcatagtccgtaagtcatctttccgaaggactgtttgattaaaggttgttctgtgagatccaccctgtgttgttcatggcatcctcttggaggcctccctcactctccatgccttggcaaagtcttccttaaggaacactgaacaagtctggagaagctgccatttcttagggccctcattggttcagttgtctatagctttttattttttattttttttttaataaagagtatgtaaaattggaaagcttcacaaacagctttgctattttttagacatgtactccacttctaagcaaaatcacaaaataaagtaaaatgcttccacaaatataatgaaacaatattcttaaagaatcaaagcagaagaacttcagagtctgttgcttatgttaagcatatatttgttttcttctctgcttttgatttacttatttctggggtgtaggtttggcaagtagtactgaaacgtactgaatgcactgttctttagcaagatagttacaggagctttcaaatgtcctcttaacatatagatttcttttagaatatagaataatgtgtgggctgtataaagcgattatgtgctttatttgatgaattatttatgtacgataaatgtagcaaaagccacatttccatcattaaatgtaatcccatttggtgatacagcaacatcagcctgtcatttgggtcctctgattgaggggtgaggatttctgtttgataccttgtgcataatggctgcgttcaagcatttaaactcatttttatttctaacctacagctgtcatctttgtaataggatattcatcagaatcttgccagagactgtgcatttgggatcttgggggatacagcaccaccaccaccctccccctgtccaagagaaacagatcaacatcttaggttgagagtctggggtctggaagacccgagttcctgagtgccctttgacaagtaacttaacccctgtctgcctcagtctcttcatctgtaaagtggggataatgacagcacctgcttcacagggttgatgggaatccagatgtggtgggatatagaaaatgcttattacttccacctttgacaccaaatacatataactaagagttaactttggagcaggggaggaagtgtgaggctccaggctggaggcagacctgtgttcggctgcaagctggagaggatggaccccaaaagcttggctgatttgaagtccatccataaaatggaactccagagagtttacacgtttcagtaatgctgcataacttaattataagatcttctctctttgtcttctttcagtgttataaaagctcttttgtccttgagcttcctttaccaagaaacatgcatttatgtatctttttgttcatggaattgcccaagcttgttagcagatcctttgtaagacccaaaagagacagacaggggaggagtcttcagatacatataatcatttttcccaatttccatgttaccagccttgccaggactttttctcagttccctgttacacaatgaaaatagtgtctctttattgataattttagtagcatcctaatgtggtataaatcgtcttccagagaagaaaatgtgtcagggttgcgttatcactgaggctagctgggaaagtagatcagcccattagtctgataattcgaagcgttgtttctgttatttctgaacatcatgtgaactccttttctgggtgtattaaaggttttcccagtgtgtgtcagtgagactcctgattgaatttaatatgaataaagataaattctttacatttaaggattaaagtctcagcttctgcttaacttgagattgcactgagaaactcctggctctcgggtatagcggagtcacgacctggggatgtctgtcccatatggctctgtgtgtaagaagaaaaagctgctgtggacggagactctgttcacattaaatgacatcacctaagccatcatgacagcaagaattatttaggaattgctcagaataaaactgccttcattatttcataaaatgtatcttggtatctttagcaccttatttatggctttttaaaggttcactgggatttataaataattggacaatgctagagacctagtacaagaatgaaagaggacaggcttctttcttaataacctttaaacattcatcaggaagataaaactttaaagcaaaataaaacacatgaaaatagccaagatgcacagaccagacaagcaaatactactttaacttatttgtatagttcttaagagtcacatttgttcctgaagtttcaaaatctcgggctgagtgtttgatcacttagggaagtgttgtggccttcacatactcttgtctcactttgaagtctagaaacacaggtcttagagcaatttttatcactgtgagaaagctgaaacttagtgtgagtagcttagtacaattcagttggccatcaaatgtcagaaacaaaactcaatccagggccgctggacccttaggccggcgttgttagtttacaacagtgcctcctgggtccaaacatctaagtgcacatgtagcaatagtaaagatagtatgtatgcatacataacacatatgtagagacagcagagtatacgtacacacatgttgcatacatagcaacagcagagaagctcatgaactataaaggatggactgtatgcttgtatcagacattttggtactgacgctttgtcatatattgtgtaacatataaccagcttgcaatcatctgcccccaaagttgaactaagaaaatcctacagggtactaggaaaggaaggccattgggaaaaggtggttatagtggcaatttgttagctcttatgaattttctttttctttttagacatactcttaattccattttttcaataaatctatactattttgtgtttttatgttagcaagtactttaagcccctcaatagaaagttgctacatcatatagtgattaaaaataaaaatctctcaaacatacaagtagaggtggtatgagacttcaaattcccttagccaagtacaagtgcagcagttttgttggctggctggctgcatagaaggactgatggattggcagaccctcaagctggagtgtaattgatctcattacagaggagccaggctgggtgacagttgtgctttgcaagtggttttttgcattggtgaagtagcccattttgttgttcctgatgttaaacaggggatgaaggtattcttttattggcacaaacgcgggaaattgctctggattcttagaggatagaacatgtcccctggacggaataaggttcatgtgtagggcaaatttagataggggcaccttattggggttactactggtctctagatggtcaaagcaaacaacatgtccatctaagctgtgatgtccatctaagctgtgtgtgtccatgagagtgacgcattttctcctctgcagtgttgttatattctaaactgtcagcagacattaattcggtcgctggtgaagtcccaccgcctagagatgaactctgcctccgatggatgttttccacttcagtgccactcgtctcgcaattactgggtcattaatatcattgcatgcaattagtgacagtagaaagagctagagggttgtgggatgtgcaccctccccaccatgaactttttactctgaccctttcccagctagaccttttcgtatcttggcaaggatattttaatgattgagactgtcagaatcttcagagcaggcactggattatgtgctggaaataattcactcaaacacctgcttctccatggttcagaatattttcattagatattatcactatcccttccctgggaagtttcatttttaaaaatctgatgcttaagtacagctaatatagacaatagggaattatgttttatctttagaactcttacattattcttttctttaaaaatgtgagctgagtcattgctattgcagtggtcatctggccgcctatttttaaaacacaattcctctatcttagtagattttggcccatattaagcatatcaagaatgactttttttttttcaagacatggggttttattgggggcttatatacaaggaaagagagagtccagtggcagtgggctggacaagatatccacatggccctgtggcagtgagctgggcaggaaaactgcaactgcttgcaaacagcatgtagttcatctatagcattttcacttaacaccacccagctaatgacttccacctggcaaccttcatttaatccagaacttaggacctcgagtccctgtacggcccatgttccacaggatgggccgagggctcagctgttcctcatagacaaggaatgactctccacattggccactcccggattccctagctcaggacacatattcaggtgtgtctaaggctggctcttctatgtgaagttacttattcttttaccattgactctcatgttcccactatattaagtttttctgaattactgtggcaataagaaacggtcccttaaattatactagaagaaaagctttttttttgttttgttttttattttgaaattatgttaaattttttttcttaactgagagattccacctgcataaatcgtcataacttttaacagtaagatcttagacttagaaagtgatgtttttcctcaacagaatttattaaaaatcaagacaccaagctgttccaaacaatagtttgaggggaaataaaataaacaactccataaataatcttatgttgttaaacatgtctctagcaaaacaaacaaacaaaaaagtcgggggttgggggaggtgcagtttattgccagtactgtctggtctttctcagaaaagcgtcagtgtacatcactgagcctggacggtatgttttcttgatctataccccctatgtgtacatgtgcttgcacgcacacacatgtagacacgcacacatgtgcacctgccatcactttctgctcttccgtcttttcactcttgagtgtctgtagccagtagctttccaggtctgtatagtcaaagatacctatggccctgaatgtcttcactgattgctatttgacattcatacggtttttaatggttaaaaggctttatgcgaaagctgtgatagaatttctcctgttctagatgtggtgtttattgctttattttgtgacttttctctcagtagattgaccttctccctcagtgtccaagcctcgcatagcatgatggcacctgtaaactcagttctgtatcctggtatcctttctcttcccaagtagaagcaattaagtaatatatgtcatcaaaaccttttaagtgcacatacaaacaaaatcaacttaccaaactgcttcaaagttgttccatgtttaacactcttctttctgagctctgggtagaatgtcctattattgttcatcatgaatatttgaaattaaagaaataaaactgtaccattttctttaagagcatccatttgtacttgataacatcttcagtcatatttcaatgctggcaaagaggaggggagttctaaactgtgactcaattttagaatctactttttccaaattattctgtttagtgcagaaaactaattaatagtgttgcatagaaaagtcactgaagctaagccagttattacttcttaatgcatgatttactgctttaagttttcaaaacacaaccatagcaatgtggtattaattcaagtgattcttcctatcatattgaacgatattttcacgggtgaaaaactcacacatcctacatcactgatagtttatacagtgttttagctgtggctccctgcatgcaaaataagagttaatcaaatgtcagtgagaaccatctcatcaagtagagggcttgttttgtttaaattaactttgctaagtataaatttcttcttgaaaataaattctgggccgggcgcggtggctcacgcctgtaatcctagcactttgggaggccgaggcgggcggatcacgaggtcaggagatcgagaccaaactggctaacactgtgaaaccccgtctctactaaaaatacaaaaaatgagccgggtgtggtggcgggctcctgtagtcccagctactcgggaggctgaggcaggagaatggcgtgaacctgggaggcagagcttgtggtgagccaagatcacaccactgcactccagcctgggtgacagagcgagactccgtctcaaaaaaaaaaaaaaggaaaataaattcttctgtatttttctttcttcaagtgaggccatttaggggaaagtataccataaaacttgctctaagataaggcaaatttggtattataggatgaagtgctatgtgatttgaagtaatgctgaattttttaaatatattaaactaaacaagaataatgaggccctcggaaagtcatgattatatttctcatttttctcattttaaagccacagtgaaaaacacataaaaggaagaagttagaaaaaaatgaatgaaattctttttttccttttggcaaattaaatagatgtttctgtttcagaagattttattaattaactttaaagaaacagtcatttatttttggcattcagtgaacactatcatttccatgtttagaacttctcttctaagttagcatcttaaaagataactgtgaaactcaaggcattcaactacattaatttgagtttcagaaattgaattcttgtttctagagtacatagtttgaattgatgtcagggtgttaaatagataaatcttagcttcctaggttgtatattcacactaattatttttttatcagccttcttatttttcaacttaccttattctttttgtttttttgacactcagatttgatagccctgtggtagaagaaaacagtaatacagtttggtttgttgttgtgtttgtgtttattttaaagtcacggctttgctttccatgttgttactggattatgctttttttaattcttcagtttgccaagataacagtcttccgatcttcagaagtctgtatcaagcttaaggaaactgatgtgtaggaagactcgcctaagaagtccaaattagcaaggctagcatgtgaggacatgctggaaaagaatagttcccatagatattgacagagaatgttcataaaatgctacttgttttgtggttacatgagagtaacttgtgtccagtgcagctgtatgtaagggcaacgtttttattctgacgactctgtggttttcatgaccctggatgcttatcatgtctctctgttggacttcttcaacggagttgatacaaatacttgcttccaagtgtccatctgccctctcctccatcctggccccatacaaatacgctacatttttaaataatttgaaataccctcaatagtatttatatttcctggtgcttcattctttccataagaactgtgataccattattctgtaggatttttttgtgcttccccgtttcacatctctgtgccagtgagacccatatatcggtgcaaatccagaagtttgattgtccatctgattagcacactgttagcaatgtggtggactaaacacagccaagatgtggggctggagcttagcctcctgggagcagagcggtgaacatcagatgaagacatgtgaaaatggagtactacttcctcttcctggggatgggctaaaaagcacagccagaaatattcttgcccttccagtctgctttacagttactcactggttctcttttttttcctactcagataaccagtatactcttcccagtgactaagaactgcagataagtataggtgcaaatagatggcaaaccgcagatggcagctgtgtggtttcagatgtgctgcagaacttttagacgatgtgaacgcaaggaacttttttgctgagcagtaatctctacccactggaaattaggccctggggggaacaatgtagtgacttctatatacttactacatgcagttagacccctgaagcaaaagcttttaaaaacaggctgtaaaatgcccatgtatctttattaagcctattttccaactggatagagaaattttctggtaatttttaaatttgtaaagtctatttttttcctgagccaagggaaaaaaaatatctgggccctaaaagcttagttataacaatgttattttttctatctctgaatgattaaatgtgatttcatttatgtagcaatactatgattgtggctgcattagatcacgctgatagaaagatacaaagaaaaactaagtataatgaactaacaatttattttcactctttctctaagttaaaaattcccagtacattcaaatgaacaatgaaaataattgcagaattgtctcctgaaatggaaatagattttttttcccaagcattagcaatttcttgttatttttcaaaatcagccactaagcctttcagagcttcttggtgactattgcaggagaaatcagaatattaatcttgtggttttatttcagagttcgctgccaggaaggaggtataattgggataggagactttttttttttagctgtgtcactgttcaaggaggggggtttggaacctcagcataagaattacactctgtgatgaggatgtagcaggggagaagaaaggtgattttcactatgggaagctatacttacatcaagtataaaatagactgaagtcattttgaattacgttatacttgtaaagtttacctcctggagtttcagttagtaccagtgtactaactgggttaaaacagttcatggcaccttagatcatttctaactcatggcaaaaatctttcctggtggaacgtgtaactgtattttaaatgcccctttataagcaaccaagtatttgggatgttattttgatattagtagtgaatttttcagtatcttccagtaccctttgcaagtcacaggttgacttaaaaggaaaagaagcaaaatgctgaatatagcagaaaaactgtctgcattcagactgttcagcccacttttgctccccacgtggcaagcacactcccccaaacaagcaatagcctgtggcttcagaggaacctacaaaggcagcatctgtagatttttccttcttcaactctaagacttgaatgtttccctcttccccacacactttttttttaaaccaagaaataaaaaagttttcactcttaaaggtgcaaagcagtttcattcttatgcaacacagccttcctcctactgtcttatagtctgtggatgttaaattatagattccaattgaattttaatactctagagattttacatttgtggttgtcaagaccccgttttggtaaacctagggagctccgcacaaaagcattgatattcagaaaaggcactgacctacaaattaaaagaaaaaaaaatcaaataatgtgcacctcttgtgcttccagtttgacaaagcagaagtcatcagcagtttctccctctgcagacgcagttctcaattctatttacaagtaactgctctactgtgcctgtttttctcttgctgatactcatttaattgtttttcttttggatctgaatctttgactgtcttttccccctcaagattaaaataaatacatctgtattcctcccctttctttctgtgcactgcccttcagatctcattttgtcatttttcagcttagtgttgaaacttttagcaacaaaaagtcagttacttactttgagtaagtaactcaaagtaagttaactttgagtttgagtgcacttttgcgtgtaggttcatttatgtgcttgtgaatttaaaaacattgggattccacctgaatgaagtaaaccaaacattttaaactatcagccagatagagacatcagcctttcacttctttctatatgcagacatatcctaattttttagaaaaatcaaataggaaaattctcaacaattaattgaagattatagctctgctctgaaatggtccagaaataggatctgctcatagaaactcatagtttgaagcctctgggaggaaaggatactttaaaatttagtcacatatttggaggagggaaaagggaaagagcagaatgaagaactgaaaaaaatcacacaccggggcctgtcgtgaggtgggggactgggggagggatagcattaggagatatacctaatgtaaatgacgagttaacaggcgcagcccaccaacatggcacacgtatacatatgtaacaaacctgcacgttgtgcacatgtaccctagaacttaaagtataataaaaaaaaattttaatagccccattaaataattaaaaagattttttttagattcacagaagtgtacaaaatttttaggttttttttttttttaagctgtctgctgaatagtttcttaatggtctacaatgtttgtatctacaaacagatactgtctgcttcttactacccttccaagacaagtattattatggcaattattgcccagtttcccgggaaaaatttatccacagttacagaagaatgagatgcaattgtgagactgtaaagtttaagcaagcactcagagaagcacagtgatatgtatgcacagaagaggcagtctttgttttgaggaaaacagtgaaagtaaagttaattcaagaccacaaagacaagtaaataagtgccttatttttgtagttaatataatttcagtggaatgcatatttctaccataaatgcatatagaacttgtttgctgacctactgtttggaaaacaaacaatcccattagaagaatgtctttgggatttatttttaccagaaaatcaatccttttttcagtcccttgcaaagtacagtgttacaagccaagactttgataatcaggtagaaaatggatttaaattgcagaaatgtatatgaaacacttttgttccttgccccttgaactttaggggaatgaaaatgtctagcactctccaccttcttttctctcctggaacttgaactgtaattcaaagcctgtttctcattaaagtacctggcagcctatctctttacagcttgagttacaaagctattcagagacctcgctggtctaaagagacagaacaaggatgtgtttaaatagagcataggctgttgaaaaaaaaaatgctgaaaatggtaaaatgattctgtccttccttccactcctcactgctgaggtggagagggaattcagttggtgaacaccagcaagtggctggtaaaagtccccactttctctccagggctgccacaggacccagaatgagtggtgggcatgtgtgtgaaccctctattcagccagagttttcccgcaacaggtagtttggttgaagaggttgactaaggttgacattggcagtaataacacgtatgttcttctgatttacaaaacgatggaggaaaaaggggagattttgaagacctgatttctggtatacttcttaagcatgcataaggctgaaaaaagaagacaagggttgtgggaggctcctggtctagtgtttacagaacttggatgcttgacaaacagagcgtcaagctaattgttcttgaagcaggaaatctgcagtggaggaagcaggtgtggggggatgattaccacgtttggaaatggctgcattaactattttgctcttctgagtttggccccaaaagagtccatagactttttgaaggatgccatcccttttatttatagactaacattaaatcagtcatttgtgaaggaaggagaaagtgcctaaataaatttggagtcagatagcatacgtgcggcagtgtttccgatatccatttctctttatttctttttctttttctttttggctttcagcatccccatactttcagaaaacttgtgactaagagtgaattcttatttttcaaattgttttcagacatttcatgttcatgtaaacttggcttattgatttcctgatttttctttatttttttgttttgtccattttatttttaatcagctacatcaaatgggtctttggagggcctggataaccaggagggaggggtgtgccagacaagagccatgaagatcctcatgaaagttggacaaggtaaagaccatctgctgcttcatgacgccactgtgacctggtgtagcccccagctagtatggtgctaatgttgccgatgcccaccttcattcgctcttctttttagttttcaaagcaaacccttctgcactttgagccactgacagatttcctcaagtcaatgtactaagcttttattggagatctaagagttaagatcagcaaggtagaatgtctattgccatagatagatagatagatagatagataatagatagatagatagatagatagatatttctttttaaaaagcaaaacactttggttcaaaatcaaaatatccagaatgaaaactaaaagcttgtgcagttttgctcatttctgaatcttgactacagaagagttttgttcattgtgacttttccaatatagataacctattgtgcagaaagaaataattattcttctaattaaaaattggtatagtagtcaatcaacttgctcagttaaattgaaatgtcatctgcaatgctttgcctgccaaatgcaagaatccctatagtttccacagatggcctcacgttctaaacctctgaaataactagtataaccattttgttttaaaagaaaaattatattcttgtatttcacagtactttgcataaagactcttatgttcattgctattcatgcctgttgaaatatatatgcagctcctaaagctagatattgtcagatgtctgtgccgtaattaatcatttgtttttcatatagatgcaagttctgctggatcaaccaggaataaagatccaacaagacgtccagaactagaagctggtacaaatggaagaagttcgacaacaagtccctttgtaaaaccaaatccaggtataacagcatgatctgtgtgtatggaggtctgtgggtaccacattcttagtagtatcttaaaaggtagggcagagtctaaagacttctaaccagttaggattagctggaagttacagtgatcaggaatctttgctgtcagtgagtcattattaattacactcaataagaacaaaataactcattccaatgaaagtcatatattcaaaggagtagagttcatgagctgtaagtgccagttattagaactactctgtcaggccaaaggtttcattggctgacattttatcaagctggttgtcaactccagcttaaagctgatgttaatgtatatgtaattaatgtgctaatccctcatctaattatatctaagccacagagggtttaattgatcctcttctaaattttaaatggtaacatttttaaatattgcataatagtattttttcaggtggttatcgttattttgtttcacattttccatgtaaaagaaaatattaaacaggtccctgacaaaagtgtagaataccagataaaattgtccgtcgttgaccttcgttttcttaacagtcttggaacaaatagttctgtatttgttaccatgctaatgaaggttttatagagtagctgttgagcagacatcagcagttttgtattaggattgttgtgtgcttgcttggtcgttgtgcaaatttatcgtctgcagcaatattccatctctttccaagagtcaaggagggaagttgttatttctaactttcaatgacaagatgtgtcaaattcttgtgacaaactgataaatggataatataatgatgccaggcagttttttagtgcttaacatttgggctggcagtctgttcggtgtgagagtttctgctgccttccaaatatattttaagtgtaaatcaaataatacagacgagttacgagctgaacattttcccaggccccctcactccttccgcgttcccgagctgttctgttctgccaggaggcagggctcttctttagaaggcaggccctttgaaggtttgcatgaaactccctttctcaaaggaggcggaagagcaataccacataaacgctcaccgctgacctggagaattggccacttccctttttcttccctgccgctgccccaggctggctgacacgggttagaagatgaagcaagatcaagggctggctgtcaccgacagtctgtgctcttgctggataatgatacaaaggaaaccctgtggcttgggagggtagggaagtccctcctagagatacctctcatttccttttgcgttgagctcttagacgaggtattggcgaggcaaagtccagcttctagttagttaataagcctggcttatttttcacatttttaagggtcataaaagcagtccgtctgcactgggacagcagtaactatctctgaccttttctgtctccgcgtctgcaggttctagcacagacggcaacagcgccggacattcggggaacaacatcctcggttccgaagtggccttatttgcagggattgcttcaggatgcatcatcttcatcgtcatcatcatcacgctggtggtcctcttgctgaagtaccggaggagacacaggaagcactcgccgcagcacacgaccacgctgtcgctcagcacactggccacacccaagcgcagcggcaacaacaacggctcagagcccagtgacattatcatcccgctaaggactgcggacagcgtcttctgccctcactacgagaaggtcagcggggactacgggcacccggtgtacatcgtccaggagatgcccccgcagagcccggcgaacatttactacaaggtctgagagggaccctggtggtacctgtgctttcccagaggacacctaatgtcccgatgcctcccttgagggtttgagagcccgcgtgctggagaattgactgaagcacagcaccgggggagagggacactcctcctcggaagagcccgtcgcgctggacagcttacctagtcttgtagcattcggccttggtgaacacacacgctccctggaagctggaagactgtgcagaagacgcccattcggactgctgtgccgcgtcccacgtctcctcctcgaagccatgtgctgcggtcactcaggcctctgcagaagccaagggaagacagtggtttgtggacgagagggctgtgagcatcctggcaggtgccccaggatgccacgcctggaagggccggcttctgcctggggtgcatttcccccgcagtgcataccggacttgtcacacggacctcgggctagttaaggtgtgcaaagatctctagagtttagtccttactgtctcactcgttctgttacccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatatacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctactttttatgtgctatgcaaaatagacatctttaacatagtcctgttactatggtaacactttgctttctgaattggaagggaaaaaaatgtagcgacagcattttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaagtgccttcaaagtacttttcttcttttcttttcatttttctttcttttttgtttgttattttaatttgccttcctttactctatttcccccaaaattacagttaatccagagacttctgtctatggacactgtgtgcccacttttcaaatcgggatgtgcacatcacacaaatattaattttgctaagagccgtgagctcgttattccccataaaaccacaaactctcatttcaaaaataatatgcaattgtataaaatcctaataatcctcaacagaaaatctctctagtggcacctgaattgcacagtcagaatagttacctacaaagttagctgtctcaggaaaaagagggaaatgtactcttatcttacacttaattccagatcgatctagtgtccatagaagcaaagcagcggtctatcgcttcatttttcttaacagaataatcctagggagaaggaaaaagtcaaatgtttttgtaaaaacttaacattgatgagagcacattttgagatactggttgaaggcaagccagaggccagctgtgagtttaaaacacactttcagtggtcatcttcctggggaaggtaactatgt

SEQ ID NO: 12325 - DNA, 3508 bp, Human
  misc_feature (1)...(3508): n = A,T,C or G
hctnmgahtvkngthrntsndstartsndndchrgarntgastartgandaaaggcaagaggaaaataatccatgtcctgtgcagcaacgggtcgccgagcctctccacagctctgtcaggtgggcagaataccaagaggccagtgtcagtcttcactgagaattcccattctccctgaaatctctgcctggctgtccaaaatgttcattacaaagttaacatagatgcctgaaaacaccagagaggccgggcgtggtggctcacacctgtactcccaacacctgggaggccaaggcggcaggatcacttgaggtcaggacctccaggccagcctgggcaacatggtgaaacccccatttcgactaggaatacaaaaattagctgggcgtggtggtagtgcacctgtaatcccagctacttgggaggctgaggtgagataatcactcgaacctaggaggtggaggttgcagtgagccgagatcatgttcagcgacagagcgagaccccatttcaaaaagaaaaaaaaagagagagagagagagaactctggaagctaaacttgtacattggatagaagctggtatgtcaaagaaatgaaaacaggtttctctctgcttttttaagtataaaaagtattattattttcttaaagatcagtccagtccttgtttggcattccttggtgtaataacatgggagttttcttgtggagttttacattcacatttacataagattttattttattttattttatttatttattttgagacagtctcactctgtcgcccaggctagagtgcagtggcacaatcttcacttactgcagcctccgcctcccaggttcaagcgattctcactcctcagcctcccaagtagctgggattacaggtgcccgctaccaagtctggctaatttttctatttttagtagagacggggtttcaccatgttggccaggctggtctctaactcctgacctcaagtgatccacccacctcagcctcccaaagtgctgggattacaggcatgagacaccatgcctgacctatgtaagactttaaatctcacgctcgctgttgagcgttggtttgggatgtgtgcctgggggaaaatcatccccctcagattctcctctgtgaggagctgcagggtttttccttcttcctcagcctcaggcttaggctgtgtcctagaaagaaggccctgttgttttagtccatagcacttgcctggaagtttgtatatctgtgaattcacttcctaaaggaatgctttgtgactttattaattaagaagaagaaaaatattttttatctgactctttggagttgatagttttaatctaattatctagttttcacatttttcatacttccttttcctttatttcctaccaagactgcatggaatgtagaatatggttctcactctgtcacccaggttggagtgcagtggcgcaatcttggctgactgcaactttcgcctcccaagttcaagcgattctcctgcctcagcctaccaagcagctgggatcataggcatgtgctaccacatccagctaatttttgtatttttagtagagacggggtttcaccatgttggccaggctggtttcgaacccctgacttcaggtgatccaccctcctcaacctcccaaagtgctaggattacaggtgtgaaccactgcacccggcctggttagaatatttttaaagacagatgggaagctgctgtttggagagctaaataacataaaccactatgggattttgtgtgtgtgtgtgtgtgtgtgtgtgtgtgtgtgtgtgtgtgttgggggggtgatgtttctgcctaggtattctttaaaatacggtcatgtgtcacttgaagacatggatatgttctgagaaatgtgtcattaggtgattttgtcatgtgaatatcatagagtatacttacacaaacctagacggtcctgcctactgcacacctaggctatatggtacagcctattactcctagactgcaaacctgtacctcaggctactgtactgaatactgtaggcaactgtaatccaatggtaaatgtttgtgtatctaaacatctcgaaatatagaaaaggtccagtaaagatacggcataaaagataaaaaatggtatatctatctagggcacttaccatgagtggagcttgcaggatggaagttgctctgggtaagtcagtgagtgagtggtgagtgaatgtgaaggcctaggacattactgtgcaccactgtagactttataaacactgcacacttaggctacactacatttatgaaaacaatgtatttcttcaataataaattagctctagtttactataactttttaaatttataaacttaaattttcaaactcttcgactcttgtaatacctcttagcttaaaacataaacacattgtacagctgtacaaaaatattttctttatatccttatgctataagcttttttctatttttaaattattaaaaaaaattttaaccttttaaaccttcttgttttttaacaagaagaaacaaacacatacattatcctaggcctgcacagggtcgggaatcatcaatatcactgtcttccacctccacatcttgttccactggaaggacaagcatgtagctgtcatctcctgtgataacagtgctgtttctggacacctcctggaggacctgcctgaggcagaaggagtacattctagaataatgataaaggccagatgcagtggctcacgcctgtagtcccaagactttgggaggctgaggcgggcggatcaatggagatcaggagttcaagaccagcctggctaacatggagaaaccctgtctctattaaaatacaaaaattagctgagtgtggtggcaggtgcctgtaatcccagctactcaggaggctgaggcaggagcattggttgaacccgggaggcagaggttgcagtgagccaagatggtgccactgcactccagcctggatgacagagcgagactctgtctcaaaaaataaaataaaatgacagtagaaagtataatacagtaaatacagaaagcaggaactgtcgtttattatcaagtatcatgtactgtgcataatcctatgcactgtacctttttttttttttgaagtggagtctccctttgtcgcccaggctggagtgcagtgggatgatctcagatcactgcaacctccgcctcccgggttcaagcaattctcctgactcagccttctaactagctaagattacaggcgtgcgccaccatgcctggctaatttttgtatttttagtagagacggggtttcaccatgttggtcaggctggtctcgaactcctgacctcgtgatccgcccgcctcggcctcccaaagtgctgggattataggcgtgagccaccgtgcccagccgcactgtactttcatatgactggccgtgcagtaggtttgtttataccagcatcgccacaaacaggtaaggcagacattatgacggc

SEQ ID NO: 12326 - DNA, 7952 bp, Human
agagattattttctgtgctgggggaggcctaggagacagagtttggatatggtttattgatgctccctgtttcctctcttcagacttccatggagtcactgattcatcactttaagttgtatactgagggctaccaagttcctccaggagccacatatactgccattgaggctcccaaggtaaggagaggaggggaaggaaaagaccatatgtagagtaggtagctaaagatagatgtttaacaaatagctcattcatcaatgagagagaaaacagaatgaatagaggttttgttggcagagaaaaatactcttcatgttaatacagacacccaaccttcttccttgaacagggagagtttggggtgtacctggtgtctgatggcagcagccgcccttatcgatgcaagatcaaggctcctggttttgcccatctggtaagaatcaatcccagtaactataactccaatgaattaaacctgaccttggttgaggtttttatgaactcttctttctcctcccaccttgcaagtcttaactaacattgttgccatctcaatctccctaggctggtttggacaagatgtctaagggacacatgttggcagatgtcgttgccatcataggtacgaggcctattgtgtagtagaggtatcctagacaaaggagttcgggacgcccactggggacagaaggagaacacttcctgttcaccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaacttctggtatcttagtgtctcagtatcttagtgtccttcactcggactgtaaacctaagaatgttcattaaccctccattcctgttagattcagtcaggtcttagcaatttttcctgctcgtctccacccccttctctgactcttgtcctttccacttctctattccccatttcctctttcgcctcagttccctccttgcccaaaccttctcagtgcccacataacttggtaaaccactcaaatcaagacctggggtaaagttgggagggaaagggctatagtggggtctgagggaatgttgacgggcagtttcacacagataaatctctgaaccagccgggcgcagtgcctcacgcctgtaatcccagcactttgggaggccgaggcggatggatcacctgagatcaggagttcaagaccagcctgatcaacatggagaaaccccatctctactaaaaatacaaaattagccgggcgtggtggtgcatgcctgtaatgccagctactcgggaggctgagagaatcgcttgaacctgggaggcggaggttgcggtgagccgagatggcgccattgcactccagcctgggcaacaaagcaagagtccgtctcaaaaaaaaaaaaaaaaaaaaaaatctgaaccaggtggagtggaaaatggcagatgtagacagcctttcctgagcgtgaaagtctcctcattctgtgggttaggagttggtcattgaagggctgacgcttaagagcccagatctcccaactcccttagttggcccttccgggagccgcccggtctcttgtgcaggaaggggaaggggccaaagcatgggggaaggcgtggcaggaagagggggactctgtggtcagggaactgctcgctgagcacagctgcacagtgctgtcagaacggccgatctccagcccaagatgattccagcagtggtcttgctcttactccttttggttgaacaagcaggtaagagggtttggtgagggatagcgtgagctggctccagggtggaagtccagagcttgggtctgagggccaagtcaaacacaggtgaaggaaggctgacagtgggtaggtgggcatagggagaccctgaggctagtcctctccagccccgacccagggcactagactcatagttccctcctttcttgttgccttcttacttcattccagacttttctccgtattattattattattttggagatggagtcttgctctgtcacccaggctggagtgcagtggcgcaatctctactcactgcaacctctgcctcctgggttcaagcgattctcctgcctcaggctcccgagtagctgggactacaggtgcccgccaccacgcccggctaagttaagtatttttggtagaaaccgggtttcgtcatgttgaccagggtagtcttgaactcctgactcaagtgatccacccacctcgacctcccaaagtgctgggattactggtgtgagccactgcacccagctattattattattaaaaaaagacagggtcttactatgttggccacatccgtcttgaactcctggcctcaagcaattctcccacctcggcctcccaaagtgctactgtgcctggctgacttttctcttttcagggttgatagaaagtggcaggggaagggtctggttgtatggcatgaagagctggtctggtgaaacgcctcatttctcatgatgagcatttcccatggggtgcctttggtcttgtctgctgggagctgatctctagctggtttaatatacaaagcacccttggtgcctataattccagctactcagaaggctgaggcaggagaatcacttgaacccaggaggtggaggttgcagtgagccaagatcgcaccactgcactctagcctgggggacagagtgagactccgtctcaaaaaaaaaaaaaagattttacatatatatctctatctatctatctatatacacacacacacacatacacacacacacacacacacacacacacacacatatatatatatatatagagagagagagagagagagagagataaccctttaggaaggtaggactctgttcttgtgcttgggagtaaggcaaggatatagccaagacaaacagatgggattgctgtttctatgggtcattgttaatgctccattctgtcagcagttgataatgagggtgggcagcatgagatccccagttccagagacctgagcgtcagctgagaaatagaggcagaaatgggaaggtctctgaagctctacagctccagccactatctaagaattctcactcctcgttcactctgtgttgtctgtgctggattggtgtgtgtgtgttggtggcagctgggtgttggggaggaggaggtcagtaaacttcagggaaactgtggaaattgaaagagaatgactggggaggaattccagcagcctagctgagaaggtgggagcaagtattaagttagccactggtctgctgccgtgggatgaggagggaggaggcccgctgaggcacaaaggaaagcatgggctttagaggcagaaaacctgcatttgagttccagctctgtcacttaactctgtggctctgagtgagttacttagcttttccgagccttggtttcgtcacccataaaatggcgatgatgatgtttccctcacagggtagttttaagatttgtgcaatatcgtgtgtgtgaaagagtgttgcagaataaaaagtacttgaccgatgtcagcaattgactgacgttagtcacatgttccctactggtcctctgatacggggtgagagcagtctctggagcccagacttgatttgattttttaaattgcacaaaacttcccctctcagagacccagagagtgagtaatagggcagagtaacaggagctggaatccatatagctgtggtcattcccccagccttgtgttcagggccaaaggtatctgtaaggtctgggaaaaacagacacactttttttttttttttttttttttacatatttaagtgtcttgtggtgggacagaaagcaacaaggctgaggctaggagatgaccaatgatagagtaattgccttctctcccttccccagctcacatccttcctgtccagccctcagccacaggtcacaggacttagtagagacacttctgtggtttcttcactgaaatttgccactacctctccctcccactacccatcttggctgaggttttggtttcagtccagtggactcagatgggtcccttgaggtggataaagtgctcaatggtgcctgaagaacccacagtgctaaaaagaaaaggttgggggctgagggggaaggcctcaattattagtccgtgtgagtcccatttcaatagaaccctcaagcttcctatcctagcctgaccctatggtgtgggaggagggaaaggtaagggcagtggaaggccagagagaaacagaatttcttcccttagacggctcccctccaggccctgtcctacctcccagagccccttcccttctctcctctgagtaccagatcctccctgatacccccgaccccatgggcatcctctatcccctcagcggccctgggagagcctcagctctgctatatcctggatgccatcctgtttctgtatggaattgtcctcaccctcctctactgtcgactgaaggtagcgctgggcagggtggggtaagggctggaaggggaagtgggaggagggcagcagcaaggattcgaagagaaggaataaaaggggatcctccacaaagtttggagggaagggggatgggccattaacttaccctttactgataacctttcccccattccagatccaagtgcgaaaggcagctataaccagctatgaggtatggaccctcctacacctggtgtggacaacttttcagaccctcagccctcctggggctctagcctgggtttccgggcctctgggagggcctgcctctcaggtgctgatctgcatacacctcagaggcctccctcccaccttacctagccaagccacaagtaaaatattcagcaggtgacagggaagaatcaagcatagagtgataaagaatatgtgagagacttggatgtagtatgtcgggtgtatatgtgtgcttgtagccatgtgggcaaacaggtatccatgtcccagagtgtccatgtgagtgccctctagcccaaggtggctggctgcccaccccccatgcctccctgggtggggcagatgctgaggggccctggagaaagtgtgggtctttaatgttttgcttcttttgtctctgcagaaatcagatggtgtttacacggtaagtgtgcctacctcccccacccaggaagtcagcagaagagggtgggattttgagcgatctttggaaggccggtggggggaggggggtcctgtggaggtgggaggggcctctgatggactccagctcctgatcgccctttgactcccatctccagggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactggactctattcattcattcattcatttatcatagatttattcagtctctgctaagcactagatacagcttttcagttccagaactcacagtctaatggacttcagagctattttgctcgactgagggataaatgctgactatggctgggggagggataaaaacctttgacctgtaggtgctctgaggatggagctggagcagggactagtgtgttgggagtctaggcatatttggaaacataagaaatgacttctgtatcagcatggccttctgtgttcgacaattgaaccaaggttgggttgtaggggagcctgggtgtccccagatggccaccaatccagacagcatcaatccagtacatgcatatgggaattagcatagctgaaaagccaaatatgcagaacggatggtgtaactagggctgagtgaagctcctaatggaaggttttatagcaacagtgaattttcagggcatctggggcaagtgggaccttagagggccagatgggtcagtggtaggtaaggcaaagggaaataagttgggtccaaatgggggggtcatctccttcaagtgcatgggtggtggtcaaggccctgtcaatgcctgtcctgttttcagagctacgaggaatatttgcctgaaagaatttaaacctcaggagatgctgccagtcctactcgtgacccagtcttttcagaatgggtctagagactccaagcttacccctggcataacccccaacctccacagtgctgcacaacacttcacactgcatagtgacttacacttttcaaagtattttccagctcattgtaccatttgatctgctaattaaccctgtgaggaaattcaggctctttgaagttaattaacctgtccaaggtcaccttgcaaggaacggactgagatcactttcgtctctgcacattttgccacatgagaagaagcagatattgggaaagagaaggggtagtgagtaatcatgaatggcgagggtcttgaaggccagatgaagcaggttgatcaatatctggaaggaattggagccatctccggtgtctggcgggggaaaggtgatttcagatgagataagagaaatgagccagggtaggaaagtaactttttttttttttttttttttttgagatggagtctccctctatcaccaggctggagtgcagtggcatgatctgggctcactgcaacctctgcctcccgggttcaagagattctcgtgcttcagcctcccgagtagctaagactacaggcaccaccatgcccagctaattttttttgtatttttagtagagacagggtttcactatgttggtcttgatctcttgacctcgtgatctgctcgcctcagcctcctaaagtgctgggattacaggtgtgagccaccgagcctgacctggaagtaactcttttaaagataaagtgggaataaacttttattggaaaatgtttcattttcctttgctctgccttttgggattgtaagtctctccccatcaacccggactgatttccattccattttcatttaatccaggtatcacagctcccaaagtttttctagtcccacatgtccaccgaattggatacttgccaggcctttaaatggctaccacagctactacttccaggctccaagatggctaccaggccagttctatgaatagtgcctggatagcagtggaggagaggcttggaatgggtcttccacagacagtgtctagataagagggtttttgttgttgttgttgttgttgttgggatggagattcactcttggtgcccaggctggagtgcaatggcgtgatctcgactcactgcaacctccaccttccgggttcaagcgattctcctgcctcagtctcttgagtagctgggattataggcatgtgccaacactcccagctaatttttgtatttttagtagagacagggtttcaccatgttacccaggctggtctcgaactcctgacctcaggtgatctgcct

SEQ ID NO: 12327 - DNA, 8073 bp, Human
gagcctggtgctgccgtgaaacagaggctgattttagcccggaaatgtagctgcagatcaatggcccttattagcattttctgaggccaataatctgaccactatgaaaacgtgactaaaggtacgaactctctgcctgagaaaaaccacatacaagaaaaagtttgcctacaatttccggagctttgtggaccagtgtctatagacaccaagctgagaacccccgctataagtcactgactggtggtacccagatctcaatatcttttttttttgacggagtctcattttttggacggcgtctcactctgtcgcccgggctggagggcagtggcacgatctcggctcactgcaacctctgcctcccgggttctagagattctcatacctcagcctctcgagtagctgggactataggattacaggtgcgcaccaccacatctaatttttgtatttttagtagagatggggttttgccatgctggccaggatggtcttgaattcctgacctcaggtgatctgcctgcctcggcctcccaaagtactgagattacaggtgtgagttgccgcgcccaggctcaatttttttttttttccagacagtcttgctctatcgcccaggctggagtgcctggagtgcagtggtgccaactcggctcactgcaagctccgccttctgggttcaagtgattatcctgcctcagcctcccgagcagctgggattacaggcgtgaaccaccatgcccggctaattttttgtatttttaggagagacagggtttcaccttgctggccaggctggtcttgaacttctgacctcctgatccgctcgcctcagcctcccaaagtgctgggattacaggagtgaaccaccgcgcctggccctcaatttctaattcagtattttcctcactacctatgctattatggaatcttgtgagctatggtcaagacattcaagttctggttctgagtaatctgagtctgagtaaagcgactgtaatatctatttcacagaactgaaaaataagaaagatgatgaatcaaagcatctagtgcctagcagggagtattttgctcaacaggtatttgcttccttcctaaggctgtagggaagatgatgagataatgtcttttatgaaagagggctgtaaacgtaaagatctgtacaaatgttaacttcattgtcaccggtcagccaatgcttctaaaatccagaacataacaactctagagaagtaaactgcccccattgttctgagacactggaattcaattcagtaaacaatcacggcccccttcccccaaaatgataaagacaatcactgccatttattgagcttccaattacgggccctctgtttggcactgagaatacaaagatgaatagacatcatcccagagctagatgcgcgtcagacggtggtcactaggaggcgtggccgaaaacaaagaagtccatggaacgtggccagagatctgtacagaggctgtgggcgctcctaggaaagtctggccaagtgcctgagagttggaagtgcttcaccaataaacatttgcccagggcattgtaggatgggcacgggttcggcagaagaactttccaaataaagataacacaccaccgataacagagatatacaaactggaaggtattcaaaattcgccccacgcctctcgcccttagaaatcgcgagctgagaaacctaaggagttcatggcaaggggcttcccccttccccacccttcagcccaagccggaggttccaggagcgtctagccctctggatctccggcgtctgaggagataagcgcggtgtgggtcagaccccgaggggtcctcgcatctccgtctggaactcccctcaacgctctcaccattttgccccgcgaaggctaatccgccgctccgccaccggaagaacacgtcggcaggagcaggcgcctagcacaaccggaaaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcggtaataagttccaccttatggggtcgtgttgtatttttcctaagaccttggacgagaaacatttctgacacttgagttgtttaggcccctttcctgcctacctgtctgtgggacgccgtgaggggatcaagggctacatggtctggtcctcagtccacactccagcagcgcggccggcttgaggcaagagccgaagggttgaacaggcctggagaggggacattagaggtttctgtctgttgtctcagttaaccctggcagcagccctgagagacaggcatggtaatcgttcttcttctgtagacgagaaaataaacctcagtggcttggtaatgtcacacggatggtaaatgccgcgcctagattcaaggccagagcttttgccgctgcagttcacaggggaattattcatattaatcaaatgaataattcattgtcaattaattattaattgattaataatccagggatggacctggaaggacgcgtgagaggatggcgagaggagggcacagctaaggaaaagtgggaaaaggcgggccttattccagctttctgttgagatcccagaatgtagggttaggttgggaaccagaacatgaaagatcgtgatgccatgctgaagtgtttggactgaattagaaggaagaattgaacagtcattgatgctctagaaagaaccctgtgaagaaagagtgggaacaatgaaaaggcctgatggagtctttcgtttcttctttctcttttcttttgtcttcttttcttttcttgacagggtcttgctctgttgcccaggctggagtgtggtggcacaatcatagctcactgtagcctggaactcctgggctcatgtgatcctcccaccacggcctcccaaagtgctgggattactgcccagagcctctgtgcctggccccagtagaatatttcttggagtattggacacataccaacagtgggcacaagatgagttttttatttttttgagacggagtctcactctcttgctaggctggagtgcagcggcacaatctcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaatcctttttaatagttatacatttaatacatattaaaatataactaatagaacacaaatattattgcttatgagttttccagtttagttttttaaaaaaaattctaagtgaatgaaagtacgggttttagttggaagtagcaaaaatcgtgagggtgatttgggaaacactgctatctgggaaacactgaactctgaagtgcaatactcttttgagcccagtgactacagcatgccagacccctaaatcaggacctggggaggagccatggagttaacatttcagactgagtggtggcgagaaaacgcaaagggaaagacttgaaactctagcaacattataataaaagtagaaactcttatgtgctgaggcgatgatgaagagagtttagagaagcttgtgagaaagccacatcacctccattcagatatgtttgcaatcctttttcaaggctgccttattagtcagggttctccagagactcaaaacaaatcagatctgtttgtttagctggtgtatttgcctgtctttcaggtctgccattatggtccctggactcctcaagccaggccaagcatcctggccttctgtggtccttgatggagacctatgttgcaggttttttttgtgtaataaataatgctgctaccttagaatatcaacagtatcttatttctctaagcacgtggttcaatttctggtactcgttgagccttactattgagtaaattctcctgctagactgagttttttgagaatggggaccttgttcatctttttatctttagcagtgctgacatggtgtcctttttgttgtgtggaatttagttgaaggcatgaagttggtgagataacaccagttataacctttctcctttcctccgtctctgacttgcctttcttttttagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggatacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaatgtcatgttctttgagaacatttgaaaatatcccaagtgaccatggctccaaatagctttccttttcactcttaacatgctgtaattgcacttgattaacaatgggtggtttgagagtggccacaagatggcaccatgctccataaaatggccatagcagctagatggaacttcagccattaggaggaggatgttttgtttattttattttgctgggagaggagttttaatacgttgaatagatttctagtctctcactccatgagatcaaaggagtgcctttaagaaagcctcacaatttagatcaactacctcataacatccaagcatttactttgccactacttgtaaactgaaagctgccattcagaaaccattttcttgttccttttgtaacatcaaatccaagatactgtttcccatagagatggcatgtttttgagctttgaaagttttataatcctgataaagcttggcccatttgaatgtctgacgttttagcattcctgtcagggccatttgaagttaacagggacacttatgtaactgtccgaaatttaagctggcaatgtcttgacagattaaacaggtagggagcctgaagaccagtagttttcaagtcttttaatggagaaacctattcttcaagtgtaatcttatgtgaaactttaggatgtacaggttcctctggttgaagctggaatgggataaagtttacccagcaacggcctcataactagggtactttttgaaaactggtgttgacaaaaagttctatcccaagggcaggtaacttttgaaactgattttcccagattataccaagccacacaacttatttgagctctattttctgattcaggtagattgcttctaaatctgcagtaatggtgataggaactaaagacggtaagatttcttttttttttttttttttgagacagagtctcttgctctgtcacccaggctggagttcagtagtgcgatcttggctcactgcagcctcagcctcctgggctcaagtgattctcccacctcagcctcccaagcagctgggattacaggcacaggccaccatgcctggatgatttttcaattttttgtaaagatgggatctcactgttgcccaggctggtcttaaactcctgggctcaagcaatcctcccgccttggcctcctaaaggctaggattacgtgtgccattctctcccagtgctgggattacaggatgagccaccttgcctggcgaaatgttaagatttcttaggagttattgcctcagtgcagtagctcttaataattaagggcttataccctgtggtggtcaagaatgtagtggttttcttttgtcttttgaaggtaagtttgtctcctatagaattttgttaatctgactttctgtgtgcacactgcagggaagattaatgatgcctacaaatgtttttgctcagagctgttctagttggatggttaagaggcactgctctgcagtcaagctctgaggga

SEQ ID NO: 12328 - DNA, 5228 bp, Human
acaaagatactaaatgagaagagcaactccaagacacataattgtcagatccaccaaagttgaaatgaaggaaaaaatgtcaagaacagccagagagaaaggtcgggttacccacaaagggaagcccatgagacaaacagttgatctcggcagaaactctacaagccagaagacagtgggggccaatattcaacattcttaaagaaaagaattttcaacccagaatttcatatccagccaaactaagcatcataagtgaaggagaaataaaatactttacagataaacaaatgctgagagattttgtcaccaccaggcctgccttaaaagagctcctgaaggaagcactaaacatggaaaggaacaaccagtaccagtcactgcaaaaacatgccaaattgtaaagaccatcgaggctaggaaggaactgcatcaactaacgagcaaaacgaccagctaatatcatgacaggatcaaattcacaaataacaatattaaccttaactgtaaatgggctaaatgctccaattaaaggacacagactggcaaattggataaagagtcaagacccatcagtgtgctgtattcaggaaacccatctcacgtgcagagacacataaaggctcaaaataaagggatggaggaagatctaccaagcaaatggaaaacaaaaaaaggcagaggttgcaatcccagtctctgataaaacagactttaaaccaacaaagatcaagagacaaagaaggccattatataatggtaaagggatcaattcaacaagaagagctaactatcttaaatatatatgcacccaacacaggagcacccagattcataaagcaagaccttagagacttacaaagagacttagactcccacacagtaataatgggagactttaacaccccactgtcaacattagacagatcaacgagacagcaagttaaaaaggatacccaggaattgaactcaactctgcaccaagcggacctaatagacatctacagaactctccaccccaaatcaacagaatatgcattcttctaagcaccacatcacgcttattccaaaattgaccacatagttggaagtaaagcactcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaaagcccacaagagaaagcaggaaagatccaaaattgacaccctaacatcacaattaaaagaactagaacctatagaatgggagaaaatttttgcaatctactcatctgacaaagggctaatatccagaatctacaatgaactcaaacaaatttacaagaaaaaaacaaacaaccccatcaacaagtgggcaaaggatatgaacagacgcttctcaaaagaagacatttatgcagccaaaagacacatgaaaaaatgcttatcatcactggtcatcagagaaatgcaaatcaaaacaacaatgagataccatctcacaccagttagaatggcgatcattaaaaagtcaggaaacaacaggtgctggagaggatgtggagaaataggaacacttttacaccgttggtgggactgtaaactagtttaaccattgtggaagtcactgtggtgattcctcagggatccagaactagaaataccatttgacccagccatgccattactgggtatatcccaaaggattataaatcatgctgctataaagacacatgcacacgtatgtttattgcggcactattcacaatagcaaagacttggaaccaatccaaatgtccaacaatgatagactggattaagaaaatgtggcacatatacaccatggaatactatgcagccataaaaaatgatgagttcatgtccattgtagggacacggataaagctggaaaccatcattctcagcaaaccatcgcaaggacaaaaaaccaaacaccacatgttctcactcataagcgggaattgaacaatgagaacacatggacacaggaaggggaacatcacacaccggggcctgtagtggggtgctgggagtggggagggatagcattaggagatatacctaatgttaaatgacaagttaatgggtgcagcacaccaacatggcacatgtatatacatgtaacaaacctgcacattgtgcacatgtaccctaaaacttaaagtataatttaaaaaaattaaaaaaaagagcaaagctggaggcatcacactacttgacttcaaaatatactacaaagctatagtaaccaaatcagcatggcactggcatttaaacagacatttaaactaatgaaacataatagagaacccagaaataaatccatgtattcacagccagctgatttttgacagagttgccaagagcatacattgggaaaatgtcaccctcctcaatgaatgattctggcaaaaccagctatccatatgcagaagaatgaaactagatcccaatctctttccatatacaaaaaccaactcgaaatgtattaaagcgttaaatgtaaggcccaaatacaaaactgctagaaaaaaacataggagtaatgcttcaggacttcaatctaggcaaagattttatggttaagaccacaaaagcacaggcaacaaaaacaaacatagacaaaatagactatattaaaataaaagctctacacagcaaaggaaacaacagaataaaagacaacctgtaaaattggagaaaatatttgcaaactattcatccaacaagggactaatatccagaatatacaaggagctcaaaaaaatcaacagcaaaataataataataataataatcctatgaaaagggcaaaggataggaatagacatttcttaacagaaaatggccaacagagatatgaaaaagtgttcaacatcattaattatcaggaaaatgcaaatcaaaaccacagtgagatataatctgatgtcagttataatgctattatcaaaaagacaaaatataaggaatgctggtgaggatgcagagaaaaggaaactgttattcactgttggtgggaatataaattagtacagcaattatggaaaacagtatggaggtttcaccaaaaaaaaaaaaatagagctaccacatgatccagcatttccactactgggtatttattcaaatgaaaggaaatcagtatatcaaagggatacctgcacttccatgtttatgcagcactacccacagtagcaaagatatgtaatcaacctaaatgttcaccaatggatgaattgataaggaaaaaaattacatatatacattcacacacacacacacacacaaatatcacctttacctttctcacatctacccaggatctcagaggcactgctcaatcttagaagtaagcctttctgccaggaaacatgaaagaccttgaatcttttttcaaatctttctctgccatagccagggcttgtgcattgcctgtttccctctaactactctgatgagaagattttaatcaactcccagtgattttgctacagcaaagtatgcatttcaggaccctctgaggggttcactctttcctttgtcaccttttctttcctacaaaaatgacaacacaggccagttcttggcaagaaagcatctggctccctgaagacaactgtggttggaagacaatgactctggcacagccctctctcagcaccgacacttaataaagcaatcacaagttcatcagtgggaacttcccaaggagcttccaaaatgtccttttaagagtgattttaaggtagctctgagggtctggagtgactcagtactatgctggtctcctacaaagccaagaggaactagattggttactgactagagtagcatcagaggaaatgagggggatttgacccagcaacaactggcaactgccttctcagaggatttgcattgtccgcggcttatggggcccagggaggaggtggaaaacgtcctacattaatgtcccaacatcccagaggagaaaaaaattataactgacggaaatgtaataaaacagtcaaaagcagatgtaaccagctatagatattgtgaaacatattggtctttttgttcaaatattacaatttttattaaaataaaaaataaattaaaagtatgtgccccactctactcatatatattcccctctccatctgaatgttctctctaatccccatcctctggcaatcagatttttttttaaatgtattacaaaatatacacacaagagaagttgataaaacataaatggagagtttaaagaataattataagttaaacactacattttatgtcgggaaattgggtttgttcaacactactgaaatctgccatatgtttcttcctactcaaaatgctctctctgtcctccaattccagagttaactactattctgactttggtgataactatttccttgcttttcattatacatttaccatatatatacatatatatatggtacatgtatatatatacatatatacatatatacatatatatgtatatatatgtatatgtatgtatgtatttctatccagtatagtttcattttgcctagttttgaactttatataaataaaattaaagttgtcttcttgggttcttttaacttatgcttgtaagattcatttgcatagctgcatgaaggaagagttttatttttatggctatgcaatattccattatatgaatatactacaatttgattattcatgctgctgttagtggaccttcgaagtgtttccagtttgaggctatcttgaacatgctgctatgaccttcttggacatgtatctggtagaaatttgcacccgatgtttctctagggtatatacctaggattgggaaaagagccaacatggtagctgcaactgttattgcacttttttcttttttctttccttgagacagggtcttgtcttgtcacccaggctggaatgcaatggcacaatcatggctcactgcagcctcaactcccacttcagccttccaagtagctgggactacaggcacatgccatcacacacagt

SEQ ID NO: 12329 - DNA, 40576 bp, Human
aaatacttttagtttttcacatccagtttttcctttcacattgagttggctatgctatctaaggcatcctggtgataacatgtccaactgtcacatggataaagtggtcattcatttgttcatttcatccaacataaacttattgagcgtctatccagtgctgggcatctatgccaaggattcaatggtgattgaaacagagtgcctgctctcctgagttttcagtctaatggggacaatgggaaacaaatattaatgaaatagcaatacggctgtgacattacaacctcataaatgctgtaaagaagaaatgcatgcagggcttctgaggaagtaatgtttgggctaagagatgaaagatgcattaactaggagagttaactaaattaacttgctcaggagtgagcagggttccagttaacaaatttatggttgtcataaggattaggggaaggacagagtagggctagagaagaactttctaggaaaagggactacagccaggcgcagtggcttatgcctataatcctagcactttgggagcctgaggcgggtggatcacctgaggtcaggagtttgagaccagcctggccaagatggcgaaatgccgtctctactaaaaatacaaaaattagccagccatggtggcatacacctgtattcccagctattcaggaggctgaggcaggagaatcacttgaatccaggaggcagaggttgcagtgagccaagatcacgccactgcacttcagcctggatgacagagtgagactctgtctcaaaataataataataataataataaaaagaaaaagggactactaacatgggcttgtattatggtgatcaggtggatgttgatggtgtaggaggcggggtggggggagtttatggctgcctaaaataggatggagacaaaaatatgtggataaaagaaaataatgtggaagttatttaggaggtaaaatggcaggaccaggacttggctagtccttcaaggctcatctggtgactggggcattcttttgggctgggatctgtggggccctccccggctagcaacttggctttcagaagtagatgcagccactgatgcagtccgcgtgccaaacagggatggcaggtaggggcagggctgggcaggggggcacaggtgagcacatgcctccgctggcagcagcatttcaaaacctggatttatgactcaagtcaggaggattcctggaacccaggcatagatttctgtgggcagtcagttgtttacaggagattaagatcatgcctattaaagagatcaattgtgtccacaagaacccacacttaataggtaattgctgcttgacagaactctacctgcaaccagcatagctaaataaggaacataggaaacaattgtcctgaaatatgaacaccatgttttttttcctccgcttgatcaaagaaagactccagcaaaaggggaaaaaataattaaaaagtaaaagtcttacctaatgaggtttaaaacaaaacttttgaagccaacaagcaactgtgggcaacacttcaaagggcccagaatcaatgtttgtcaatagcagttttgcatcctttaatttatgtctcatgaatataaagtgtgatgttattaggagcccatccatgccttaattctgtttgagatttgatgaaccagaagtctattaacattctgtacaaatcagcactggcagaggcctgtggcacaggcttcacctgatcttttatcctgaggctgggatgctagtcacgctgtcaggcttcctgctcggaacacccagcagctgtcatgtgcaccgtggagccagggggctatgtcagctactttctttggagagtttctccccagaagagaaaccacttcatgactcagcccagccccaaagttgccatttgtttaatcaagatagttagtttgcaaaacattaaacattaaacagtatttgatgcctagttaataatttgcatcctcttcatttgttcctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtggggtaagtgttcttttctaatatttgtagttgagagactccgaagtttactaggaggaccaagctaggctgggagtgatgagaaactttagagtgaaaggctggagttgccaagttggagatgttctaactacaagaaccaatgcaggcctgtggcttggtttcttttgagcagccactcccatgggaacaggtgtctgacttgagccatcttggagcggagcctccatgaatgcattccagcaaaggagactggggcaagaaaatgtgccccagggcatggattgtaatctgtcatggatctcatagacccctttgagaagccatggaaagctataaactctctccccaggaaaatatacctatctattggtgctgacacacacagttttccagcgatttgtggctgacactagggtaagaagcaatgtgctatggccttagaggggaagcctgctgactgcaaaagatcctggcagtgggtctgcataaatagtttggatttggggagaagctttgtgtttagtactttgtctccttttccctgtgacagcagcagatgaggcagagaaggtgagcaggggcccaagggaggttgcagtgcgcagggaagggaagtcccatcagagagtcttgaacgggggactcaggaccttccggagcagatgacttgtcaagatgttagttccttctgtgtgccatggtccaagagtgtcagatggatctctgtgggcatggaaagaggaccttgcacagaaatagagtctccttggagttccgtgctggttgtggtctgaggcatgaatgtgggctttggagccagggttcgaatctcagctttgccacattctagctgtggaatgttgggcaaggaacataatctctctgagcctcagtgttgtcttctgcaaatcaagtgctaacctctcagatttggggagggccacaagtaaacgaggtcatgtatgtggcttgcaaataaatgtgagctctactcccttaaaatgtcaagaatgaacacaacttctccataaaaatcagagaatgctccgccttgttcgggaggggtggtagaaagtgggcagaggataagaactaaaataacagtcataacctctctgtcttattaagtacctttgcattttgttccccatttcactccatagagcgtttcctgaatgaagcagattaagttacagttttctgattagcatgtttttaaaacaatagcttctcctttcttttccgtcaactgtgctcagacacctatcttagctctgtattaagttgccaagtgactcacttctgaaagggttttcttttcaaatcatgacttgtgtgtgtgtggtggttgtaattacaaattgttgtcaagcccctacatcatttgatggcttgttggtgtctgaggccgagacacagcagaaataccacaggtctagagaaaggcaggagaaatcatcggaggcccacgcggggcccagagaacataccagtcggaaagaattagatcctaaactttgcgggcaaggagaaacgttgacacggtatgtttgaagttcacaaaaggataatggtcccgaaaaatcccttttttgcaaaccccagtgaatttttagggttagcaatgaaattataagtcaataatggataaaagagaaaatatgagagttagccttcaggcaatgagcttagtcaattccaaagagaggattcggggctttggaatgctttcttaccccagatgtgtgccagacaggtggtcgggaaggcggcttgtgttccacaggctggcatacagacatcaggggaaagtggccaagtcgttcagatgctttggagagtttggggcgtcatgggggtaaagaagccacatagccagctgggctgggtggcctctccagccccacacagctaaaagtcataactaactgctaccatttaatgagaagtcctgagtgctagcccctgaactttccatgaattggttcatctctggaaggaccccaagaagtaattcctactatgctcccattttacagaaacgaagctggaaaactgggcctgtcccaagtcatacagctgatgagtggcagagctgagctctggattacagactggtttccgtgtagccagtctcctgtctggggccctgggtgaggatgagatttctttggttcgtacagcttcagggacatggcttttcctgtagggaaaggcctcttagaccaggcacatgtttgctgggtggagtgtaatggactccacgtgtctctgaaactccaaagaaaggcagctataggatctgtggtcactattcattggaaagacacccaggtactctcccatgaattcagatcatgtagcaaatgaggactgttctttgggatcatctgtcatggagatttttattctgatatccactagcccaagagatatgggtcaaaaatcattgctgtgaactccagggcatcattcattgtgccttgctgttctactcgaggtttggttttcctaacatatcatttttgagcacctgtccagcacaacctcatatcattatccctgttttatggatgagatacaaacccagagatgttaaaatgactttctggccaggattggggccaggtctgtctgactccacattcatcacaggaggcctgcttaactgtaaataaggcgtggactgtcttagaaatctcttcttgctaggattcttagagtgatttggggcccagctgggctcagccataatggaatttggcctctccaagcccagaaaccagaggacaatgtttgtcaagcttgcctgcttatctcagcccatccctagaaagaagaaagacaaaggcttctcctctcccctgcaaaggaggtgctttcaattaaaacaatgtttacatttctgggcttttaaaaccctagaactctagaatcttcccagggatagagccacaaaacagtttgcataggtcagaagttgcaaattggcagcttgaaatacactctgctcacagctcaagtttaacttggtggatagaagattgactccaagagtattttagttttattttaattgcttggccacatttgaaaatcggaacacagaacatttcccattaaagatacagattcccagcttttcttgaaaatcagacatttgagtagcattgggttcacattcttggctggcaccatggagaggggtagccaccgctgctgttattagatgaagtttgaggccaggcatggtagctcatgcctgtaatcccagcactttgggagtccaaggtgggaggattgcttgaggccaggagtttgagactagcaacatagcaagaccctgtctctatcaaaaaaaattttttttaaattaagcgggtgtggtggtacatgtctgtagtctcagctacttgggaggctgaggcagaagcgtcacttgaacccaggaggtagagattgcaatgagcagagaaggtgccattgcatcctgccttggcaacagagcaagactccatctcaaaaaaagtttaaaaaaaaaaagaaagaaagaaaaaagaagcttgagtttcccagatcctgctcctctctctttctttgattcttttattctttttttttttttttttttgtagagactggtttttgctattttgcacaaagctggtgttgaactcctgaccttaagtgatcctctagccttggcctctcaaagtgctgagatgacaggtgtgaagcatcatgcctggcccccatactatctagaactcttcctcttgaccaatgtgcattgtctgcctggttctgccttactgcacttctctggttattgctcagaaatgctgtggatattgacttatcggaccaagtttgggatgggcaagtgaccaggctcagcatccgattaattcaagcatccacacctgcatgggctccaggaccaaacaaggtcttggacaggaagatgggagccactcttttcaaagcctccagaatgccagtctctttcgggcctaggagagactgaagaggcattcctccctcttactgccatctacacggtcttagggaaaggggagggactgattttcactgcaaattctcatagatttttttttaactgatctgaagcacaaatccaactcattacctttagcggtgtacactggtatttagggaaatcaggtcgcaggaaatcacatgtgtatacaggcacgggtatatttatattttaaattcattagagtttcctaaatgcaagagcaattctgctgtcacagagaaacagcatggcagaatatttggcagccgggattttaaataaaacatgctttttcttcataattaatataacaaggtttcctggcttaggacttggcaacgatcccaggaaaaatggttgggggggagggggttggtgcgccatgcctgtgacccgcaaacaagttccaggaaaagttgatgctgagtaagttctccttagtcggctcttccggcactctgagaaaacagaacaaactcactgacaacagtggctattaataataggagtagtaagagtaatcgtaataattaatagtagcagcaaccacgtatgaagtctttacatttgccagatgtggcatgctttatgtttattatctcatttaagcttctctcaaaccctatgagttagggaccaatgtcattctcattttacagacaagaaactaagcatagagcagttaaatcatctactcaagatggcacctctgggaggttacagctctgggattcaaggtctgcccaacgcctagttctatgctcacaagcactgtggttgagatcatcatgcctggcactgcccaaagacaaacaagaccgttttgtgtggtatcaaaggtgtcaaaatgggcagcagcctgagactccagcttccagcaggagacaaagtcgctcccatctggacgttccctcaatagccccgaagctttgctttccctttgctttccgacaccacaaggatcgagtcttgccggctagcaaaccagttcgttcagtgttttcaaaacttcagtcatgaatgaagccatcttcagaaattctgccaaagcccaaattagtttcttaatacttttgttaaagactcaccttttctctacctaaattgatttagttctaaaggaaattgtcattactacaaagaaagcgaagtgatgtcattgaattctagctggctgctgttgacatgctaaagctctgagcctgaagcggctttatcctccttagaggaaagatcagcaggaggcagaggatagagacaccagcaccccccagtccttccccctggtgggattggaaggcttgacagtcaacctgagaaaagaaagactttctcacgctgtgttttctgttttattctaatgctgttacttcacgtcctggctaggcaccatctcaatcaactcagatacccgcagtggctcacgtctgatgccacggaaagcgcaggagtgagcacagcttcagcagaggtggtgctgatgcctagcgggggagttaccttcctgaagccctgggctatttgctggggctgactgaccaaaaagggaaacatgggggcttgtgcttatgaggcggccccacgctcagctgtgctttggttttgtccacttgcttgtcttaattttttttttttcttagacggagtctcgctctgttgcccaggctggagtgcaatggcgcaatcttggctcaatgcaacctctgcctgccaggttaaagcgattctcctgactcagcctcctgagtagctgggattacaggcaactgccaccacgcccagctaatttttgtattcttagcagagacagggtttcaccatcctggccaggctggtgtcaaactcctgaccttaagtgatccacccgccctggcctcccaaagtgctgggattaccggcgtgagccaccgtgcccagccttcgcttgccttttaaaagggcttccaagagcattatcatatgcagaatttttacccagtctccttgtcttggatggcctcactccctaaccttcaaagctcccctccaccaccatctgtttgcaccaagtccctgggatgagccatttgtacagatatttctcaccaagtctcacctgcggagtaatcattgcaaatgccatattcttcctgagcagccaaagttccttgaataaaacattggaattgggaaagggaattcttacttttataattggggaaactgaggcacagagagactcaacaaattgcacaggagcaaagataggccctgagtctcctcagccagaagcttcacacccaagagagcttggtataaccaaagcgtggccaagggcagagtcgcctgggcactggaggaagatgtgtgttgtgttcccagcccacctcagacccatggacgccaaacctctgcgggtgggccccagggatctgtatttttatcaagttccccagacaattcttatgcacattgaggtttaagaaccaatgtctttaaaatggaaattctccggatgtaacaaatgggactcttctctttctgcccattgcccctgtcccatctctgcctgccactgtcacacgaagctgcagctcagcccttagctgggtagggtctgagtggccagctctgggctttagagcagggaagctgcacagaatccctctgagccaggcataggtgatcggcgtcagagccaggagacttgagcctgagtccctcccctgccccaatgtgtccatgtccttacacaagccacttcaccatgctgggcctcatcttcctcctctgcagatgaagggtctgagccagttcctctctacagtggctcctggctcatcactgtggtctggtgaacagcttcacccaggtgtccaggaaggaaaccacccacaggcactgctggccagcaccttcacctttggcttccacattctcccttgagagttttgcccccttcccctgagcttcaggtgaaagcaaagctgcagtgaacctgccagtcttgagacagcattgagcaatgtgtgcaaaagccagaagggcaagattcctgtgcctacgaagggatggagttgcaccacttcacacctattaggatggctcacttcatacctattaggatggctatcattttcgagaatggggaataacaagtgtgggtgagaatgtggagtaattggaaccctcaggcctcgctggtaggtatgtaaaatggtgcagccactgtggaaaacagtatggcggtccctgacaaagttaatcgtagaactaccctaggacccagcaattccacatctaagtacatatctgaaagaactgaaagcagagacttgaacagaaatctgtacaccaatgttcatagcagtattattcacaatagccaaaaggtgtaaatgacccatgtccatcaagagatgaatgcataaacaacatgtgattagatagagacaatggaatactatttagctgtaaaaaggaaggaaagtttgatacatgctacctagaagaccttggaaacatgatgcacagtgaaataaaggcagtcccagaaggacaaatattgtaggattccgcttccatgagatacttagaattgccaaatgcacagagacagaaagtaggctagagattagcagggctgagggagaataagaaggaggcgtttctgttcaacgagtacagtccatgctggggatgacgaaaaagtttggggattagagagtggtgatgggtacacagcattgtgaatgtaattagtatcactgaaaggtacacttacaaatggtcaaaacgataaatgtgatgttctgtatatgttaccacaattttcaaataaaaggactgagtggcttggcacaactgctcatcttagtgtcttctaggataaagttggttagacagaaagtcaaggaggggcagagagagaaggagcccgtgtctctgaatcctactgatttacagtgtaatcttcttgggggtggggagtgtatacgtctagtctattttgtcctatctttaatccagtgatgatttcaactcaggctgaaatgacatcgcttatctttgtagcaggagccagagaagaacaacatgagggaggatttggcctgggcactggcagccactgccctctgccacctccactactcgctctggccttgagctctttgcccagcaaggggactggccctgctgaactgtgcacacttgtccctgtccaccttccagtccagaggttgcagcctcaaccatggccatggtacagaggtctctcctccccagctgcccttgggagtaacgcacctccctggtggttggcaacatgtggcctaccaccaggcatagggtagaacatgcaaggaagaagagatggtgtgattagagtcccaaccttttatccagcaagcagaagatttctctgctcttagttcattctgagctgagcctctgtccccaaaagacaaatctggccctatctcccccatcactgcctcctaatccctctgagaacattttctaccaacgaatttctggaacacatcaactcagactgttaggctttttgttttgtcttccagaagttttggaattctggaaggcagaggaagaatcttagttgaaataatcactggattaaatataggacaaaatagacttgatgtatgtgcaccccacccacaaggagattacactgtaaatcagtaagactcagagacacgggatccttttctccctgccttcctcactaaccaaccttaacctgggaggacaccagactttgagactctggtggcttagggagtttaacattgctaagggcctgctcctaaccttgaagtcagtgtcctgagccagggatccattgagaaagcccaagtgcggagtagaataaacagtcgttggatctagaatggtcttgctaaatatactacaaagcagctaccttaccatgtgcagaagcagcagcgtccaccctttaagagaagacgggtcagctgggaccatgtgctattttagccctgttgaaactaggaatggatgtggtgggagaagtgggcagtggcttacgtgccttttgatctgagtgaagatgtttgttaagatgtgtttaccgcagtaggctggccaaggctcaatctgacttttgtactttctccagctgtcactggggccaagtaggccctctctgtggcctgccaggcctaggccagattggataagctttttttttttttttttttttaagacagagtctcattctttcacccaagctggagtgcagtggcacgatctctgctcactgcagcctccacttctcaggttcaagcgattcttgtgcctcagccacccgagtagctgggactacaggctcctgccatcacgcctggctaatttttgtatttttagtagagatggggttttgccatgttggccaagctggtctccaactcctggcctcaagtgatctgcccacctcggcctcccaaagtgttgggattacaggcgtgagccactgcgcccggcccacaaataagcctttttataaagcattccaagaacagtgcccctgattttgaacctagctcaacacctgcctctcaaggttaatgagcttttctgtttctttctcctccatccttgctttattactgtgtacacgtggcagcttcctggtccctcacaatggtgactaagagcaaggactctgatgtgagactgacagtctcctgttctggctccagcatttcctagttaagttattttagacaacttaatatctgaaaacctcagttttgtcacctctaaattggatataatcataatacctaaattatgaagtattgtgtgcaacaaacaagacaaaatgtccgtaaaatatttaacacagttgatggcacattgtcagctctaaaggaatgtgaactgagataacagttttctccctagttatctcttcctcctactcttccatcgatctttctctttgaatgtgcaagtctcaggagtaagggttcttctatcattttcttgtctctgggagaagagataatggaatgatggaatgaaaggaggcaaatactgtgtccacccttcccacctaccatcatccaggttagtttcagggatccggatataggcataagtaattgactatcagcctggactttcccatacggtccctaaatatccagccaggtgttcggactaccagtttccacattgcaccacggcccctctctgtgggtggacactgtgagtcacaaaatgagtgacttgcttcagattccggcgaccccctgacaggcagcccaagctgcacatcggcttcaggctccccgagagcccagcccaggaagtctcggctttctttttgtttggtttccctccgagcgccagctcctaggaagggcacgtctgccacctgctggctgtaggcagcatggcacccggctgtccctcaggctccagctggagccaggatgcgcaatgctggcccaggtgcaggtcctggagggcccttccttgctggaccccgaggaaggatgtccctcaaagtcttctgcccacttcttaggacatggcccaccctgttcggctcaaagagaagaattcgtagggaatctccaaaggactgggtggagacaggtctagacagacaggccctgccctgagaaaggcaaggcagggagcaaagaccaggaccaaggcccagatgactgggggtgatgagggcgagattgaagaaggggtaacctttgtccttgaagtcttagtgtattagtccattctcatgctgctaataaagacatacccaagactgggtaatttataaagaaaaagaggtttaatagactcacagttccacatggctggggaggcctcacaatcatggcagaaggtgaaagacacgtcttacatggtggcaggcaaaacagtgtatgcaggggaactgcgcattataaaaccatcagatctcctgagacttaatcactatcatgagaacagcacaggaaaaacacacccccatgattcaattacctcccacatggtccctcctatgacacatgggaattatgggagctacaattcaagatgagatttgggtagggacacagccaaaccatattagggtcccctcatggcacctctctggcactcaaccccagaggtacccatttctggcaatccttcaccctaagcccaggagcacccctaaggcctaagctgcccttcctctgccaggcctccccactgccaacccccaccctcagccccaaacagaacacctgtcccatctcactgcctgcagaaacagggtgtgggggaggtggttagccaggaagtcattagacagaggcacagtccccgataacaaatgacctctcttcctttttttgcattcctttcccctcaccaacatgttattttgtaattttttaaacctacagaaaagtgggaagaataatgcaatgaatattcttcatccagatagatgccacaattgttaacatgtcgttatggttgctgtgtctctcattctcctgtgtgtatagttgttttgtttgtttgtttgctgaatcatttgcaagtaaattgtagacatcactctacctcaccacgcatctctctcttttgtttttttcttagatggagtctcgctctgtagcccaggctggagtgcagtggcacaatcttggctcgctgcaagctctgcctcctgggctcaccccattctcctgcctcagcctcccgagtagctaggactacaggcccccgctgccacatccagctaattttttgtacttttagtggagacggggtttcactgttagccaggatggtcttgatctcctgaccttgtgatccacccacctcggcctcccaaagtgctgggattacaggcgtgagccaccacgcccagccagcgtctcttaagaataagtacattttcctacagaactacaataccattgtttactctcaagaaagtcaacattgacacaataatattgtctaatatgtctatattcaaatttcccacttgtttcagtatcttagtccattttgtgttgctacaaaggaatacctgaggctgggtgatgtattttttttaaaaaagaggtttatttggcttggatttctgaggactggaaagtccaggattgggcagctgcttttggcaagggcctcaagctgcctccactcatggcaaaagggaaaggggagccaatgtacagagatcacatggcaagaggggaagcaagagggagggatggaagtgccaggctctttttaacaaccagctctcctaggaactaatagagtgaaaccttgcttaccctgagggtgagtactaatccatttgtaatggatccacccctatgccccaacattgaggccccacctccaacattggggatcaaatttcagcatgaggtttggagaggacaaatatccaagtcagcccaaaccacagcactcaatgtcctttttgccattgtttttaaatccaggatccaattaagagtcacacactgcatttcgttgccatgtcctttactaaaaatacagtcctcccatctttttttgtcttttatggtgttgatgtttttctggaggctaggctaggtgttttgtagaatgccctgcaatttgaatctcacaatttggatctgtcatgttcctcatgagtaaattcagggtaactatttttgccaagagtactatctgttgatattttacatcctcagtacatcatatcaggatgcattatttctttttatttttctttcctaatttatcatctacctaattcccaaaatcatgtaaggaagcctacagtaaaacagaaaattagaaattctgcagagggtagaagcagcaaatataccaaactgcctagcttgatgtatctcattgatctcagctttctggcggccaagacccaaagggaaagctgtctagtggtagaactcgcatttctttaaatcagggttcagcaaactttgtaaaatgtcagatagtaaatgtttggggttatactttctctctacaaaagcagccataaacaaacaggcatggttgttttccaataaaactttatttacaaaaacaaaactgctaggcttggcccaagggcccttatttgctgacccctgattaaagtggaagagagcatactccagttattaaatgagtaatactttctttttcaggttgagtactgcatattaaaggaaatatttatgtcattatttatttattcagcaaatctttttgaggaatgccatgtgccaagctctatgctaggtattgggtaatacatcaatgacaaaacagacaaaatccctgcctttctggaggacagagtctgatgtgagagacaggtgacatgcaaataaacaaatgtaaatctatgcactgcagtaaggatcatggagggaataagcgggtgcagtgacaaaacagtggggatagggaaatgtcatattgatgggatatttcagggaagatgacacttaaactgagacctagcgaaggtcatagaggggggcttccaggcagaggcaacaataattgccaaggccctgaggtgggaggaatttatcttgcgccattttgaagccaggtgtggctgaagcttagtaaaggggcaatgggagggaggagtatgggaggagatttgtaggtcatggcaggtgtttgcattttattctaagaacaacgagaagccactgaagggttttaagcatctgtccatccccaatccccaggaactgtcacctgaagaaatcacctagatttcagcatgaattccgaatcctatcacagctatgtgacctccgagtccaaattttctcatctgtaaacaaggctgatgcaagcctcttcatagggctgttataagtatgaaatgcagcaatgtgtgatcaggcagggagtagatgaaactcactgcacctgacgagcacaccagtacctgggcagccgtgttccaaagcaaggacaggtgcagacaactgacacgaacccctgctgtggagaaggacaatgcttcagtactcagcgcgcacaggtggtggtggtggagggggtgtatcttcaaatagaccccattgcccctcccttcaacctctagcccagccacaaccatcagaaagcacgcagtgcacctgcaccccatacgatctcctctggctgacagctaaggagcacgcccggcagagctccatctcaacgctgatctgctgtgttgttttgtttttcagttctccctgatgtctttattggaaagcctggacccaggtaagtgtgctgatctccctggggcttcccaccaatcccaggctggttctgggctggtgaaaaggaggcctaagtatggaagtgttggagggacctcagggttcaactggttccgggttgtcacaggcacctttgagaacttgccctcaaaatttgtgcacccacaatgctttacacaattttgagtttcctgtggacactgctgagcccaggctcaggatcccaagggaaatactgcctacgtacttaaaacccttgattttataaagaactgaggcctagaggggaagcaatttactcctggccacacagcgaattggaggctgagatgaggtgaaaggctgaggcaaagtgagggcgagatgaaaaatgcatggctccaggcaggccgctccacctttttctgtgcgagggcggcctccgggctgacctgccctggtgataccctcacaccagcacctctgctgttgtcttctctgcccaaatggtttgcttcctcaggctcgacgcgtctaccaccaggtgggtcctgtatcttcacaagggctctctgtctcacagactcgctctcttattgtctccctttcctgtgtcctcggccttgtgcccacagcgtgcgcaagctaagcagggccaccccttccacatcatgcactcctagtcctttggctctgggttcgagtctccctttgcagctctgagccgcagtggagaaaattctgctcgccactccatctggccagaggccaacaaccccactggtagagatctatgctggtcacccacagagcgccatagccaggcagacaacacatggagactgtggccacatctgaaccttgaatcaaggatttatttggcacaaagatggcagtaactgggccaaagtcagtttgacagtcaatattgtccagcagcaaaccctggatgggcagaaagatgaggccaggtcttcattctgtcccaggtgctcagaggatatttgtggagttgaagagaaatatatattggcatggtgtgtggggttttgagaaaatccgtgtctttccccaacacgaaggatattcaacgacacatagttcagttcctctgaaggcgcgtatttcagagagttatcccctagctgatgaacacaccaccacccacacgtggagtccagggaggagccaagaccaaggggctggaagggtggcctcttccccagccttaagcccaaattgctcaggcaccgctgaaggggatccctgggtctgattttcagagatacagggctgtgggagctatggggtgacacagtggaagaaaaagaagtgcggaagactcaagggcccttgactttactgccagctgccagaaagttgtaagagacatctacagtgagttcatgacaccctggaattgtgcagtgaacaacttgagcaactgtaagcagtggccctactgaacagagaccatggaaagggagtggagttagccaatgtgcccatagatttatagctttaatcaaacagactgggagctacagggtcagatttgatctgcaaacaggaagaactttctcactatcagagttgttcaaaaatctgaatgggccactgggctctcaggaggtaatgagtttcccatcactggaggctttttaagcacaggctgaaaaacctcttatagggagtgaagagtatttaatttaaccctcaagaaactaccttcagacagtttggtatataaatgaagggaccctgaagcagacttctcctgggatccagagtccatctcgaggtgtcatagcctccagggagtgggctgagttgtagagattgggcctttttgcaaagagtagattcagtttaaaaacatccctgttcagtgtccgacttaacctctcacaggggttgtgctttgatggtatttgtcagctccctgctggctctagacaacagcatggcgaaagagaccccgtgctcgtgcccgtgggcaagttgcttctttggttgatcttgctggagacagcgcacggtgagggccttgctggagcagaaggtgcgcattccacagtccccaatgggtggtggaggaggtagccagcaaacagcacagactctgccaatctccccaaagcaggtgccacgacagccagcaggcctgtggaaatgcctcttcaaagctggcttggctctgcccagcaatgcaggctgagcccatccatcagctgtcctactgcctgccagcgagagtgtctgctgggcttgccccgccagccagattggaagtgtcaaatgcaggccgacagggctggggtttggaggaggccctcagaggagccgtctgtgccacagtgatggatgacaccaacagggacgacattccggggattttgattctgttccacacatctggcaagctccttaaccagagcagctgcaaagctcccatcgcaggaactctgagcattttctgagagaccccaaacatggactgagttaatcctggtcaagggacctggagcatgtgcttaagaaggtttcccaatgcatgctacttcctgaaagctaaaacccaaggactttcatgaaacccaaacctataagagattccaggatcgtaaaaaggcaaataaaacttggagttaggtagacctgggttatgatgtcatctcatttggccttcatttttccttatctgcaaaataggaataataatacctatgctatagggttgctttaaggtgaagtaagattgtgggcaaccacatttatttagtttagtgtctgatacatagaaaatactcaacacattataacctattattaggataatttggcttaactcaggatactctcatgatccttcctgataatttctagaaacagactgaaaactagacaaactcacaagaatttctttttattcctgatagaaaattcttgaacagctgcccctttctttcccaaagctcctcccttttctatagcctagagaaagtcacaaataatctatgtttaaacctgaactgtttttctacaatctaccagtggaaccaaaatttatggcaggctactgtgcctctctacccaggaaaatatgtggacgagtttctagatcgctacagagctcatcaggtattttctttgccaagtacatttgacccatttcttacacagtttcttactgaaattccctatttgctctgctttaagcagacaccatttttttagccagcaaagctgcatgcaggccaatcagaaagcagaaaggcttagccactaagggaaaaataaatccgtcaatcacatacattaactacaggtagggctttgtgctgggcactctggggttaaaagaggaatggaaatggcccttcctcttaagaaactaactatcaagttggaggaaacaaataagatagaccaaatacccaagagaggtgccatctgaggtctagctatgacacttaaaactctccagccaactgggccacagaggaatgctcttgaaactaaaattcttatcccattagcaatctaatatcaatcaagccctgtgtgtcggtttgttattattgcataatacgctaccccaaacttagtagcttaaaccactgaccatgtatttaggtcacaattctttgggttgacaattttggctgggttcagctgggcagttcttctgggctgcatcgggctcagttgatcttgactgggcttgctcatgtgtctgcagaagctggcagattggctggcctcttatcttgctgaatattggctgggctttcttatatgtctgaggcctcagctaggaccactaggccagccgttgtccacatgttctcatatgctcttgcagaataggccaaactgttcacatggcagtcatgtgggtccaggagtgggagagatacagagtcgagagagaacaagacttcttaaggcccaggctctgagctggcacaccgtccttccatcacacatgctattggccaaagcatgtcctaaggccaacccagaaccaaggggcagggaaactgactccatctcttggtgggagaaactgaaaagtcacattgcaaagggtgtgggtgcagggaggggtggagaatcaagggctatttttgtcatcagattggctcatactgaagcagagtttcactgtggaacttgagggcgccaggcctagacttggtcacttctagctccctcacctcttcactactctttaatctccttccttagctggctttcatcccccacccaaccttggctggaggcttccttgaggacaaggccacatcctactcttatttgtataactctgcaccattcccaatgccatcctgcacctggcataacacttggtccattgtaggttcacaagacaagttacatatgcagacaataggattaagtgccaacataatgggaaagacaaaataaggtttaatcctagaagtggagaaaccctcccagatgatactcctgtaaagcaccttcaaatcacatggcagcccatcccaaatggaaaggatctttgtgactttccttgcacagccaccagctggatggcttcttccaccctggctacctggggccactgagctctgctcgttctatccatcttgactgaggcccatgggccctagagaataggaagcctttcttagcagcaatatgattcaaagcctatgtattttatttcttctttggcttcactgagaggtaagcagaccttgttaataggtctggattcaagtcaaaatcctctaacagacatttcattcatccctcgtcacctggaaaagtcacaccataccatctacatcagaatcttccccatttctaaatatctgcaaaagaagtaattcttaatggccttgccaagattagctggtctgactgccaacctgtgggagagatgggagaaattacagaagcaacctgaagggcatttatctataaacatctgttggaaaaacaaaaataaattcttcaaagaacaagaaataactaagcaatgcaatcagctccttatcaaaccccattgtctctcctaaatgtcagtttgaaatctttcatgtcaaactcagaaaaacatttttttcctcattttctccctctctttctctgctttatcacgctagatggaggaaaactttatttgctccaggaagacaatggccttatcttcaacctggatcctcagccctaaaaaggtggcctcccctgggagcattttcatagtggggaaaagcacttcgggagaaataatgagcaagccaagggagtcttgacttgacactgtgataaatgaggtgaaactttggcaagaaaccagagttggcgtattcaaaaaagaaataaaaagctagttccattttaatgggaaatataaaacagccattgtgcaaaagtcgatttttcaaaagccagagagataaagactctaacagaatgactgagagacgagtaagataatgtggttgataatcaggcttaggtaaagtgccatcctccaagccatcagctggctccgtaggagtgccttttcaagtcagctatctgcatttgctcgcgcctcattatcatatgcatctctggacagcttccttgcagcttcaacttgccgacttgccatactccagccggctggagagagcaaagtcaacctgactttcttcaaatcccaaacttccacagacctaccagccacagagctaccaggatctccccgccaaggccccagagagcaaagagcttgagtccagccaaccttacacatacctgttttttttcccaatgaccagtctagtgtgaggtttacaactgtaggcaagatccatgaacttttataaggttatccttgggaaattcctaatgagcaggctggatagtcaatggggatggtgggacacattttcccaagggtaagtgtgggagtacccaaggcaatgtaagaccccagttgaaacagttgagtgctacagttgagctagtgagatttaggggttgtacggagacaaactgccatagttcatatcctgccctttagtaactatgtgtccttggccaagttactcaatctctgtcagcctcaggtttctcaacttagagtgaacaatacacctcctagatttttatgaagatgaagttagatggtgcatgtaaagtgcttagcacagggcatggtacataataaaggctcaaaaaatgttatctgttaaaatgactctgtagataatgcttgaccatgaccaaaagaaaaatgatgagttttctttgatttcattcagcttggtgactaatgaagtcccatcaagaaatattatccacaggatgaggcaaccaggcactcaagtatagtgtgatctgaccccgggcagaccccatgtaggaccctgtagacgtgctaggtcccaatcctcttcctgctgttcaaagatgagaaaatcaagacttgataatacagttggctttcctaagttcaagggagtagaaagctggacttcgcttcatctcttcacttccaatcaggtgctcatgaccctgctaaatgtcaacactaccttgccgggtcatagcgtcccccaagtgaaaagatgcaaagcctgagccctcctttccactcccctcactgtgcagagctggagagacacatgattcctcctgcaggactttgaattctttggggaaaaggtgtccaactaaataaaatgctggcctatttgagtgtaatgattaggatttcttctgtcctgttaccatccctgcagactggacccctgaccagtatgattacagctacgaggattataatcaggaagagaacaccagtagcacacttacccacgctgagaatcctgactggtactacactgaggaccaagctggtaggtaccaaatctctttcagggactctcctgggagaaggtcagagcggagtgtatgtgggaccacatgcaagggcctctctctccgcctctctggccagtattgtgaaatagctatggaagaaattatttggactggcttttttttctgttagattcatatgctatgaggactggggaagttcttagagaccatctcccctaccctcaaatgacagatgaggtaagtgaggctaagagaggagctgacttggccaaggtcatgcagcaagttaatgcagcattgtccaggtttcctgatgctgtgaatagcagctgtattcaaaatcactcccatagcttagattacaggtcagaccctaaggatgcaggaagtccatgtcagccttgagtaccagactgtagcatgtacacattcagctttgggactttccttccctcatgcctttgccagaacttttccttcccttccactttttctttctcccttcactctttagaagctttccacaattgttagattgtgtgtgtgtgtgtgtgcatatgtgtgtgtgtgtattcatacacatgtgctcctaccacacttgtttttgtttttgtggcttcttaacccaagcagtgggacagaaaagaaaataagaagctgggtccaagcaatgccatgtgactaaaccaggagaaggaatggaaagcacttagcagctggaataaaagctgtgtaactgtgcaaagtggcctggaaggcagggccaagatacagggcatgggggaacatcagaagggaccatcaaaacaagagcagggcccagggatcctagttcctgaaccaaagaacaatgtgtgtgaacagaaggataaagaattccccaagggaagatccattcagacaaccatgaaaagccacaggcacagatgaaatatgacaaaatctaactgaacaagtagttgaagaaagatgaaggccactgggtcatttcctccttgccgccaattcttctgtcaccctcttgcctttggtcttctctcctgatgttcagaaagcttgcgtttcattaggggtgggttttctttccccactcctgacctccacccctgggcactggaagtaggggaggtcttcaggcttgtgaaataccttcagcatcagagacagaccctgtggcactcccagcaagactgggaggagaaaaacactgatgagggaaaaggggagtttctcaatgagaaaggccccgtccaaagccaggccgaggggagacagtcgtggttccttctcgcctctcctctcactaacctgaatccctctctctggtcaggtgactgcagttttccttgctgtttagggacaacatatgttttcctcctttccccagtttctggctcagtagttactctctcatttggggcaggagactgaaatttgatgaaaaatttggaggggggcgcttctcacctgcctttccttaccaacattgccttcttcctgtgtgtcttagatccatgccagcccaacccctgtgaacacggtggggactgcctcgtccatgggagcaccttcacatgcagctgcctggctcctttctctgggaataagtgtcagaaaggtgagtccgtcatcactagtccactcttccctctgagttaaacaagaggcagtcctttctgtgtgagaaagcactgcgcgatgccatggaaaggattataactgcaatactgtatcatgcatagtgtattcctctgcagggtcccaggcagcctctcactggatcctcacccctgcactgtgagatggaactagtacatccattctccagatgggaagattgaggctgagaggggataagggctggactctaaccaagatatatcccaaactcaggactttgtgcttagagtttagtctaactgcaacagagccatgttgtcctcaaatgggagagcagggaggatctcagggcacatgagacccaacccagttagagaaagggaacccagagagtgggggcatttgatcaaggtcacacagctagctagatgtagagcagaaattagagccctcgtgcctgacttctggcccatgctcattcattctaccatactcactgtgtctgctgccagtgaactcttgtgggcataacatgaggcagtggaataaagcatcaggaataggactcctaggggctaattttacccctagagaaaagctggattcgggctgctctagcaaccatcttacttcgtggagggaagtggggccttaggtatatgtacagctttgtggttgacttcttccctcggtgccctcttcacttattcttttcattttcaatcctgcaatttcttcagtaaatttttcaggatggttgagaatatcgagtataaacacagtgtctgggctcactcctcaacttctcagaaaagtgacaaaactgtaaatgcattctgaagttagctagaaaatggagagactaaaattgcagctctgtttggtgaaggtgtaacaattatcaaagtttttttattaagatataaaaattaagactatgggcatgggaagcaatgtgggagacaatcctccatgacccaaaaattagacagaagccttgtcctggcatagcccagtgtttcaggaccacggacaaggctacagacactgtcagtcaccccaccctcaaacattgttttatacatgtatccctctaaggaaaatgtgccccaaataatgtcttatgttatggatctcctacagtgcaaaatacgtgcaaggacaacccatgtggccggggccaatgtctcattacccagagtcctccctactaccgctgtgtctgtaaacacccttacacaggtcccagctgctcccaaggtaagtggtggaggccccttcgacgctagactttctgtgccctatcttgtacctgcacccttctgcatggaaggccagatgcatctgatgtttttgtggcaggcacccaagatggtccttttccctaggctttctaaagattcattatccctggattgactccacccagtgggaattgactggtctgtgtcccttcccacccaaaaagaatcatcttgaaactcacttcttccaggaagtagaccctgatctattcctgagagggaccaagtaggggaatgaatacatatcgagtccctgctgtgaggcaggcattgtctcaggaaatttacgttctcttttgctttctccaaagacacctcaaggaagagctttacagatgaagaacctgaaatgtagacagattaactcatttgctcatggccacatgggtatcagcaggcagagctctacctagctcagacagggcccaccactcctgctccgtccatgcttctttgtttccttactgagtgacccatctacttatgcacttaggcatggcctccagccagattgcttcatccacatttgcttatgttcttaaggcttctgtgtacacttactagagtgtcagtggatctgtctttcccatctggtgacccatctttcgcgaaaggatggacaccagtagaatgccaccaatgtctccttgtcatctcagacatgggctgcaactccttctgaagagccttcctggccccattcctgtgttcacagtggttcctgtatgcaggccaaacccctgccagaatggggctacctgctcccggcataagcggagatccaagttcacctgtgcctgtcccgaccagttcaaggggaaattctgtgaaataggtatgggtctctgccaccatcagggccacaagtgaggcctctggaaccctttcctctctgggttttgttgccagaatgtggttcaaatcaagtttcccaaactcgactattgcctcagccttctcacctaaagggatagggcgtgtctggcttcctgtaaagaaagtaataaactggggtgtagtgcaggcaagtcaaaccacttgggcatccctaggccctagcccaccttccatcagttcttgtgtgagccagaattaaagaactaagctcccacaccctacaaccactatatttcatgttttaagcaggattaaatgtgggacattcaacacttttttttctgaaattcgtggtgaaatctcagggcgataaatatgcaggtccagttctctcaccatgtcacatacccaccaagccctttttgggagtggcatgccaatggctgttggttctcacattgctacctgctctctcggaggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcaggtaacatttaccttatttatgctcagttgattttggtcacttattttaaaacagatcattgaaattcatcagcctcctttctaggaagattttcttactcagcaaggcaatgttatgctgctgtagtaaacaactgccaaatgtcagtggctcaaatacatcaaagtctatttctgggctggttgctgtggttcatgcctgtaatcctagcactttcagaggctgatgcaggcagattgcttgagcccaggagtttgaggccagcctgagcaaaatggcaaaaccccgtctctaccaaaaaaaaaaaaaaaatagctgaatgtggtggtcagcacctgtagccccagctaatcaggaggctgagatgggaggatcatctgaacccaggaggtcgaggctgtagtgagccactgcactccagcctgggtgacagagtgagaccctgtctcaaaaaaagaaaaaaaaaaaagaaaaaatgtctatttcttactaatgttccatgtgtcatgtgggttggtggtgatgatggcaggggattcagctccacaggcttactcaaatattcaggatcagcaagaagagactgggaaatgaagcatgagtttttctctacctcaacctagaagggacacatcctcttcccacacatactttgttggtcagaaataatcacatgagcccacgtaacttctaggcagagatggagaagagcaagtggaaggtctgttgaaggtgatggtctctggcccaaggatgttcaggctttcccatgtgaggctaatgccaccaccctccctggtggtgatctagtttccttcttccttttctgctgcctccaggccactctgttggcttcctgccactaccctttgtctggccaaggccaatgagtcagatgagttgcaggtgagggggtctttgtatggctttgaactggcttcataaatgaggattttttcttgttttttttttttgtttgtttgtttttgtttttgtttttttgagatggagtctcactctgtcacccaggctagagtgcagtggcaccatctcagctcactgcaacctctgcctctcaggttcaagcaattctcctgcctcagccttccaagtagctgggattacaggtgcgcaccaccacacccggctaatttttgtatttttagtagagatgggtttcaccatcttggccagcctggtctcgaactcttgacctcatgatccacctgccttggcctcccaaagtgctgggattacaggcatgagccactgcacccggccatgaagatttttttttttcacaaaacactagtactttccacttgcactcaccttgagctgttccctttgtggagctgtcttcgggggcggggggagggggggcctcttggcagcctttctcagaggattcccatgcatagaattcaaagcctcaggcagaggaacccaactctcaccatgtttatgtgatgattttactctcctgatatagaaaggtcttcatcagggatctcatttcttttcctacaaataatttggtatgtcctgtggatctggcatgagacttgggaccgctttcttgtccttgagattttcctctagaagaaaagattttgccagaaaaaatactataaacacccttctgttctaaggttttgtaacctgatggaggattcaaagaaatgtggtcccagggggagcacaagagtctagcaccttcttatccaaaggttctttaataagatccagtgtgttcatcaagccttgactctgagttgttttgttttgtattttagaaacccagatgcggacgaaaagccctggtgctttattaaagttaccaatgacaaggtgaaatgggaatactgtgatgtctcagcctgctcagcccagggtaaaggccatggctgttcagaagcccagggggtgggggggatggagatttgtagggagatgtccctggcacctggtccctccctcaccctgttcttcctccacacctgctttaccaattcccatcccagtgccagcccaactgcccaactgtctgcacccaccaggatgccaagcaggtctggatacctttgtgggtttaggtcaggtagtccaactctaaactcatggtttctgactccaaatcagtgccctcaacagatatttacccatctcttgctgtttgccagccactatgctgggcactgggtgtgcaatggtgatcaaactggctgggctcccatagcctcttaggatgcaaagcattcaaattccagcctcacagtcttcctggccatctgtcctggccccgctctgtgcccacatctagaatgatgtgcccttccaccctgaccagtgggattccttccctgagcagtttcacatatgtgcctttgatcttatggttacttctgtctataacataccatcccatatctgttcttgtccatatacaactattctttgagaaccaactcaaatatcccctcctccaggaagtcctccttgatttctcaagtaaaatgttatctctgcctccttacaaaccctaaggaacaggacaaggcaccacctatacaacatttactgctctctccttttgtgtcacagtcatctgtgcaaatgtcttatctcacctattctagttcatctgaatatcctcccctctaccctgaaaaagcctccacaattgtaagtgtgcactaataatgaaaggtgcattgatgatgcacatttataattgtgggggctttgtcaaggtgaagtacatacccagtgagggatttgtatatttacataaacataatgtgtgtgtgtacatgtcaatcttaggagtcacatactttgaaatggacaagaaaaaactacattgttaattctatagacttgctttatgttacgcaatgtattcaacaaatatcaactgtgcacctactgcatgcccaccctgtctgcaccagtgcagtctctcagctctggacccctgctcagctgttgggctcagagtcatacctctgcctgagccctgctgaggaactggagggaggctgaatagcacaatttatctttcttgtgtcccacagacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgagtaggtgccgctgggagcagggaccagggtggcttgagtggctgggggtgctctccccttcccctctgagcagcatctttgtagctctgtcaggattagggggtctgatctgttcaagggcaaaagaagggctcctgaaagccagagggaaaatagctaccatgtctggaatgtttaccatgggcactgcatttattatatgacatttaatccttaaagctgtctgctggaagacaagctgaggaaggtcagggatttttatctgttttattaactgtaggatctccagtgtcttgagcaggcctttgtacatagcaagtgctgagtaaatatttgtggaggaaaagagtttattgttattccctttttgtaagtgaggatcttgaatcccgggattcttcctttaccttgcctgaagttgtatggaaagttaagtggacaagtaagatggaaaccccattctatctgcttctttgacttcttttgtcctgccctgaatagaggaaagcatgctcctttgtctgataccatcaccaatgacccttctgagtcaggtgtcttcatccatgcctcctgtgtgccttagagaagcaagtaacttctggggagctgaagagtcaccccctcttctgagctccctgtgctcatggtcaaggctggtccaacaaagtctgggttttggaggtggccatgaaggtcttccagttcaccttatagtaaatgatttctctgggattctaggaggtgctcctcaagagaggtcaagcaggcaaacattagcacctgccaatggattttagaagattggttcaagatggcaatggctgtttctttggaaggcctagggagaatgggaggtctcccatgagaagtgggtaaaagttatagcttatatttggagcttgcttctgttaataaagcacttcccttacataatcttatttggaccctaccacagcagagttctgtgagtgagacgagggttacaaatgaggaggctgagtctgcagaaggtcagatttgccaaaggccacacagctgagcagaaacagtgccttcctgaccatctcattttcccttgcagcataaaaaccagacatctaaaggtggtgctaggggaccaggacctgaagaaagaagaatttcatgagcagagctttagggtggagaagatattcaagtacagccactacaatgaaagagatgagattccccacaatgatattggcaagttcctctttcatggctttcctgagggtcttgtcctgggtggatttctctatgaccagaaagctgaagtttggttctagaaggtgctcttgattgtttttggtccctgtggaccctgtgcggtagggaatgtattccagggatttttagtttttgagggtatgtgcaaatgtagataaatgggcatatgctcttaaactgaggggaagcaatgctaggaacattgtgctatggaataggcttggcctggaatcccagcttcccaactttatcaccaggagacagctcacctcctgagccctcttttctcttctatgaaatggaaacactgatgcacaactctcagcttcctatgtgtcaggagacacaatgtgcttgcaggcatgcctggcccctagcccctggcaggtgctccagtgcaaatgcaatgacgttcctagctaccagctgctcagttctgtatcccgtttcccttttcatgagacacccccccacctctctctccttcctcaatagcttttttcccctctaatggcctgtttcttaaaaaatggattagaaatgatttcaaagtcaattgtcatttcttgacatgactctcgccctgaagtgttactccttcctgggtggaagttcaaaatatgaaatgaccacggaagaagattttcaggcatggtgggggcaggtggggctttgctgtggccaccttcatgagcaagttggagctggtgcttctctgacaaagaggtgacatcgcatccattttctacctctctctccacctagcattgctcaagttaaagccagtggatggtcactgtgctctagaatccaaatacgtgaagactgtgtgcttgcctgatgggtcctttccctctgggagtgagtgccacatctctggctggggtgttacagaaacaggtgagtcggccatgcactctcccatgacttaggtgaactacatcaaccagagaagaaaggccaaactcaactgcccttttgaagttgaaatgagtgtcatattcaaaatgcatcaaccaaagaaagcatccacctcattgatcaagctctggttaaattcctccacctgcagggagccttccctgagtttctctgatctccatatctgtccctggccctacccctaaatacttgaattttaccaagcattgaccctgcatttatggagctcttgctcccttcctagttagattggaaagaggaaagatcatggatttttgagtcagacagactggtattcaattcttgactttgtcacttgaacaactgagttttagtttctcaataatcatacttacttcccgggtttgcaagcatgatcacaggggatgatagaattctacagagacattcattaagtcagcccttagaagatgggggtcaggtcccattcatctctgtctgtctcacagtactttgctcggggttctccacacagtagacattctataaaattgtgttaaatccagctgttgatttgtctttaggatttggtctaatttttaaaagtaaccaaaggattactttcctcatagtactggcaacattatacccactactacaaaaaaaattcagaaaggtatttcatgtcttttccaaatactcaaaatatatttctcttccttcgcaaatcctgtccttaataatgaatagcgagaatcacgataaataagtctgcagaaattccacatatctgaacaaagtgaaatgtaatatacaactttgagtcttttgagaaagatgtctggctaattggatttagggtcagccagtaaactcattttacagccattttcattgtagtccatctgaacttgtcaacctctattctgctcaatatggtctggtcagcatggtgatgtctcagttgggaatcttttggagcctcaggttagaattattttgcttttcataaacaggcttctaagactttatgttcaaagcctttatgttctctaagactttatgttcaaaacatgttttgattgatgtcattatctttacaggggaaaatgcctgctctaggaagcaggtagcctactgcgcagggcacttcatccatccatccatccattcattcactaagaattgtgccagcccttttgttaggccttgggaattttaaaatggttaagagagcatctatttcctcctgaacctcatggcctacctggggaaagagaggagggaatatactatctggtccatgtatcatgaccagcacaggattgcaggtctgcactggcatggtgaaggctaaagatgaggcttttctgcccatatcctggaaaaacccttcccttctgagctaagagttggtgggcttctccctgacaatctggtttctggtggggttggtgccaccctggtccccacagtagtgactcttttctctgcaccttccccacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccaggtcagagactccaagtggtgcttgtggtaggagaggctagcaggatgtttcactaggcagaggacccttagagccctgggctgggagctaggttcagaggtccacctgtggtaaagctaagacacaggtgagctgtgtctgccccctggccctctggtgcatctgcatccgcatcaacccaggatgactcagcataatgaccacagaggtcacattgcctgcactgtctaatttaactctcacaacacactggtgaaggtgatgtcatgatcaccattttacagatgcttagagaagttatcttggcctatagcaattgggtggccagtggcagggctgggatttgaacaatacagtctgcaggacaccaaaggggcttgtggcctcagtgtagggcagcctttctgagaatcccagtaaacagggaactgtccagaagaccagtggctagaaggagaaagaagaaggcctagagctagagatttcacagtaatattaactcatgattaggactcatgtgtgcgtgtgtgtgtgtgtggggggggggggggtgttttagccctagaaaactaagtatatctgtagcctagggcctttcagaactccaagttgctgaggcttgtgactcagagacactgttgcagagagagaaggtggtggctccatcaaccaatgctaaagtgacttcaggccctgccccaagtcaaagcccattccccatagtccctttatctgtagggatcacatcacacagggtcctttctagaatcccaggaacacctccatttagaattttctgactgttgtccccataagccttctaaatgtcctggaaaacagcatgccaacattcaaatcccaactccttcagggagcctccccgtacaaaggaacccacaatgatttgctggccttgaactcactttgggatgggacatcaaggttcctctctccagggtttgtggctctcctgtgactatctgtctcttcccagtgagccaaggatgttcacctactcagaggaggggcagatgggtgcaatttgccctaaactccttcccagaagatggttaagaaaacagctcattcaggctgggcatgcgtggtggctcaagcctgtaatcccagcactttgggaggctgaggcgggcagatcacctgaggtcaggagttcaagatcagcctagccaacatggtgaaaccctgtctctactaaaagaaaaatacaaaaattaggtggacatggtggcacatgcctgtagtcccagctactggggctgaggcaggagaatcgcttggacgtgggaaacggaggttgcagtgagccaagagggtgccactgcactccagcctgggcaacaaagcgagaccctgtctcaaaaaaacaaaaacaaacaaacaaaaaaaaacctcattcaattccctagataattgaaggctttcacttgcaggctttggaaacaaatagttgtgaattgaaacctgtttctgtctcttactgtatggcttttatcagtgatgaaagcaattcttcaatctcagatgcctaaactataaaatggaaatctatctataagatcacaaggtcgtggctaagtttaaaatagagaattcattttttaaaaacctgtcagttgtagtgtttaagcagtattaagtttttgagagctatcaccctcaatgtcttcttctcctcaccatcatcatcctcgccaccttccgtgagggtttaatatgaaccaggcactgttctatatactttacaaacaatcttcacaagaaccctgggggatggggatctattgctatctatggtttacagtgtgagaaactgaggcctaaggtcacatgcctggcaggtggtagggcctggcttaaaacccaggagatctaaccccatagaccatgctgagcacctaggccacgctgccttggagtccccaacctcctcccctatgtgtgctgagggcccccgagaactcacagtcataacatctgcatcactgagagttgggaagtgcagctgtgcggctcctctgttaagcccgcgtggactcagggacggaggacactgttatcttctctcccttagagtcttgtatcatgtgagatgtggggagagccttgtcactgctttccagagaagcccacggaggctggcaagggactccaccccatccctccctgacaccccctggagagaggtgggggcatctccagatgtctctggttcacgaggatgagcttatgcctctgtttcccttagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggacatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaagaaacaatgagtttgtctttccccatggccttgcaagccagggtggctttgcagcttgctactcacgtaagctccctggagacccaggccccttgcgttggccagttccgcagcccgccgagccatttccactttgtaggagccaggaggggtccagccaacacctctggtcaggttcaagtctgatttatacttgaccttgagggtaagagggaagcaagaggaatatgtcagcagggtttggagcggtttgaccattaagtaaagaagattaaaaaggcagccacagtatgagactatgttgtctgtcatcagtaaagccagaacaaggggaacaaatttatcataagcagcatctccctggcacaggggccgcaatgtgctgtgagtccagccggcatgttgctgtctcttgcatcttcccattcaagtgacaaaagttacagttgggagtgggtggggtagtgacacctgctccacacactctgtggccttagggaagccacttcccttctctgggcttcagtttcttcccagagaaagtgcaaaggctgggttaatagctaagatcccttggaaacagtttagcatagccatcgagagcttgggccctcacagcaaaccaaaaggggttggtatcccaggtctgccacttatttgttatgggatcttgagtaagtcactgaacctctctgagcctcaagttcctcatctgtaaaatgaagcagccctggggttggcataagtgccaatggcaggaggcttggaaagcatttgacacagagcctggcccacaggagacactcgagaagtggtggttattattgttattctttctggcactaaagtgttaggtgtcttggattctctctcagcccagctcccccagaagctaacaatggaacgtggcattatggccatctcttaggaagaggcaccaggggaagggcctcaagggagtgggtggaggtggctcacatcactctgcagctggtgggccttctgagcatgcctgaggcccagctgctccgggtcgcaggtgggctggggcaggggctgcctgtagtgcacatcactggccagctgctggctcctcttggcctgaaggaggccgggctggtctgtgctgctgtgaaactgggaccgactcttggcaaagtccttcttgtactcattgtcactctggagcctgccaacgttgaggaaatgcttcatccttgggtcatcgtcgacactgcggtacccgatctgcaggcctcggtcccgcaggaaagcctctttgtaccggaactgcaagtcagaggagcagaggcagatcatgggtgcctacctcccccaggaccagcctcacatatggggccatcccagggcattctcagcaggaggctcaagagtgggttagaggcacaggctttggattcaaatagacctatctgtgtggccatgggcctgttactgagtttctccatgagcctcagtttccccatctgataaaattggagaatgatctacaccccataggaggttgcgaggattcaaccagataaggactgagcttcatgtctggcatcagctctggcccactgagtggtggctactggtattgtcactattgtaattaatactccaacaggaagataaatgtgcccattctcacataggccactctgcctttgattctttccagcttttagggacctagtccagtgctcctcaaaccatctacagtgaagggccagtcccattttgatttgctttttacatttccaatgcatcaaagacccatgtatggtcctattgcatgtggctagtatgtagcagtaccacttgtatttggtaacacccaacctggccttcacccttttcaatgagatgagtccagtgatcacatgcttggatgttacaacgtctaattgctaaaaaatatttcaaaaatcccatgctcttaatttctgtacttatccaattgtggaccagcaggaaactgttcccaggtgcgcc

SEQ ID NO: 12330 - DNA, 34414 bp, Human
catagtaggtgctcaataaatatcagtttctttccaatttctgctgggtgctgcaaggatctcaggaaatggaagactcagccgtgcctgcaaggagccatcagactggtggtgtggggactgaggggagggacggatgaggatcccaacaaacctcagccccagtgacaggagcaacacggtacagaggagcagagaggcctggactgtggggttccctgtgcttaacgtgggacattctgatcttaacctcagtgcctgccagtgctgtttgtgacctattgggagtcaccctgttaatcccaccacattcagttggttgaggccatcatgaaaacctgcccaatttcaagggaagggggcagaaacattaccttttgatggaaggaatatcaaagaattcgtgggcatatttttaaaggaccacaattatcaaaaagcagagtggttaatgctgtggtggggaaagcgcaaagggttctgggacctcagaggggaccctttctagaatccagagaagcatgggagtggtcagggaaggcttcctgggggtgagggcaaagcagaactcacaaatgtaagcagggctggggcaaaactctaaaaattaaacacagtctgtactataaattttgttttccagaatgaaattttactatctttacttactgcgaatatatgcccgggaccatacccccaagaaaataaaaattttagaggctgggcatggtggcccaagtctataatcccagtattttggaaggccaagcgggaggcttacttgagctcaggagttcgacaccagcctgggcaacatagcaagacctcgtccctactaaaatacaaaaaattagctggacatggtggctcacacctgtagtcccagctacttagggggctgtggtgggaggatcacttgagcccaggaagttgaggttgcagcgagcgatgttcatgccactggactcctgcttgagcaacagagtagactttgtctcaaaaaatgaaaaaagaaaaaaaaattgtacgtatcaacaagcaaaaacttttttaacacttataattctacccccacaaccagagacaatgcctcatgactccttgctaaatattttccagattgttgaacatagaagcctattttgaaccccccaaaatagaaccttactctatggtgccattggaaacggatgcctcatgacatccctttccttgccaagaaatacctttatttctgcagcctcactttaagggacatgtcataattcatttaaccaatgcccttctggtggatacatgaggttgggtctcacttctcctgtcctgtttcccacagcatagcagtggtatcttggagcagtgatttactggcacactgactcaattatgtatttaagggcaagtccctgaaattgaattcctgggtcacagggcatgcaactgtttaaacatttgccaattgccttccagaaaatttcaccaccagcaaggtttgagaaacactgttttcccattgggggaaacatttattttttaaataaacgagccaatatattttaaaaaagagagtttggttggtgccagatgtagcttcactctcaaccctgccgtctgctgggggtgagatctcaagggagctatgtggcttttttgaacctcagtttcctcatctgctaaaccaggccttcctagccgagctcttaagagactggctgagatgaggcaagatgaacagtgatgaatatggggtctttctgtggggagggtggacagggatgatcataggagtcaggcttcctcatccactgatctaggcagtgaaaactggcttctaagtatgaccttatgacttcagtgatgtcgcaagcaggttccagtccctgtgcctccccttcccgctcccaggaacccatccagcctcaggaactgcccccagccatcgagccttggctacttaagggacctgggcccaatccacagctgggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatggtaagaagccacatctgctggctggacttggcaaacccacgctccaggctgctctgggtacagtggggacagggagtggggacacagaccggaccctctccctggggcagtgccaccttctgggtcaggtggctctggctcctattctggccttactgcccaccagctgagtgccctgggcatgttatttgtggtagtgaggtcctccaccagccaacagaacacagctttgcgtgcaagtagttgatttgggaaatgattccaggaaacactgtagggaatcggtactgagatgaggaagggagggcagccaggagagagtgtgcaattaaaccagccaccacctctgatgatgggaaccactcagctgggaaaattctgcgtaaagtttggaaacacatgcctctgaactggaagtcagaattgtggtcacctctagaggcaggcagagaccctgaagggcatgagggaggtctgccggggtgctggaagttgccatatcttgatccaggtggtgatcacattcctgtataaacattaaaaattatttagcaatacctttaaaatttgtgcccgttaggtactttatgtatattattcctcaattttaaagaatgggcaggccaggcacagtggctcacgcctgtaatcccagcactttgggaggccgaggtgggtggatagcttcaggccaggagttcgaggcaagcctggccaacatggtgaagcctcgcctctcctaaaaatacaaaaattagccagtcttggtggcagccaactgtaatcccagctacttgggaggctgaggcaggagaatcgcttgaacccgggaggcagaggttgcagtgagccgagatcatgctgctgcattgcagcctgggcaacagagggagactgtctcaaaaaaataaataaaaataaaacaaagaatgagcaaaagtaggagtatttttttttaaatactgaaacaaagcctcccgactatccaggtggcatgggaactgggatatttatacaccacagtgattgattgagggcttctgggccgggggtttgtcaactccccagcacttctgtcctgttgcatgtacctgctttctgcagttccaggacaaaaagcctcgggacatacaggctcagggaggcagacattggcagctgggagtcaactgtcactcactggaaagactcaaggatatggacaggcactgaccacatgtcttctcacatccctagagcctcaattgccttacctattaaatgagataacaacattcccttagatagggttgttgggagcccagactggctcgagacaggcagagggaaatcagggaaggattccaggatatagtaaaatggaaaagacagtgggaattacccagggacaaggggtagcgttccaggcggaaggaccccaacatgtgcgtttgctagagggagaagagcaaattggaaagaggtgaaaggggaggctgctggtcatctgtgtacccatgtctgccttggggacagaaacctgggcccctcagatctcggaacagtgggacctggtaactgctacttgcattgaaactgtaaatcagggaagtttctcttttgttcctttgcactgtgcacacacaccatgtttatgtaaccagtcctctgaggttggacattttggtcctttccatattttttttttttttgaaacggagtctcactctgttgccaggctggagtgcaatggcacaatctcagctcactgcaacctccgactccctggttcaagtgattctcctgcctcagcctcccgagtagctgggattacaggcacatgctaccacgcccagctaatttttgtatttttagtagagacagggtttcactatgttggccaggatggtctcgatgatccacccgcctcggcctcccaaagtgctgggattacaggcgtgagccactgcgcccgacccctttccatatttttaataatataaaccctatttgctgttccaggcatttactgagtgcctgctgtgtgtcaggcaccaagctaggagtgcttgttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcctcccgggttcaagtgattctcctgcctcagcctcctgagtagctgagactacaggtgcctgccaccatgcccggctaatttttgtattttttagcagagatgaagtttcaccatattggccaggctggtctcgaactcctgacctcaggtgatctgccctcctcggcctcccaaagtgctgggattacaggcgtgagccaccacgcccagcaaatgtattgttgtcattgctatttgacagatgaacaaagtgaaggttgtttggggactttgtcaaagtcacccagctagaaagatgccctctttctctagcccccagatccttccagtttcttctacacaggccagatgtcatggagaacaagaaggaggactatccgtccaagcgcacagcacttttgcccttggggatttgttggcaaaggcattccatttcctcatcagtaaaatgggcatgaacctaacaatgccacagaaatgcagggacacctctgaatgtccctcatgctacctggcacacagaggggctcatatcctgtcattgtacttaatgctaataaggatgttggcccctctcttgaggacaggtgggagccaccgtagggtttagagcaggggaggaggcaggcagatcaagctgactcccagctatttcctttccacagcggcccaggaggggctattggctctgcagagtgagctgctcaggatcacgctgcctgacttcaccggggacttgaggatcccccacgtcggccgtgggcgctatgagttccacaggtggggctctcccttctgctgcggctctgaagtggctggagctggctgtcagggggaattggagagtgaggaagagagagcctcaggattgggctgtggggggacctctccggggcggacagtgggatagttccctgaagagctcagaaggaaattctgggaaggaattgagctcctccactcagtcacgcagcaaatattaaggaagacctactggctgtgtgatctgagccttgatttccttatctgtaaaatggagttgatctacttcctccttcagagtgctcatccaagatccaatctggccactagatatagtttggaagagaagatagaccttacactttaaatgtagtagcccaacggttagagctgaagtttgtacttgggggagtcagggaaggcttccaggagaaggtggcatttgagccaagtcttcaaaagattactagacttgagcagctgatgctttaaaagagcgtgaactgctttttgagggatgggcagtgaagaaacgacaatcagactcgtagcacattgtacccctccctgctcactgctgttgggcgtttccttcattcctgccttcttttattcagtccatcagcaaaaatctattgggcacctactatgtgcccggcaaataaaatagaacttgaccgttcttttcccactgtgacaaccttgctgacttttttggggtcttatcttaaggctgccaccatcttccctgaatctgtttcccccctacctggatgtattgagagagaggagggttagcaggaactgcaaacccaaagggatatgtctacggaccttctcaggatgccaccgggggtcattagattcatgggttctgatgcagactgcaaaaccgtgagcaattgcatcccttcctcaaggttctatttccccctttgtggaaagggagcaagaacactgctgaccccttcagtgtggcccatatggcatgaagaaagtaacgtgcttagcatggtcataagatcgatgcctggggcacagcaggtgcttacctggagcagatcctgctggtctagtccccactgtggagaggggaggcgcaaggtccctggtgaggctgggtccaggcccagggctgacacctccttccatgtctctcccttcagcctgaacatccacagctgtgagctgcttcactctgcgctgaggcctgtccctggccagggcctgagtctcagcatctccgactcctccatccgggtccagggcaggtggaaggtgcgcaagtcattcttgtaagttggctctgctcccaggccctggagctcttggccttggccttcgccccatccttcttaggtccaaggtgttcctagcttatcagaaaggccacgtgatggacagatggagtccaagcccggaggtggcctggggattgagtcctggctcttggatgagtgtctttctgtctctgagtctctacttcctcatctcccaaaggggacgggcctgcttccttgatggagtcatgggagggctaagtgcggtaatatcatgtctccttggtttgcttcccacagaagcagactttagggcaagaattccagtgcaatactttatcttggaagcgatctgaggaaacccacaggggagtggggaagtgaggaagggaagggaagggaaggaagtcagcctggtgggcaagtgaagctctgtctagctggggaactcagggacagcggagaacacgcctctgagttactccagccccacgctgtcaccccgtcctcctgcttgccattggccaagggctgcttccaggggctctggctctcaggcactttgaacagttctctgacctcagaggcacttggatggaaggggtattcatgtgctagggctgccataacaagcatagactgggtggcttaagcagaaatgtgttttctcacagttctggaggctgagggccaaggtcaaggttttggcaggcctggtttcttctgaggccactctctttggcttgcagatggctgccctttggcaatgtcctcacgtggtctttcctctgtgctcaagaaatcccatttctgaggccatgcacgttggctcacccctgtaatcccagcactttgggaggctgaggcgggaagatcacttgaggtcaggagttcaagaccagcctggccaacatggcaaaaatcagtctctactaaaaatgaaaaataaattaaaaatttaaaaattagccaggtgtggtggcaggtacctgtaatctcaactactcaggaggctagacagaagaatcgtttgaaccctggaggcagaggttgcacagagctgagatcatgccactgtactccagcctgggggacagagcgagactccatctctaaaaaaaaaaaaaaagaaaaaagaaaggaaagaaaccccgtttctctctgtatgtcctaatctctttttataaagacactagtcacattggattagggcccaccctaatggcctcatttaaatgtaatcacctcttcaaagggcctatctccaatactgtgacattctcaggtactggggatcagagcttcaacatctgaatttgggaggcaggtggtgacacagagcagcccatagcagaaggaacagcccaaatatgggtgatatgaccatatttatacttcagacctgcactgcctaaaatagaagccaccagccatgcctttactgagtacttgaaaagtgcctggtacaagttgagatctactctaagtatgcaacactggatttgaagatttaggattaaaaaacaaacaaacaaacaaaaaaacagcagctgagcacggtggctcatgcctgtaatcccagcactttgggaggctgaggcaggtggatcatttgaggtcaggagttcaagaccagcttggtcaacatggtgaaaccccatctctactaaaaatacaaaaattagctgggcgtagtggcgcatgcctgtaatctcagctacttaggaggatgagacaggagaaccgctgtagcctgggaggcggaggttgcggtgagccaagatcacgccactgcactccagtctgggcaagagagtgagaccctatctcaaaataattaattcattagttaattaaataaaataaattagccaccacacctggctaatttttaaaattatttattataaataaataaatctcattaatattttttatattgattacatgttgaaatcatactatgtattactaaaattaatttcagctctttctttttatctttttaatgtatcttctggaaaatttaaaattacatgtgtggctctcattctattgctttagaaagacggctggtttatatgttacctacatatgcacatttgttctagttccatgaaaggaactggccacactctcttaccctggcttttgtcactgaagtatcttaaatatctctttctatgggcatatgactatctacctcattttttttcacttttttgaatgtgcttttaaaaattgataggaaattcacggaacataaaattgattatttgaaagtatacattcagtggcatgtagtacattcacaattttgtgccatgtccacccctatctgactccaaaacattttcatcatcccaagagaaaattccttacccattaaacaatcattccccatttcccttcccccagctccagacaaccaccactggggttggagactcctggaatagaccacattttgccccattgttctcaaaggctgcataacattgggtgcccacagcttattcaacctgtcgctgctagcggacatgtaggctgcttcctttttttttttttttttttttttttgctactgcctatgatgcttcagtgagctgccccacaccacgcgtatatcttggcaggaagagctacgggataaaggcttagaagttaaattactgggccaaagagtatgtatgttagaacgaggagagatctcactgatttgtgtttcagaaagcttgtgccaatgtgcactctcccagccacagtgtctgggacttctgtttactcgtacattcaatagcattgagtactaaaacttcaaaagttttttttgaatctgataggcgagaactggtgtcattgttattttcatttttaatgacttttacatgcttattttgtactgcatttcctgttcatatctttttttttcttttgagttgttctttctttccttgttaatttatattggcttgttctttgtatattagggaaataagctcatatattaaggaaattggctctttagatgtctcatactgcaattttttttttactttacatatggcattttttttgtccactgaagttttaattttctatgccgacaagtttatcaaggatttcctttatggcttatgagacttggatattgcctagaaaggccttcatccagccctgcctggaaatactggatctgggctttcttctagatcttttatggctttatttgttattcttaaatctctgctcagctccatgtatttggaggtcagaactgagccttctattttccccacaaatggtggcagacccctggtctaggaactaaccatggcttctcttacctcctccagcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtaggtctccatcggggcactgccagctggactcctggttgcagctcccggccaatccagcgctcagcctggcctccgataattgcaatgatccaggtggcttgcacaggcacttgaagatcattctctggggaaccctgttgagatgaacagacttaagccaggaatattggtgcatcattttcattaaaaaaataaactttcattcacctgacaaggggacccttgtcaggtgaatgaaatctggctatttggaggaacacagaaactttggttgaaggagagtttgcgaaaaacatacaagtccttggacaagtcatttcatctcttctagtctcagtttccttgattagaaaagtgtgaccgggtgtggtggctcacgcctgtaatcctaacaatttgagacgccaaggcagaaaatcgcttgagctcaggagttcaagaccagcctgggcaacgtggtaaaacctgtctccacaaaaaaatacaaaaattagccaggcatgatggcacatgcctgtagtctcagctacttcaggggctgagttgggaggatggcttcaggccaggcgacagaggttgcagtgagctgagattgtgccactgcactccagcctgggtgacaaggtgagatcctgtcccccacccccccgcaaaagaaaagaaaaatgtggattctcaagccgcttccccaaatctgctgaatgtgatcatgcgattgggtgccgcaggcactgggaagccagacacaccgaatcaggctggatgtgctgggacacagcagggcgccgggaaggggtggagagggctccctttgtggactggcctgaccagggaccagggcctggctttcccaggcacccggccatccccaagttcagtggcagactgtgcttctctccccaggtggctgttgaacctcttccacaaccagattgagtccaagttccagaaagtactggagagcagggtaagaaggtccaagcctctggcctcccccgagcttggcgagggctgaatggaagacctcactgaccaatggccctggaccaggccatgggggctggtttagacgtacttgggcccaaagcccagggaggacaaatcatttgcccaggtcatggagctgttgtggggcacgctggggacaaagctccaagtccgttcggttgggcagaaaatggtcaactgcttgaccaagggttaaacagcaggggctaaacagagactccagcccctccctctgctccaccttgctcagtgccccacactgccctgcattccaccaaggtccgaaaggaaaccattcctcaggcgcctgcaagagaccaggcaggaaagctcagcgagggcgtgggccaggtgggaactgggcgagctcatgagcaccagccctggatggggaggcagcaacactgtcagactggcctgttaaaaaggagtatgtgaaatcttcagagtgtatcatctttgactaaatcaaaaagatgtcgtgttaactttcagttcctctaaacactcattcatcccaaaatcccgtttctgagatattagccaaatggtatctgtagcaatgactgtgggaagggagaaagtgatggaggaggaaagggaaaaaaacacacacacaaacacacacacaccacaccccacacacactccctcccagcacacacacaccacacacacatcctacacacaagcaccccccacacaccacacacacacaccctccacacacacacccacacacatcccacacacacacacaccccacacacaccctccacacacacccccacacacatcccacacacacaccccccacacacaccctccacacacacctaacacaccacacacatacacagcacacacatcaaccccctcacacacaacccacacaccctgcatcccccccacattcacccctcacacaccacacctcccccatacaccctccacacacacccccacgcacataccacaccccacacaaacacaccccacacacataccataccccacacaaacacacacaccccacacacacaccctacacacagacagcacccacacacaccacacgcaccccctacacacacaccacacacaccctacacacacaaaacacaccacccacagaccacccacaccccctacatgcacacaccacacacaccctccacacacacacaaacacaccacccactcacaccccccacaccacacacacgcgcacacacacacacacacacacacacacacaccctcgtctgtaggtccaacctctggtttggctttgagtgccccctcgtggttgaaacaggaacagcaggcaaaccccgcattttgggtgtggccagctgtgctctttcttttctggttctgggtccctgggattaagtgaccctgagaaatatgccaatctactcaggcaccctgttgccatattgctgtgcataacaatagtaatgtagcacaattataattatcacagtaatcacataccataattattgttttgataaatgtatataattaatgctgtacagaatatattattgtataactattctgatttataacaaaaatggctgctatttcttgagcctgtagcttggccagggataatgggctcagcagttcacgtgcacagtccctctggatctctctttttttttaattgagacagagtctcactctgtcgcccaggctggagtgcagtggcgcgaccttggctcactgcaacctccacctcccaggttcaagcaattcttctgcctcagcctcccgagtatatgagaccacaggcacgtgccaccatgcccagttaattttttgtatttttagtagagacggggtttcaccatattggccaggctggtcttgaactcctgacctcatgatctgctcacctcagtgtcccaaagtgctgagattacaggcgtaagccaccacacccagccagtcccattggatcttaacctcgaccttggaaggaggtgccattttccacatggacagaggaggctgaggggtggagtagctttcccagtgtcaccttgctggtgagaggctgaatcaggattggagcttcctagaatgtggagcagcttgtaccaaagcccttctagggctaggtgtcttgggaaagatggagatctcacctgacccctgatccttagagatcttcgaattatcttccagaaaaactaagagcctgacgcaggcctttctaattccccactcagggtgggatgtggtacctggaccagcaaggctaaggagaagaataagcactcacgaatgcttgctctctgggcgatatatactcactatctctatccccaacttcccaaaatattaccagaaaggggtcctgatccagaacctcaagagagtgttcttggatctcacgcaagaaagaatttggggtgagttcataaagtgaaagcaagtttattagagaagtaatgacggaaaagaatggctactccacaggctaagcagcaacatgggctgctcagtcgcgtatacttgtggttatttcttgagtctgtgctaaaggggtggattattcatgagttttcctggaaaggggcgaggacttcccagaactgagggttccttccccttttagaccatatagggtaacttggaaattgccatggcatttgtaaactgtcttggcactggtggtcatgtcttttagcatgccaatgtattataattaacatataatgagcagtgaggatgaccagagggcactctcatcgccatcttggttttgattggtttggccagcttctttaccgcatcctgttttatcagcagggtctttatgacctgtatcttgtgataccagtcctgctgacctcctagctcatctggtgactaagaatgcctaacctcctgggaacgcagcccagcaggtctcagcctcattttgcccctgttctagatgaagtcactctagttataacaccactgacaaaaacaccctgggaagcacttggccttgccattgtatcttgtgagtgagaaccaaaaagcagagagaggttctgcaaaggtcaaacagccattggggactgggcaggatttgaatccaaatttacctggctttcctgctgcacccctaaccactaccccagtcgcatcctcaggaggccctgctgtgtgtctgcaactcaggcatcccatgcctcccctgcccagtccttcgggtccctaaagactggggcatccaggctccaggcttttgggatggtctgatgggctactgtctgaaggaaaggcaagaaaggagcggtcttcagggagatggatggagtttcttggttcccttgcaatcaaccacgaatgttcctcaccacacttgaccttgctttctggcagctcatcgctgctaaactcctctcccagaaaatggagcagctgcaaagagaggttaagatacagccctttgccctcccagcccccagcgtcacccttccatcagcaacccagcgtctgatggatggtgcctgcttacccttcagcacagaagccatctgtgacccctgcactaggccagggctctgcatgtccctctccttcactgtacatgtggattcattgcacaagaggtggtagctggctaacaaaaagagctgtttaaagtgaggactttctcatcgcacatcaacaaagaaaatattgacgtatgaacccaaatgttttaatggtggagtttcaggcagcgtctccagtgccccctcttcgagctgtgtcagtgaaggcccacagctattctttgaaaatggtctcttgattgacattgcccttggtctttcctgcataaaacattaaactgctacaaattccatcccaggtttctttaactgcaatgagaatttaaagacatttgcaaagccatcccagtgtagaatccttcttgatctttatgattttttttcctcctaagattttctgttgtctgttccaaatttaatcttgcttttagaggggtttttttgtttttcgtttttttggttttttggttttttttgcacctcacctttccagagtatttatcttaggttttcatagaaagaacccttatagctggggccgggcatggtggctcatgcctgtaatcccagcactttgggaggccgatgggggtggaccatttgaggtcagaagttctagaccagcttagccaacatggtgagaccccagtctctactaaaattacaaaaattagcagggtgtggtggcacatgcctgtaatcccagctacttaggaagctgaggtaggagagtcacttgaacctgggaggcagaagttgcagtgagctgagattgtgccattgcactctagcctagataacagagcaagactgtgtctcaaaaaacaaacaacaacaaaaaaaaaaactcttttctcaatgatattgcattagtgtacataataaataattcgagtaattacaaaagcaagtacagcaaacaggtggtaggctttcatgtggactccagtagggcccagttggacttttcaaagtctatcccaaggctgcatcataaataattcgggtgattacagtggcaagtacagccaacaagtttggaaatgcacatttccttctcttgagaagcaggccgcacaactggtggcaattgtgtgtgagtagcctacagaccccagcattcagtcttccaggagtaccagcaggaatggggaatactgatcagtccagccaatctgttcaggatgaccattaagaactatctacaggccgaatgtggtggctcacgtctgtaatcccagcactttgggaggccaaggcaggtggatcgcctgaggtcaggagttcaagaccagcctggccaacatggtgaaaccccgtctccactaaatatataacaattagctgggcgtggtggcacatgcctgtgatcccagctacttgggaggctgaggcaggagaatcgcttgaacccaggaggcagaggttcacccaggagggtgagccgagatcgcaacactgcactccagcctggccaacagggcgagactccatctcaaaaaaaaaaaaaacaaaaaaactatctacattaactgtatgtttatttgtgtttatttctagttagtgtctagttctgctattaaactctaaattctgagaggccaggacctcccaaaggaaaactttgtaatggtggagtttcaggcactgtctccagccagtgccccctcctcaggctatgtcagtgactccctagctcaggtgtccagccctgggacagactgaaaagtccaactggaccctagtggagtccacatgggggcccacatagttttattgtttgtatttccttggtacctggctcatgacaagcacttataaatatttgtaaatcagtgatcactgagcacatgtgtggaataatgtgactgcagtgatcagcacggggccagaccagagctggggaactcactcagtcattctcttcccatgtttttcagatttgcgaaatgatccagaaatcagtgtcctccgatctacagccttatctccaaactctgccaggtaggacaccccatccatcccgggacacttttatttctgttaatttctataagagcatatatatatcttataaaatagtaaatggggcaaaaatatagaaagtaaaaattaagggccaggcgcagcggctcacacctgtaatctcagcagtctgggaggccgaggcgggtggatcacctgaggtcaggagttcgagaccagcctggccaacatggtgaaaccctgtctctactaaaaatacagaattagccgggcgtggtggcgcatgcctgtaatcccagctactcgggaggctgaggcaggagaattgattgaacccagaaggtggaggttgcagtgagccaagatcacgccattgcaccctaccctgggcaacaaagaccgaaactctgtctcaacagaaaaaaaaaaaaaaagaaagtaaaaattaaaagttcatttttctcccccacttttcttccaagaagtaacttctgttttgggtgtatcttttcagatattttctttgtatgtacaaatataaatacatgtaagcatataaatagacattcatgtatgtattattttgttcatgaatctatgtgtatatgtattattttaaatatatatgttcatatacatatagtataggcattgttccagatttcttttttttgagatggggtctcactctgtgtcccaggctggagtgcagtggtgtgatctcggctcactgcagcctcaaactcttgagctcaagtgatcctcctgcctcagccacctgagtagctgggactacaggtgcatgccaccacacccggctactttttgtattttttgtagagacagggtttctttatgttgcccaggctggtctcgaactcctgggctcaagtgatctgcccacctcagcctcccaaagtactgggatgacaggcacgagccactgtgccagcttgatttcatttttaaaaactttttattgaagtatatttataaagaaaagtgctcaaatcataagtgtgctgttaaagagtttttacatgcatgtaaccagctcccaaccgagaaacagaacacggctggtttttcagagcccctggtgtccccctcggtcactgcccagccctccagggtcaccaccatcccaacttctaccagcaaagattagttttgcactttgcacatgaatggaatcagacaatattttgagtctcttttcaaaagccagaaggctttctttgttcaactttaaaatatgaggtcagggctgggcgcggtggctcacgcctttattttttgttttctttttttttttttttttttttgtgagacggagtctcgctctgttgcccaggctggagtgcagtggcgcaatctcggctcactgcaagcttcgcctcgcgatttcacgccattctcctgtctcagcctcgcgagtagctgggactacaggcgcccgccaccacgtctggctaattttttttgtatttttagtagagacggggtttcaccatgttagccaggatggtcttgatctcctgacctcgtgatccgcccgctcggcctcccaaagtgctgggattgcaggcgtgagagctcacgcctgtaatcccagcattttgggaggccgaggcgggtggattacctgaggtcaggagttcgagaccagcccagtcaacatggtgaaaccccgtctctactaaaaatacaaaaattagccaggtgccgtggtggatgcctgtaatcccagctactcgggaggctgaggcaggagaatcacttgaacctgggaggcggagtttgcggtgagttgagattgtgctactgcactccagcctgggcaacagaacaagactctgtctcaacaaagaaaaaaaataataaataataaataaacaaaataaaatatgaggtcaggtcaggcttggtggtgcacacctataatcccagcactttgggaggccaaggagggagtatcacttcagttcaggagttcaaggccagcccgggcaacatagcgaaaccccatctctacaataaatacaaaaattagccaggcatagtggtgtgtgcctgtagtcccagctacttgggaggccaaggtgggaggatcgcttgagcccaggaggtcaaggcagcggtgggctgaaattgtgccactgcactccagcctgggccacagagtgagatcctatctcaaaaagaaatgaaataaaataaaacatgaggtccatgcatattgttgcatgcacctgtagtgtagctggtttattctccttgctgcatagtatatcaccatgtagatgtttccccatttatttgttcattctactgttgaaggccatctggggggtgttcagttttaggccattatccgtagtgctgctataaatgtcctagtacctatggtcgcatgtctttgggtatatatctgggagtgaaattgcaagctcgtcatatcatgtgatatgcccagattcagcattataagatcctgccaaacagttttccaaagtggttgtaacagaccttatttgttaacagccgtgtagtgttccatcacatggatgtgtcttcatttatttaataagtcccccactgatggacatttaggtgctttgctgtcccttgctattgccaacagggctgcaaggagccatctacaagtggagtctctggatccagggtgcacacattaagctcggagggggagaccctggcaaattatctgagatgttctctgatgccttagctcctaagcccctatgcggttatttgctgacatcacctttaccagaggtccaggtcggcaacccggtactgggacttggaacattcatccattcagggttttggaggggagtgtctgggccctctggacatgccatgcctgaccttcctggttattggctcagcattaagctccaggtgtggctggagaggtgaagcctggactcatggtgtgtgtgtatgtgtgtgtgtgtgtgtgcttgtctggaaactgcttaggccctaggctgagcatacacccccaccattgttaactcatccaagggaatccatgtagtgtctttcttgaagaagcaattctttgcctcagggccgggctagtagggggattctgaagaaagtcacagggaatgtgagtcagccagagcccttgcccctcctccagcagctgaaagtgtcatctggcccctaattctgccctgtcctcattcacagttacaacagagattgacagtttcgccgacattgattatagcttagtggaagcccctcgggcaacagcccagatgctggaggtgatgtttaaggtgagggtcctggggccgggctgcgtgggtgaggctttccctcagggtcagccattctttgggccacctgtccccccaacttcagatctgtcctcatcctcccagtggttcccgctttgtcaagggccgggtgatatggagtggtggggagtgtttccagagctaggattctcccacggctgtcttacacctctcaggtcttaacgcttccctcctccttcttcccctactttgccttgcccatcatgcagaaaaggccaatcagagcgggtcttagggagtgtagatgggcctagggcatatagaggggctggccaggacttcctgtgggttaatgtagcaaagcttctggtgagcttttcattaaaagacataacactgcctttaatggtggagtttcaggcagtgttccagccagcgtcccttcatcggactgtgtaggggaatacctagcccctgccccacgataggctttgaaaagtccaattggaccctatttccctctccagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatggtgaggatggtggcaaacaggtctctcaaatgaacacataacctaccgctccttccttctttccttttcacccctgttgacatcagtcaaatagtgagttatagctaagagaaaaatcaacaccaagaaaaatatgttagcacaatctccctttttactttggcaaccaagaaactcaaagccaaagttctttctcccatggctgggtgtggtggctcacgcctgtaatctcagcactttgggagcctgaggcgggcggatcacttgaggtcaggagcttgagaccagcctggccaacatggcaaaaacctgtctccactaaaaatacaaaaattagccaggtgtggtggtgtgcgcctgtaatcccagctacttgggaggctgaggtgggagaatcgcttgaacccaggaggtggaggttgcagtgagccaagatcatgccactgcactccagtctgagcaacagagtgagaccctgtctcaaaaaaaaaaaaaaaaaaagctcttcctcccttataacaactgtggaagactttgcagcttacttatctgtgttttgcttttctagacctgtttactagtctagacttgttagtctaattcatattttctctcatcctgatgatttctggaggtttattaaaaaatattttagtgaatgaggccgggcaaggtggctcatgcctgtaatcctcgcactttgggaagccaaggtgggcggatcacctgaggtcacgagttcaagaccagcctggtcaacatggcaaaacctcatctctactaaaaatacaaaaattagctgggcatggtggcacatgcctgtagttccagctacatgggaggctgaggcaggagaattgcttgagcccaggaggcagaggttgcagtgagctgtgatctcactacttcactgcagcctgggcaacagagtgagactgcatctcaaaaaaaaaaaaaatatatatatatatatatatatatttatatgtgaatgaggcaagataatacatgcactgataaatgcatatattttcagagaaaaggaaataaagaccaagtgaaaataaagcacaattataaagacactgagcccttaaattaatttctttaacatctcaaacctgtcggggagcttccttgtagctaaagtgaaaaagatacatgatttcatgattcatggtgaaaaggagagacagtcttcctcacacccccaaaacaactgtttccaatgtggctttgtataagggagactgaattttacagtggatctcacctttaatggttctccagtttatctaatatttctgggtttcaaaaagttgtttcttgaagcacttcataaaagttgaggcctcatgaataatgtcaggatggtgggagaaacagtgtggttcggctcagacggtccagcttaccctggtataagtcaggggccgtctggtagatcgagggtcattttgtccttctgatggcctcctacacctgcacaggccttcgcttctggcatcgtgtttggtttacccatcctactgcggcacgggcctctctttcaatgggatgataatagctacgttttatggagcactcaccatgtgctgggccttgtgctaggatgttcgtttaggcctcacagtgactcgaaggtggggactattgttatccccattttatggataaggaagttgaggttcagggagatggaagggctggcctgagatcacaaagtcaggacacaaaccgaagtctgtgtgaccgcaaacctcaccctcgcagaccctctgagtgggagccacacatcagctgccccccggggagagcgggcaggatgctgaagtcccatgtgctctccttgggtgaatgcaggacaggcatctcctccctgccagggtaacccaggctgtggagaagcgacagtcttgcacatccccctgtctccccaatcttctttagaccttcagctccagcgggagcaccctaaaacttcttcatgtctctttgctgcagataccgcctgactctaatatccgactgaccaccaagtccttccgacccttcgtcccacgggtaaggagtcccttagttccccatgagtgcagaccgagcctactagactccagaggtttctctttaaaacctctgcatctctcagcttgaccaagagtgagaaggccgggatgagactcccactgaaggctggggtgctgctcctttcaaagcctaaataacagaggccacgccccatatcttgtgggaccacagcttgtccaatcttttattggtgttatctaagaatcccaaggaatgctggcatagtccataaaatgtaccctaatgaacagcagctaacaattacagggggcttcctaggtgccaggcatgttcttggttctttaaaaaattattttttggccaggcatggtggctcatgcctgtaatcccagcattgtgggtggccaaggtgggtggattgcttgagtccaggagttcaagaccagcctgggcaacatgacgaaaccccatctctacaaaaaatacaaaaattagccaagcgtagcggcacatagctgtagtcccagccactggggaggctgaggtgggaagatcacctgaggctgcgaggttgaggctgcagtgagctgtgattgcaccactgcactccagcctgggcaacagagtgagaccctgtctcaaaaaaaattattaaaaatgttagtttttgaatgggaaataaattctcaaggttcaacattcaaaagatctagaaggttatagagtggaaagtctcacatccactcctattccctaaccacccagttcccatctcaagtttgccaatattaccagattttacatatctttctgatgatattctatgtatatacaggttcactatctcttatctgaaatgcttggaaaagcaactctgcctaccttcttagtgaagcattttaccccctcagccttccaaatgtctcccttctagaagaggatgtaggttttacatatacataaccaaaaggttcatgggagtgctgtttttccacgaatagcctcctaaaaaggaagagtcttgccccaaattaaactctgtacctatctctagtacacagaaaattaagagcacttttgaaatggtggaatctagggctggtcgtggtggctcacacctataatcctagcactctgggaggccaaagtgggggggtagcttgaggccaggagttcaagaccaacctggacaacatagcaaaaccctgtctctattttagaaagaaaagttaaaaaagaaagaaagaaagaaagaaatgttctgtggaatatcatattaaaagagtaatacgagaaaattaaatattttttttaaaaaagaaatggtgggatccagctgtgtcatatttcgaaaacactggcatctgacctcagcatgcccaattagcagaatgtgatgaggggatggagaaaccttgggagaggtagggagggagaaaaaatgggcccaacttttctggaggacaatttggcaatacctgccgaaagttttaaaagcattgctggccaggtgcggtggctcacacccgtaatcccagcactttgggaggctgaggcgggcagatcacctgaggtcaggagttcaagaccagcctggccaacatggtgaaaccccatctctactaaaaatacaaaattagccgggtgtggtggtgcacacctgtaatcccagctacttgggaggctgcagaaggagaatcgcttgaaccccagaggcagaggttgcagtgagctgagatggcaccattgcactccagcctgggtgacaagagcaaaactccatctcaaaaaacaaaacaaaaaaagaaagcattgctgtccttcaacccagcaactccacctctaggaatgttttcctgaaaagaatagccaagggtgctcacaggaggtggtcattataatggcaaaaccctggagacaacttgatgcccaatagagtttaatccatcgcaggacccatacataacgaaatacaacacagccgtgaaatagatggtgcagactctgtgtctgacatggagagatggccagttttgccactaggagaaaaaggcacagagaattttgttggaaataaaatcaatcgaaagcaacttccagctttatctgactccctcaggcctctcctggcagacttgtatattttcttctcttgatgtaatctcctaattctgctcccagttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggtaaggttcagagcctttgcaaatgctgtttccttttccccacatgcttttcccttttccccacatgcttttctccccactcaccacctgggtaattcctccaggtctcaacttaaatattacttcccgagagagggctttcttgctggcccttacccccaatctaccttacgccccttgccactttttcttgtaacaccccattatctttcttctcagcgtttactacaaagatactttgtagctgtctgcaggtgtatttgtttaatgcatgtatctctcactatgtgagtctgggctattgtggggagaaaggtatactggtgtttgtctatttgtctattttgaccttggaagactacatttcccaagcttctttgcactttgatttccacccaggtcaaccaatgggaggtactgtcaggagaatgatggcggggaggaaggatgaagccagagtactatttcctctttctttaccacggcagaggctctggctgtgactatgtctcctcatggtgacttccataattccacctccactctttgttcctctagtcctggggtggatacagcctcctgtctctggataatctctgggtggcctcaccaactctttactagcttctcaacaattccatcacttgtataaccaattccccgtattaaattccctctgcgttaaacattgagagtcagttttccttttttgatggactctgtctaatagggaagggatgttgggtcctttgggggccttgctccctggatggagaactctgctctcttgtttcttgacttttgaaatcaacaagtcaaatctctaccagggtaattcttcctagaggctatatctgcaatttaatattgttgttattgttatcaaaagtgtcattattaatatattttaaattaaaatataatttactgtctgggtgtggtggctcacatctgtaatctcagcactttgggaggtcaaggcaggagaatcacacaaggccaggagtttgagagcagcctgggcaacacagcaagactccattgctacaaaaaagaaaaaacaaatagccaggcctggtggcatgcacctgtagtcctatctactcagggggttgatgtgggaggatcgcttgagcccaggagattgaggctgcagtgagccatgattgcaccactgcactccagctgggcgacagacagagactccatctctaaaacaataataataatttattaatgttgttactagggctgaatcttgacctgagataactagaaatgatcctttttagagctttccaagggtaggtactctataccttctcttagtagtctgttcaaagtttaactgctaacataaacaacaatttcaagtaaaaatgttcaagtccaagttcaaatattgtttgagcacctacagtgagccttctgggagtctatgatctagtgggcaaatttcctgctttagctcattgagctgtttgttgagaggagacagttggtccctcgtcatcatccttcctatacatacaaccttcatcacttacacctgcttccttcttctggcatttccaggccactaatgtgtccgccaccttgaccttcaataccagcaagatcactgggttcctgaagccaggaaagtaagttggcctcctacctacatgggggtgcccagctggactccatctgtatgctgtagctgcttctctgtagctggtgggagggggggccaccatttggaaaggacacttacatttcaccccaattggcccaattcttctgccccactggtcctgcccccacaaatctcaaattgttaaagaattcactaagactgttacttcttaatgtatgaattttagaagccagctatatgaacttcctgaaatgataaagagtgagctttttgacactatctcatctgccctgtgacagtcttcccgatgtcattgtatcactgcttttagttcctcagtcatcttttccactcctgctcccgccctacctttggccctgtgccttctcaagcccatcctttctcgcttctggggacccccgcattgcttaaacttgcataaagcccacaccttttaatcttctctgattcattacagggtaaaagtggaactgaaagaatccaaagttggactattcaatgtaagttgtttttattgatgacatgattagaatgttaattaatttggggtgtttcctaagcaattgctatggcacctataataggaaatacaaaaggagaagagttgattttttgccctgcagaagtgtaaaaggtctcgaaaacacaagacatagggccaaggaacagttatatcctagtataaaacaatatataattaagtcatctactgaacagaattctcttaactgcaagagacagaaagccaattgaaatcatcttaagcaaagaggagaaatatataggattatataattgaaaagcaaaaataaacgaaaaaactaagaccagaggtttcaggcatagctggatccaggtgttctaattagtgcatcaagaatctctctccatctctctgttctgttttcatttgtgttagcttcactctcaggcaggctcttccaattggtagcaagccccagagtttcctacagtttcagttttttaaaaaatttgcacacacacacacaaaatctctgtgctagctctcattggactaatcttaggcacccagtcttaagccaagcactgtggccagaagtcagcccagcatggatctcatctacactccaggaggcaggatttgcagtcagctacatccaaagcacatggaccaagactggcaaggagggttgttccctgggggaaaatagactccgttatcaaaacaagagggattgagtgctgagcaggtaaatccaagaagtgatttccacaaggtagaaaaagtggtgaagtagacggccccaaataaaaggaggaaagagaacgtgaaaatcagtgtgggccaaagttatggagaagagctttctggaaagagggaaggaggagctgggtagactttaatgtgtagtcgttggcttctcttttaccattccatgatgctggcctccactgaccacctccacctgtgccctgcctcccagactttcccgaagcacttatgaagtggaaacaaacacagaggcggtggggagagatgcagggaccctgaagctaactcctttcagagaataaagggtggagtgaataatggtgcactcatattgtatctgtgcgtgtttactgcaaagtaaaacattcaagtgagaagtttcacaaaaatccatcctgtcgggttttcagagcatgaaatgtaaaaacaaaaactacagactcagatacatttagattcgaatcctgatgctgctgcccagtttgtagtaagtccctttcattctgtaggcctcagtttcccgatatatggaatagggacattaatatgaactttgaggggttgttgtgaagattgaatcagacatgcacgtaaagctctgagctctctgcttggcatatagtgggggttagaagttgtgtttcatgattttggtagagaagcttattttgtttttattaaattttttaaattatgtaggtagttcaggaaaaacattctcactgtaaataaaaccgatactaaagataaggctaaggacatgtcaaatgttgatgttcttcctttagaggaaagactgtcgggtgtgtaactttccaaaatttttctattcacttgcataccaaatgttcatctcaaaagagttttatcttataaaatagtagcatgatgtaatactagtttgcttttcccaagcgttttgctatgttggcacacacagaaccaccatgtggccctgtggcgatgtaaatatatctctcctgttctcttccaggcagagctgttggaagcgctcctcaactattacatccttaacaccttctaccccaagttcaatggtaagaatcactgtggatttttccaagtcaaaagtgaacactgctgtctggaggaaagagagttggacttggaaaacagggctctcctgggggctgtatgaccgtgggcaagtcacttctctctgagcttagtgacctgcctgtgacatgggatcgttgaagttggcctcatctccctccagggctctaatgagggttgggggctgggacagctctttggagcacgggaaacctccttataagcgggacagagggacacatggaagtgccccacatcctgaagaggcaggtcaaagactgaggaccaagttaatatagaaggcacaaggcagccgcctctgaactcacatctcccagtcaattgcccaactgcctagtcaaaaaagaaagcaaaaaacttaaatcctgtttccatgaagctttgcttcttttggctgcaacagagaacaggacgggcaaagggcagggagtggaacgccctgttctttatcttatcatgaatgtgtgcttcctccagacagcaccatgcctgatagcttaggctcccaagtcagcctccctgggtttaaatcccctttctgacacttcctgtgtgacctagaacaagttacttggccactctgtgcctcagtttccttatctgtaaaatggaaagaataatcacacctacctcatagtcttggaaatcactaaatgggaatatactgaatatagagtttgcagagaacattttcggtaaaaatctgtctctaattattatttattcaccaatctctttcaatgttgtgcttcaacctctagataagttggccgaaggcttcccccttcctctgctgaagcgtgttcagctctacgaccttgggctgcagatccataaggtcggtgggttcaggggggctctgaggatgtgtgagggaggaggtggtttgcatgctagctttggggccatgattcatgggtgacacccagcccagccctgcagctgggaaagtctggccaggggcaggacgggtgctcctgggccttgccatatgccacaaagccatccacatgtccttcagaagtggcacctctgctggtgcaggtggcatttgacacagccctatgccaccaccacatcccatccctaccatgaggggcctgagggaagctcaagaccagctcgttttgaaaatactgcgggccgggtgcagtggctcacgcctgtaatcccagcactttgggaggctggggcgggcagatcacgaggtcaggagtttgagaccagcctggccaacatggtgaaaccccatctctattaaaaatacaaaaattagctggacatggtggcaggtgcctgtaatcccagctactcaggaggctgaggcaggagaattgcttgaatccaggaggtgaaggttgcagtgagccgagatcacgccactgcactccagcctgggcaacagagcaacactccgtcaaaaaaaaaaaaaagaaagaaaaaaaaaagaaagaaaatactgtaagtcctagacgtagcattaggtcaggttctgaaagtcatttgtaagttttaagcttttcttctaaattttaaggttgaagagctttattataaatacctgtttggcatgcctccccatttaaacaagtactacaaccatatatacttttttttttttttttttgagacagagcctggctctgtcacccaggctggagtgcagtggtgcgatcttggcttactgcaacctctgcctcccaggttcaagagattcttgagcctgagcctctggagtggctggaactacaggctcccgccaccactcccagctaattttttttttttttttttgtatttttggtagagacaaggtttcacaatgctggccaggctggtctcaaactcctggcctcaagtgatatgctcacctcagcctcccaaagtgctgggattacaggcatgagacaccatatacagccaacactatatatgtttacaaaaattattcataaacctattgctccactacaagcacagtttgaattttggtgtacttctagtgctttttgttttaagggtttttttttttaagtttgtttgttttgcacagttgcattactagtgctcatacctgttttctttctttccctttttttttaaaacttaaaacaaatttttttttaggccaggagcggtggttcatgcctgtaaccccagcactttgggaggccaaggcgggcagatcatgaggtcaaaagtttgagaccagcctggccaacatggtgaaaccccatctctactaaaaatacaaaaattagctgggcatggtggtgcgcacctgtaatcccagctacttaggaggctgaggcaggagaatggcttgaacacgggaggcagaggttgcagtgagctgagatcatgccactgcactccagcctgggcgacagagcaagactccatctcaaaagaaaaaaaaaattaacttaaggttctttttaaagcttaacttaaaaactattttaatatcaagtgaaatagtgaaaaactattttcattattcaaactattattctgaccaagcattttgtggtctatctgtgcttccaattttcaggttatcttttgaggtgagatgaactgggttggcggactcattagcaggagggggatgctgcgctgtgcctggtacattgttaacaacagaaaataatagccattaaagggaatgaagggcaggggggatgattagggacctagaaacactggccaactgttctatctaaaaaacaaatgtcgaaagcccttttgggctctgagatactcagcacttaactgctcttgagcatttataagtagtcagacagatcgttgttcaaagcaaagattgagtgacagttcataccatcggcctcagttttctcctctgtaaaacgggacataaccgaaatgtcagtgggcttttgtgatgatttagagggcaagtatgatagcttctagctcaatgtttgacatgtggaaagtaattagatttattatatattataatattcattagaattttgaggtcaactctgcccatgtgtctaaccgtctaaaacaaaggatggatcactgtgggaaagaactgaacttggccttcggttcagaattcctgcccctctgggtgatggaaacgtaagaagagcaggagagtacaccctagcagttcacaatttttcattatttgccaaagagagaaaatttaggtgacgcaaaggacacttagaggcctgccgggcagcagcagctcggggaatgacagatcgatctctaccttggagaaggtagctgggaagagctgtgctttacggagagcttggggactgaggcacactcgcaatttatgcactgacctggattctggcagagcttgtgtttcgtgagacgtgggctccctttcaatcgcagatgcatctttttggagtagaggatgctctttaccatcctgtcctgtcctgtttttcctaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccccgactggcctgggatatctttacaagcaggcactgtatttttttattcgccatctgatccccatgcctagcagagtgctggcacttagtaggtcctcaataaatatttattaaatgatgagatgatggaatcacctggtattctagctgagcctcatcactgcctgccctcttctgacctcaggggtctttggatagtcagccacatctatggtctccaaggcccctttctcatcgccgctgctatgggagcctcaatgagagaaccagggattctgtacatcatgtagccctggatctggcgctggtgctccgtctctaaggcccttgtcctgtctcaggcaggggctcacttcgacatcgctccctccctcatttcttgcctgctacagccaagggagccaatgatctcccggagcaaaaactcagcctcccgctgcttttccctcattgaagcaggtgtaaattaggaggaaatggatctgtctaagtttttggtccaaccccaataaaaagctcatccaactgttgtttatgagccccaagcctggagggagaggccgtgatttctaattactgaacaatgagcctttgatcagactaataaagagtcatttccaagttatgtagttgggctcccagggactgggagtcagaagactcgtttgataattttttttattgtgttaatgagcagatggatggagcttcaggctagcagataattcacagggaataatcccatttaccctgtgtgtgacagagatgtgttccaagatgggacgatgtgttgtcgcccagctggtggcagggtaagctgtggcttcaagccctctctcctctccatttttgttcatttgtttgccaccatccatccctatgaccgactggcaaaggacacaggcttcatccagtactagccatgtggccttgggaaggtcactttccccctggggtcctcatctatgaaatgatgatgatgattatagtagtcaattcctgggactgctataatgactgcattgggtaatctatgtggaaggatttatttagccaaatggggattccatatttattggctgggtgtgcttactaagcacctcctatttgccaggctttggggtcctcatggggagaaatacatggagcatgggctccattcctgatcctgcttttaagagtgatacttcctctccctctccctctccctctccctctccctctccctctccctctccccacggtctccctctccctctccctctccctctccccacggtctccctctccctctcccctctttccacggtctccctctgatgccgagccgaagctggactgtactgctgccatctcggctcactgcaacctccctgcctgattctcctgcctcagcctgccgagtgcctgcaattgcaggcgcgcgccgccacgcctgcgtggttttcgtattttttttggtggagacggggtttcgctgtgttggccgggctggtctccagctcctaaccgcgagtgatccgccagcctcggcctcccgaggtgccgggattgcagacggagtctggttcactcagcgctcaatggtgcccaggctggagtgcagtggcgtgatctcggctcgctacaacctacacctcccagccgcctgccttggccccccaaagtgccgagattgcagcctctgcccggccgccaccccgtctgggaagtgaggagcgtctctgcctagccgcccatcgtctgggatgtgaggagcccctctgcctggctgccc

SEQ ID NO: 12331 - DNA, 16740 bp, Human
gcgctgcagcctgcctgagccctgacacccacacgtcctgccagcagccccaggagctgaggaaactgaggctgggagagggtctcagacggccagcacagagcaggtttacaaaccccgaggctgatgtcccaactgtcactggtgctgcgaccctcccggcttcctcttagaaggtgggaatggggccaggcgcagtggctcatgcctgtaatcctagcactttaggaggctgaggcgggcagatcacctgaggtcaggaggtgatctggccaacatggtgaaattctgtctctaccaaaaatacaaaaattagccgggcgtggtggcgcacacctgtagtcccagctactcaggaggctgaggcaggagaacggtgtgaacccgggaggtggagcttgcagtgagccaagatcgcaccactacactctagcatgggcgacagagcaagactccatctcaaaaaaaaaaaaaaaaaaggatgggaatgatgaaccacactgcaggagctcccacatggcacaaaggaaagaatactctcaggacggggtctccacctgccaagccctcctacttcggggcctctctacacgcccttggccttccaaggtctcagggctcccctgcagctcccagggccctttctgggtgtgacgtattttctctgtggtcccacacctcctgcccctccaggaattgagccctcgtgggcaggcactatcccccagaatagggatttgtcccatactgtgagagagttttttgtgtgaatggtgctggatttccagctgctggtgaacactcaggtgtgccaacagtgccctgattatgcgaggacaacagcaaccatccccgtcgtgggccaccgtgccagaccctgtcctgcagatcccctctgaggcagagctggggcagtgacagcctgagcctcagtttctctgctgtgaagtgggccaacgacagctcctccttcatgggatgaccccgtttggaggatcagggcaagcgcaatcctgctgccctgcccatgcccactcactcctacctcctgtcccggtggcagcctgactggacagagcctggggtctgagctggccttccttccactgcccttctggaaatagagtggccatactgccgcaagctgactatgctgtggtcaggatgaactcccctggcctcccagggtggccgccacatgctctcgacccccaggcccccagatgggcaaagtgctgaggaatgaacatatggagaaacagagaccaaacaaccacttcaatcatacaacaggtgggggcccgcctagcatctggccagggctctgggcactgtgctgcccccagcccaccccctgccacaggtggcacagatgggcccatgagtcagcgcacgttcatcccctttgtgcctcccccagcccctccagcagtctgtgccctcataacccccatttcccaggcaggaaaacctaaggtcagggagtgggaagccctgtgtcagcgtggcccgcaatcaggggaaccccggactctctgacgctgttactaggggcgcagcaggcgctgtgctggagcgatctgcggttcccagggcgaaccccgcctgggaaaaacccagcgtgggcgccagcggcaacgcccgctcgctttcatgcagtttgcctggtggccagggaaaggtcgttcttggcctcattttgtggattaaaagtgtccgcgacggaggttcagagcaagacgcagcgcagggtcctctggggccatcggcgtcgcgccccctcccttgtggggccccgcgggaccgtctcaggcccgaggggttggggtcgccccaaactgcgcgctctcagcgtacagcctccaggccccgggcccgccccgggtggaggcggagtctggggcagcagctcgccgccgggcgggccgggggcgggccgggggcgggcgcgcagctggagcctgcggctgaggctcgggcgcgctcaggcccggatcctggcggcctgggcggccgcaccatggactcgggaaccgaggagtacgagctcaacggcggcctgcctccgggcacacccggctccccggacgcctcggtaagaccttccccccaccgctgcatgatcttgccaggccctgtcctttcggggcgccgcggctccccgggcacctgtgtgcgccgcgtccgcactgcagagtgttgggggacgtcccgctctaggccaagtccttcccgccccatcagggtcagaacgatgcccccgggagctccagccacccccggcaagtgggcgggacgagggggcgtgggggcgcagggcgggctggcgtccccagccccactaagcagcgcccgcgcttggctgcacggcggagggggcctcggcgcagctcctcgggctaaggactgccggcgcccggctttcccgacctcccccccactctcgcgcgggcctctctaacttcagcctcgccgtgccggctcctccgcgcactttgcccggaggcgggcggaggggagtcacagcctccgggctccagaccagctgcatgcagacagttacgtcaccccacgctgaccacacaatctgatgcgtgccttgatgggggaacttggggcccgctgtggtccctattccactcacctgccttgagaaatagaaacgtcacacagccttcagtgtatgcccccaccggccctccagaacttgccctgcccggcctgggagggctgtgggcagggggcaggccctggtagtggtcccgcttcagaattcttcatcccaggactcagcacttactgagcaccttgtgtttgttgcaaggtcctggcatggccctctggtgacttgtttactttgaacattctttccttttctaaccccctcagggatgggggcagggaacagcagcctgttgggtttttccaggcctctccatggcgtggaccagactggggcaaagacactctgcccactcgctggtgaacagtcctaggccggtgctgtggggacaggacatgttcggggaggcggggccccatgagccacgggataggatggccctggggctgcatggacacttgttcctaggttagagaggagctgtcgcactgcaggacttgaccggtgtgcgggaccccagcgacctggccctgccccagtgtgtgagcactttggagcaataggcagggggctcctccggctgtgtgtccttgggaagttgccacacctcgctgggccttttagacatggtcttataaagagagaacaaagggtctctcctgccttcagggaagtggggaaagcaagtcaggtaataaacaggtcagtggcttggaagcgccttggaaaggaagggatactgctcctcccccaaccctgaccttgcccgggcaatgccctccactcagagcagtctctgctcacttctgcgggcggcaggataggctgtgcctcctgagatgggtgcatctcaagcccagaggagattgggttggatttgttcccggatcactgtcttggctctgggcaccagagggagagagacacagccccgccccaccaagccgcggttggagagcagcccagcccagacagggcaggagaggccagggcaaagcagggggttccctgggggctgggagcccatcgtggggggcggggcatggtggtcagggaaggctttctgtggaggtggggacattggctctgagccctggagggcagggaaggtgggtgagcagatctggctctctgagatgtgtggaagggcatctaggcagagggaacagtgggagcaaaggctcagaggctggaccacagagcacatgagggccaggtaggaggtggggggatgggaagccaggccgatgggaggggccttgcaggcctgatcacggtctggtgtccagggagctgtggaaaggctatgagccagtgtgaggatgagcacatttccccttgaggggtagaaaacttcgagggccgctctgctcacccagcctgggggcccaggaccacccaacacacctgttcctcttcccaacctcaagaccttgcttctccgtttcttgggcacatcatgtcagcactctgtgcctcagtttctcatctgtgaaatgggtgtggtcgcggtgcctgccatagagagtggtgaggactcagtagctgatgtatatgaagtgcttagagccaggccagcactcagcgccctcatccttctgcctgccacggagaccctctcccactggtgacccctggcagtggtttggagagggcagcgctttgcccagctccctcagtttccttttctgtaaaatggagagtctcagtttccttttctgtaaaatggggcacaactgctcacctcccagggtggacaaggctcagggaggagccacacgtggaactccaacctgggtgggctctgttgggccacggccgtgggaagctctcaggtctcccccaccccgtgtgccctgcgcccctgtggcccttcatgtgagggcccccatcagtgtccagggattgagtcagctcacttgtggctgtcagcagaaggaatagtaaacaacaatgttaatgtgaaaatggcctgaatctgttatccccagggtgtctcaaggcagggaggtggtggggatggggttaggacacggccatctggtgccagccacaccttcctgcccctcacagcccgcaggttgaaggttcctggggccacatctgggccgagaggcatggtccttggaggtaggtagctgtgccctgtatacctgccgtctgggccgtgcatggcctcagctgcccaggaggaggtttgctcgtttcctcatttccgctttcctggcagatcctgaggccggcagggtctgggccaagttctaaaaggcaaccctaacatggtctcagggccactcgtggccagtgctgagtccgcgggaagtgggtctgcctggcccagctgtggtgggaaccccgccttccagcacttcctgctgtcttgctggggtttcctgccaggaacacagacatggagctgggagaccctctcagggcctgcttcctgggctggccggtaggagacggtgcagggctccagtgccaggccctgcctgtctgtgtggcatctggggaatgggcacagcagctcatgcccacactggtgggtcagacaagggatgccggaagccccaggcaggtcctagcatatggtggggtagaagaggggtgcctgattttcaggtcgccccaccatctgccaatgcctgctgagtccaagggttagggccagtgagcaggacaggctgcgagcagccaaggtgtagactgggaccccccaggcacccagggcaggcacctcgtccctgttgtccccctgggtcctgctcagcacaggagaacccgtgccccaggctgtcctttctttgctgtgtgactgttttgtgagcctgttcagctgcttttgagtcagtggagttggtcggggaggcagagtctttcaaaacagtgagagccaggcatcaaggaaaacagccctgccacccactgccatgcgctccaccagccacggggcatctgagaccaccccattcagtcccctccacatccttgtctacccattttacaaatgaggaaactgaggcatagagtggtcagtgttgaggcaggactcggggggtaaaggaggtgctgtggcagcttccagccctactcctcacaggcccctggaaagggcgactgatatgcatcaccacatttgtgggcccacagccccgaccctgtctcctcccatccaagccctgggtgagccagaacacccattatgctatggccagagccaggccggtggatgcagcaagcctggttcatatcccacttctgtgccagcccctcctgcctgagctgaggatgctcactgaagtggccctaggaccgaccgtgtggcccagccccaacatgtgcagcctgcagtggggaggccgaccgtccacagaaggttgcatgaggagccagccacgcccctacacagagctgacctcctcaccaagcctccctcctagctttcagaggaaaaatatctggcctggccccaggccccgagtgctgctgaggttctgggaatctattaaccagggtgtttattccctgccctgcccaagccatgggcactggtctcagcagggcttagctcctggcagctcctgctggctggtcaggaccacagggctccctcacctgtggtagctgggtcccccggccaccctcaggcccatcccaagatagaggcaagtgcccaggactgggggagagtgggatcgtcctccctgggaccctcctgtgtggtggtcagctcagggctccaaggcccagagtaccaaggttagggacagggaagcagactgtccctgctgccctcccctccacatgatgctcccaatgtggcctgctgcctggggtggttgccagctatgctgtatcctggggcagccctatgctttgggacacacagtcctgggaggtggctctgggaaaacctcctctgagctgcaatctgctggtctgtagaatgggagaggaacacagcctctcccttggtaagcaggagtttcccaggtgcaaccctagatatacggagggggagactgaggccaacggagggggagcttgcgtcagggccacgggctgggctgtggtgagccagggcttgacctgcatgcagaagcttccctagctgcaggttggacaggaagcagatggccggatgggctggaagtgcccttcaccagcaggggtgcatggtcagggcatttgctggccactcggggctcagaggccatcctggggcatctgctccacagcctcgtggtacacatggaagactgaggcacaaagtggggctagttgtccggacacagctggagcctgaagcagggagccattgagagttcagcccctaagggacaatggcatcagctaccagagcttctgagccccggggcctgggttcaaatcctagccaagccctcacttgctatgtggctttgggtaaggaaccgcctttgctgggcttcagtttacccaccttaagtgggcatgaggacagcaggggcacaggctcctcgtggctgggggtgctgagagctgaggcttggggagctggaggctctgcgcggatggtgctttttaatggatctgagtgttcctcgtgactgcatggctgtgaaatatttaaatggttctgcagagctcagaaaaaaagggaattcttcctcctgcccagaggccaacacagttagcctgggcttgtgtgtctgtttatgtacgtgtgcatatgtatgtatgtgcatgtgtatttgtgtgtgcgtattgtgtgcacatgtgtgtctcacgtctatgtgtgtctttctgggggatgtgtgtttctgtgcttttgtgactaggaacacgcacatatatgtgtagatgcccccagaaggtggaaatcctcacggggtctgcacttggccttctcccagcaccaagtcctgggatggagacccgaatgagcataagggtggccttgaaggaaggcactttggcacttgaggtttgtgaaacttaggagcacatgcccactgtggccagcagcccctgggacactgcaccttgcggagcacacgtgtgatggggtgtggcccactgggcagcttcgcaagagcagaactggagacgacctcagtgccaggcacaggcccttgtgtccgggctgtcctcacccagaccctgggcagcctgggaggaagcccctaagtggacagtggtgggacagggacacacagtcctgggaggtggctctgggcaaacctcctccaagctgcaatctgctggtctgtagaatgggagaggaacacagcctctcacttggtgagtgccctggctgtgctggggcctgggggaatcccagggagtgcagcgtcaggcccagggtgggagaggcaaagtagacaccccatagaggcttcggggtatgcatggagtgacccgagagcacaccagggccccagggacagcgctgctgggtggcccaggtaaaggcggctgtccctgtgcgcacatgtgtccacgtgaacttgctacttagagagcagctgatgctgaaggcaggttgttggaattcccaggcccaggtgtaagcagcagagcccaccagtgtcccctgacgcccactctcttcctcctgggcacataattttagatgaaactgaaaaacacgcagcatgaaagcaaggcccctgccctctgctggttctgtattggctgcctcgtgtatttttccagcctgcagaaagtcgaggcctggatggataccatgtccacccctccctgtggccctgcggcaccccggcctcccggcctgcatctttcatgagtctggaaacaggatctcccagagagggccccaggaggttggctgccagcagtgggttctcacagctgcctccaagcaggtgaccagtcctgggaggctgtggtctagggcctggcaactcaggggcgcctgtggacaaagggccgggccaaggggctggcaggtttgtcctgagtgactgaagagggccccaccagggcagcttgagaggggcagactcttgctccagagaaagaggaagtttggtacttagcttggaatgaagggccagccctagagaggaccttcctgtggcaggagagagggccatgtcctgccaggggaagtcctgggaggcttcctggaagcagtggcctctgtgtggggccttggagcttgagagtgtctggcaccagggaaaggcattgggggcttcgagagaactgcagggggccctgaccagataggcccctaaggcaaagaggattccatcagaactcgcattcccattttattactctgggaagtaatgtggaagctaagctccactgtatgtcgtatgctgaggcatctgttgagcctctgctgtgtcggggccgggctctgggtggcccacctcagtgaagtcttgctgctaatggccgaatagttctgcaaggcctgtgctgaggcctggaggcgagtggcctgttgggccccaaggctgggaggttgggaggtggcaggggcgatctctgcccttaggtccggcccaggaggacttgcttcttgcctgggccggtgtgcacagatctgtccgcccacacgtcacttcctttcctggcatcaggagctcagactctgaggggagggggagaggaggccgggggcacagaccggtaggggcaggcagggaggagcagccccgcctatggcaggagggggaggatcgggcaatgctttccagtggaaaatcagagtgcgtgtgctaaggttgctatgtcgtttcctttctctccaggaccgtattcctaggggaggttttataaaggctgagcacatgctcgcagcctctccttagggtaataagcacttctgtctgagcacttaccaggggtgggggcaagggaagccctcacctgcagggcccggtgacccccagagcccgactcaggcacagcccttgcccccctcccccacccgccttgctgaccattcccctccctgcagccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttggtaggtccccaggtgggggcagccaggccacctgctcaccttgctggcatctgctcgcatcgcctgggacaggtgcccaccaccttgcacacttggctctcaaggagctgccgagttcctggccctcatcacccagacatgcagtccaggaagtggcaccccccctccccccaccctgcactttggtttttgttttgttttgttttgttttttgaaacaaggtccccctctgtcacccaggctggaatgcagtggcgcagtctcggctcactgcaagctgcatctcctgggctcaagcgatcctcccacctcagcccccaaagtaactgggattacaggcgctcatcaccatgcccggctaatttttgtattttttgtagagatgaggttacgccatgttgcccagtcgaatttttgagctcaagtgatccaacagcctcagtctcccaaaatactgggattacaggcatgagtcaccacgctcagccttgttttgttttgttttgttttgtttttgaaaccgggtcttgctgtgtcttgatcacagctcactgcagtctcaacctcccaggctcaagcgagccttctgcctcagcctcccaggtaggctggaccacagctatatgccatcatgccagctaatttttttatttttggtagacacggggtcttgctatgctgcccaggctggtctcaaactcctgggctcacgtgatcctcctgtctcggcctcccaaagtgctgggattacaggtatgaaccactgtgcctggccccaccctgcactttgaaagagcacagagtggggtcagggcctggcctgtgggcattagggcaggtgtttcaccgggttcttgttgacccatgccatgagatggcctcagtcatgccagtcctaccttctgggcccagggtccccttcatggctgcgtaaccttgggcaagtggctgaacctcccgggcctcacttataaaacaggcatcataatagaactgcagcttgtggcaggaatcactagattaaggcacgcaaagggctcagtgcatttgcccaaacctggcctttggttgacgtccatagcttcaattcgtataaggaaaatatgggggctacagaaggtggggtcatagaccgtggggttgcccaagccaggggcgctgttgtccatgtttcagcaaaacagatgtatttttctctgggcgacaaaactcatcctaaatgcgactgagagccctgtaatgtcccaggacagcttgaccgctggggtgggtccccttccactgtcccaggctggggcgctgcgtctgggctgcccttggcaccatccactcctctctcgcccacagtcaagtacgaccttaacaacccggccaagcacgccaagctggacttcctcaacaacctggccacgggcctggtgttcatcatcgtggtagtcaacatcttcatcacggccttcggggtccagaagcccttgatggacatggcaccccagcagtaggacacccaggtgagctgggagatggggcgcgaggcctgcagtcctggggttgctcgctgttggaggctcttgcagtgtggtgagtccctggccggccagccttggacaccttcctaggccatgggcatcctcgtccacacctacaaggccaatgcctggccactgccttgaggccagccctgccactggtgctggccacctggggtcctgtggtcacagtgtttagatggaatgtgtgtaggagccaccatttgaacatcctggagaactcacttaaacgtaagatttctatacattcagaatgtctgtccgataaaaaaaaaaaagatttctgggtcaggcgcggtggctcatgccggtaatcccagcactttgggaggctgaggcgggcagatcacttgaggtcaggagttcgagaccagcctcgccaacagggtgaaaccccgtctctactaaaaatacaaaaagtggccaggcatggtggcacatccctgtagtcccagctactcaggaggctgaggcaggagaatcgcttgaacccaggaggcagaggttgcagtgagctaagatcgtactactgcactccagcctgagcgacagagtgagactctgtctcaaaaaacacccaaaacccaaagatttccggcttctcttgataagtcaggggctctgcaccccttatcagctccacttagcaggtgaagcttcctcccagccctcgtctgagaaaaagggaccttggtatgaccgcctgcctgacatgcccacctcactgtgccactctgaccaggacggtgggattcaggatcttgtcacgtggagcccttgtgactcttcaagtctgccccttgccgggcctcgcagaatctgttagctgcctgccttaggctggaccctggctgtgtgcaggatgcagactgaggctgtctctacaggacgaggcacccagtgtaggaagacttctcacaccacatacagcctctccctgtgtccttgctcagagagggtgagcgtctgcccagtgacacagcctgggagcaggatccacaggaaggcctgggatgcagccatggccagggccacatggtgcacacactacagtccatgcagccaggccagggccacacaccacagtccccgcgaccttaggcctaggggtcacccctccggtttgtagcagaggtggaggtgagttgctaagggaggggtgggcactcctggcaggtggccatctctccaccagtggtggcccatggcagagtagacaggagcagtgctcttggggcagagcgcctgtgtgtcaaggatatataaaaatttccccaggccaggcacggtggctcacacctgtaatcccagcactttgggtggctgaggcaagcggatcacctgaggtcgggagcttgagaccagcctgaccaacatggagataccgtgtctctgctaaaaatacaaaattagccaggcgtgatggcgcatgcctgtaatcccagctactcaggagggtgaggcaggagaatcgcttgaacctggaaggtggagattgcagtgaactgagatcacgccattgcactccagcctgggcaacagtatgagactccatctcgggaaaaaaaaaaaattccccaagagggcatagtgaggatgaggtggggcgctggggccagcagctgggttgggagcaccctgcatccacctggcctcacccctccccacacgggggccaacgagtgaccgctgctcgtagtggcccatggcctctcaagctcccctaccacacccaaggccattcccccagtgggatcacgccagcccccaatgtcccggccgtggagcctgaagtcacccttctgaaaggacctggatctgggcggccccatgtggggtccgagtcactgtccagatgctgcctccagtttgtagttaagttgtcctcttccagaacacctagatgtcagctgctccctggcttgggcatgtggccaggccatttattaatcacctgctgtgtgtgctgaatgcagtccctaactctcccaagcatgagttatctgcctgccgggaagagggtgctgcgtctgtgggccacgtggggacccagcagtggaccttaaagctgtcctcagaggctcggaggccaaagctgctgtgtgtcctgcgtggagcagtcagagaggtctcaggcttcgtgggtggctatggtcacagctgcccaacccgagccccccatgctgggccaggcctctaagtcctggcagtaacccagccatgctatattcattccattttcagaggggaaactgaggcatggagtactttgacacctctcatgtcagaatcaggctcttctccttcctgagtccgggtgtgcaaatggccctgacactcggggcttgtcacagcctggctcagagcctctcctctccctccttcccaggctcagaccctctcctctccctccttccaggctcagagcctctcctctccccccttcccaggctcagaccctctcctcttcctccttccaggctcagaccctctcctctccctccttccaggctcagaccctctcctctccctccttccaggctcagaccctctcctctccctccttccaggctcagagcctctcctctccctccttccaggctcagagcctctcctctgtctcctttccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtcttaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctccacatgccatctccctgttcccggggctggaccggccttggcttccctgtcccctttccagctgccctgcaggggcgtcagaagcacacggttctggccagggccgccttctccagaatcttggcttggggagctctttggctcctgacatctcctggggtgaggtttggaggcacagaggtggaagtctgaggtcactggcatcagcagcccctagtgacctctgacccaggcagggtcaggtggggagcggcgtcgttttccccctcacatgtttccagcactgttttcctgcccccgcctgtggacaggccttgaggtgctgcccctgagtctctcctctaccaagtttgaagttgctgcttccccgcagtggtgtccagtgatgcctgtggtcagcggggacattctctgggcacaggggagctgggagccatgccgggaccaggccctggactctcagggcccacctgccccacaggacccctcacccagtggaaacctggctcccgggccgccagtgtctggcgtttcactctcttctccttggtcccccatccttccccaaccccccactacccattctgttctccccaccgcccctcccagccccagcccctcatctccctggatgtggagcatctggtggcctgaggtgggagtggggtcagcctgccccgtcctccatcccgcactgcctctgtgtccccgctgtgggtcccccgacctggcccctccagctgaggtacctgtgcatctcctgccagcctctgccctttcctcctccaagcagccttccaggggcacaggggagggggcaaggcctccagcactactgaggcccccacttacttcctcatcacttttcttctgtccccatctgggctgagccccgtgacttggggtggctccagctcccgttcctcggatggatgagtggcccccacctgcagtcctgtgtctgggctgacatcaggtctgcatagccccattgctgaagtgacagaaagcagaagcactcctgagtgagggggtctaactgggctctgctctaaagcactcccgggggaaaacaacagcaactactgagtaggtggaccgcgtggatgccgagaagctgagctcgtggcactgctctctccacttttgtgtttgtcccatagagggtttgaaaagtagttgatatgggaatgagttctgagatgtgctgagttgaaaaggaagctgcgaaggtatacggtgggtgcgaaatgtgctcctgacaggaggcaatgtagcattggccgcaggttgcgtggccagcgctgactcagatgcatgccgcccagcgcttggtccctgatttggccatggcctgcagtgtgggctggctggcagccaggcaggagggagggccccctgtgtgcctggcctcacacaccagcagccggatgttggccaacacatgtcttagctcctcctttggccaggagaggaagttcactgggaccgagtcggaggggtgaacccagatgactgtgctgggccctgggccatccccagttggatgtgtgcgccctgaccccctgcagtcccaatgcccaggtggcctcccctactcagacgcccatgctggccgcccccaacctccctgcccaccaactcccaggcttattcaccaaccactccaccagctctgaccctgacttctggggttcccatctcagtcctcagcctgtgctgctgccccctgaagagcatccttccaggcccccgtcggctggccggggcttagctctaaggttactccagaggccgtcctgaccagtctgatgccgcccctccctgatcactgtcttggccccattacaatttatgctctggtgccttgggatggagtcactgtccatgttgccagagacagtgcggccaggtggactctcccctggagctggagtctgagtccagcccaagtccagggcaggcactccgagaatgagtgttctgcctgctgggtct

SEQ ID NO: 12332 - DNA, 30773 bp, Human
ccgcagtagtatgtacctttaatagacacagtatgatcatttagcacatgctattcaaggtatctggcagctagcagctgctcatgttacctaactgaatttaggtcctccctcaagtacggcaaagccaaacactgacattggggtttgtagtgaaagtgaggcatttattgcattgcaccaagcaagaagaatcaggcagctcatgcttaagaccccaactccctgatggtttacaggtaaggggttttttgtgtgcttttttttttttttttgaaacagagtttcactcttgtcacccatgctggagtgcaatggcgagatttcggctcactgcaacctccacctcccgatttcaagtgattcatctgcctcagcctcccaagtagccgggattacaggcgcccaccaccatgcccagctagtttttgtatttttagtagagaaggggtttcaccatgttggcaggctggtctccaactcctggcctcggcctcccaaagtgctgggattacaggcatgagccactgcgcccagcccaggtaaggatttttaaaggcagggaggcagaggttacaggcaaagtcataaatcaatacatggaggctatacgtgggtttgatctaaaaagccaggatatctgaagcagggacccacaggtcatagatggattcaaagattttctgatttgcaattggttaaggaggcaaagctttgtgaattcttccaggctcctcaggaagaaatttagaacaaagataggtagtttgagatctccatgccagtggacaccattttccatttggtgaggtccaggtttctgaaaaacaactcagggacatatgtcgtctttagtttctatagggaagcaaacattttgtgaatctaacgtccttggctactgtcttaagctattattaccttcttgcttatcaggttgctcattgacttattgaggaagttaggtgcctggaatgtcccttcagggaactcaagattttcctttatttccatgcttggggaggggggtgcctagatggcccctaagaggggtccctgttctgtctctcaataaatatttgttgaatgaacaaatcattacaactcagtacacattgcagaaaatatagccaagagctctggagctggaagggccacagattatcctacagaacaatcatttcacttttctaatgtcgaaagggaggattcgagatgttaggggctacaggtgaggctggaaataattaatttactccatcaatattgaatgcctgctattgagtgctagactctggggagacaatgttaagggaagcccaagttttccaactccctgtccagagcgctgcaaagtactgcaggaagctaaagtgaggacaaagttcccagagatcaggatatttaaagggagaaccagcagagcttggtctggggcagggtggggaaaagagggaccctggcctcctcggaccgtttctccgccaagccacgcgagggcgctgttctgctcctagggcgccgtgtcccggcggcgccgcctgctcgccttttcccggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggtgagggcgccgcgggggcgagtgcgggagcgcggggctgggacgggccgccgctttcctgcccgccccggtcccgtccgcccctggcccggcgcggcccaccgggggcctgcggggctgtgggtccggctccggcgtccacctaggcggccggcccatcggttcagggcccggggcgttgggctgccctcgcctgccccttccacctccgcctcacgcccccggccggctgcccagatcccgggcgtggggggctcgggtgcggacgggcggggaaacgtagccccctgagccaagcaggaggttggtcggggtcgcctgcgctccactggggagttcctgccactctagcatttcccgagtggactagcgagagcgacgtccgaaaaggaccattttcagaccagtttctgaaaatgcaactaaaattaaccagaatgtcgtgcgtattaatgaacttgttaataaatgcagaatttttgtcaggtgaacggggcacctcagaaatcactaactcaagccgggcgtggtggctcacgcctgtggccacagctactcgggaggctgaagcgggaggattgcttgagcccaggagttagagaccagcctgggcaacatagtgaggccccgtctccacacacaaaaaattttttttaattagcagggtgtgacggcgggtgcctgtaatcccagctattcgggaggctgaggcgggaggatcgcttgagcccaggaggtggaggctggttgcagtgagtcgagatcgcgccactgcactccagcctgggcgacagcaaaaaaaaaaaaaaaaaaatcgctgattcttgaatgtgccaagcgtttgtttgcggagaggtaggcgtgatggccaactgtgatttttaaaatagaggttgactttggtggaaacagatggtgactggtctttgtgttgagtggctcttggaagtaaagtgttgattttcagaaacgagagccgatcttaagtttgggaacagtgtttgctggaaatgataagtgggatgtgtgttttcatgcacgatagcactttgcagaaagttatttttgtttttaatatatataaagtttttttccaaagaataataaaacatgcgggtgatcagttcgttcttgtacatcgtgagtgtgtgatcttcactttgtaaattctgtatccattgttttcttaacccctgaaattatttcgatctctccatctttgaagtctagagttgtccacattcatcctttacaaggtggactaaataattttcatgtatttttaggttaaaaattctcacttgaagtgcatgaagaagtaacgatgttattttaaaacgtaatctataaaattttcttaaccgtaatgtttagaagtcatgatgtggcagaagtgcactggagaaggaaagattttgttagtctgattttagggtactcttaagatcatgaaatttacttagaaaaggagcactaatagatggtgttaagttacaatatttttaacgggtgtaatgttggtcggggcctttgtgtattaagtaactatttgttaacacaggaggatttatttttgtaaatagaagtgccaagcaagtggtatttttctctttctgaaacaaactgcttacttgtggcttcagttgacattcatttttattgtgataacctgtaatttcatgagtcttaaaatttatgccttaaacatctctctccagctctaatgcgaagtgaaatgtacaggtttgaaatgatctgagtcagttaacctgactatgagcatcagaatacagacttgaagttatgggtaaagtgttagttgaatcagtttttcccattgacttcctttttttgttttatttttgttttgagacagaggctcagtctgtcgcccagactggagcgcagtggtgccgtctctgttcactgcaacctccacctccggggttcgagggatcctcctgcctcagcctcccgagtaactgggattacaggtgcatgcagccatgcactgctaatttttgtatttctagtagagatggggttttgccatgctggccaggctggtctagaactcctggcctgaagtgatccctcagccttccaaagtgctgggattacaggcgcgagcctcgtgcacagcccctattgactttctaataattttaagatgaacttctagagaagaatattgtaccactgctgtactttgaaataatcacaccggagtgtcaacgatcacttgaggaagctttctgtatttgtcaaaagagattatttttacttcggctcctaaataaatcagactaacagttcctaggacttcacaggtatatttaagattatctcttgtatcttactagccttttttgggggcgggggggggacgcagtcttggtgtgtcagtcaggctggagtgcagtggggcaatcaccgctcactgcaacctcaacttctggggcataagggaccctcccacttcagcctctcaagtagctgggaccacaggcatgtgtcaccacaccgggataatttttttattttttttatggggtctcaccgtgttgcccaggctggtctcgaactctcgggctcaagtgatcctcccgccttggcctcccaaagtgcagggattgcgggagtgagccaccactcctagcccatttttttttctttgaatatttgtccttacccacaaagcatgaatttgttagtgaaattcattcatctttgttctctacccccattgatggagttgccaatgggttggaaaagtgtgataatactcatttctctctactctttttgagccgtgcttagttttgcagccctcttctggcagctatgacctagctttgtggtttgtgtatgtatgagtatatatacatatatatgttttctgaccttagtttctagttccgttttatatccctaccccatcctccttgttgatacataacaagtgtagcattcatcctgtctgagttccagtcctgcttcacagcttgctagctgtcagtctttctgcacctctgattccttatgacagagataatatgtaccaatcctcccgggttggttgtgagtgctaagatatatattcattggccgggcacagtggctcacgcctgtaatcccagcattttgggaggccgatgcaggtagatcacttgaggccaggagttcaagaccagcctggccaacatggcaaaactctgcctctactaaaaaaaaaaaaaaaaattagctgggcgtagtgttgcactcccagctacttgggaggctgagacacaagaatccctaggaggcagaggttacagtgagcagtgatcataccgctgcactccagcctgggtgacagaatgcagttttctcaaaaaaaaaaaaaaaaaaaaaaggccatgtaaagtcctaatgagaagtaagcacgcagtgaatgttaactaaaggaaggctgaaagttttaatcataagtgtcacccattttcttttgtaagaaatgcaaaatgaatagatgtgccaatatgccttttctttggtaaatatacttcaaaggagttttttttatatagtggctatagaaccctgaaaagtagtggtgcctgttatgtgaaccacacagtactggaattaatagcagttgtgtgaagtatctttactcctgacttggtctacttaatacttgccctacctttctagggcaagagtagcaggcatgtagaaagaaaatatgagaaaaataaagagtcaaacctaattatataaactatctttaatccttgtgattcaatttttgggttttttaaaaatacctttttttattctattggaaatactattctataggaagttacatcgtatgatggtggtttttccttaaatttctattctaattcagattgcctaaaaactgaaggagtcggctggtcatggtggctcacccctgtaatcctagcactttgggaggtcgaggtgggcggattgtctgagctcaggagttcgagaccagcacgggcaacatggtaaaaccctatctctactaaaatacaaaaaattagccgggcatggcggtgtgtgcctgtagtcccagctactcgggaggctgaggcaggagaattgcttgaacccaggaggcagaagttgcagtgagccgagatcgccactgcattccagcctgggcgacagagtgagactctgtctccaaaaaaagaaagctgaaggagtccactgaaatcaagaccagagtagtactagtaaaggcctattttgaggtagttgcaaaaataaaatctatcctagtgccagtgggtgaatgactacaaaaaataaagagtatgaatggtatggtgtgtctggcttccaaggttaatttctgcctagtgaaaaattgtttgcataaaatagcaaggcatgtcttctgagaagactagctcttaacactagcttaaattagcaatccagcttttgaagctaattgtgaatttgactcctcttgtgtgtgcagagaaattgcttctgtgattcattcctgcatcagcagtatgcagttattttagaagattgtgtgccaagagagccaggctggcactgctcaggacactctgtgactagaactatatttaactgttgtctcagaaagagtaaaaattttaagctctttgacctgttaaattttataactgaagaaccttggtgatgattctttaggtggggagggaaattcagccaatgtgtgtgctggcagatctttattctgatgattataaagtacgtattgagaaaaatgtcgaggcttgtgtagaagtataaatatgtaaattttatattgaactgatggaaatgtttctaagtcctggcgttagccttgaaataagcagaaataactttaggatatgacttcattcctaatgtgaaatagtatgcttgttcctgaatacccaaaaccatcttaatgaagattagattctggtaaaaatgagtgatttttgtgaattgagaaaatttttttagattactttctgtgattgattacagcttaaaaaataaaaatagtggtcttgacaggcaaaatgcctaactggtacttccatttttaatttccctcgaacaaaaattagtgccagctttggtggtccattgataaaatctaaaatgcagtgataaaatagctcctttcttagtataatgaagaatggcatgattacagtgaaatagagggtcaagacccaattctagtgactgaacaaatcattgttttccttgctaagccagcctcttagtggacaggtaaagaaattaaaccaaactagactagcatgaactattgctaatggcgggaaagtggactttgttacatttctctactttatatatgacgtgtcaaatatatatgactaggtaaatatatttaatacttaatactgccctttaacaataatatacccttgccataagatatttacctaagtagataaagtgaagatatttgcaatgtaaaatttcttttcattgcctgcttttattgccgtgtgtgccttttattcttatttgaagatcttgcagaaattttttcttcacagtcttttctcttcagtacgaatgttataaaagacttggtgaatgaagcccttccttggtaaaaggaaatgaaaatgccagaaattgaagatggaattaatgcttaattaattttcctagattgttttctgaatgtagttttttctaagaagaatgatattaaagttacagaagtaatctgtataagaaatctgagtctgtgttaaatagaaattttttattgttttgaactgatttccttcaagtaaatgtaatgaaatgtaaacctaatccagattgtttaaagaaacttgtatgaagacatcttttcttccttaatgaccaaatgtgatctaatagttcctgtacgttacttttcaactctaaatttcattaataatcatattaacggccgggcatggtggttcgcgcctgtaatcccagcactttgggaggccaaggcaggcggatcatgaggtcaggagatccagaccatcctggctaacatggtgaaaccccgtctccactaaaaatacaaaaaaaaaaaaatcagccaggcgtggtggcaggcgcctgtaggcccagctactcgggaggctgaggcaagaggatggcgtgaacccaggaggcagagcttgcagtgagccgagatcgcgccactgcattccagcctgggtgacagagggagactccatctcaaaaaaaaaaaaaaaaaaatcatattaaccctgggaaggagttctgtgtattacagattccgtttcctttccagagaatgggagagctcaagcactcaagcttagaactggtttgctgttgtgtcctttgtaatttagaaatatttatcatcattccttgtaaactgttttttgactgagatacttttgtgatcaaatgaattaaaagacaatcctgaggtgcaacctgagattcctgacttgcgttataatagcatcatgttacaccaaaaatgtggaagactccattggagatctattaagtgaatattttatacaaagacaatcgtttttatgttgagactgggatacagtggtgaatttaagtgttctcacctattcaatcttagaaaaaagcttatttgaattaactttttagcatagttggattttttttaatatgcaggatacggtgtgtaggctgtagtttaattttgctcaaaatctctttttttttgtttttttgtgatggagtctctctctctgtcatccaggctggagtgcagtggtgccatctcggttcactgcaagctccgcctaccgggttcatgccattcacctgccccagcctcccgagtagctgggactacaggtgcctgccaccactcccggctaattttttgtgtttttaatagagatggagtttcaccatgtgagccaggatggtctcggatctcctgaccttgtgacctgcctgcctcagcctcccaaagtgctgggattgcaggcgtgagccactgcgcccagctcaaaatcccatcttatagagagggaaataattttcatcttcgtttaaaagagttccgcatgatatttatgtcctggatgatgagagctcagaattggttcagtgtattctcgacttggcttgagtagcaaaagaggcgcttgttcctgtgggcagtgaagaagaaaggagaggattggttgacagaatgctgccactgtgtagttatcccgtacattcaacagattttagttgaaccactatgtaccagactgttcaaagtgctagagattcagctgtgaagaggggacacgattaatgaacaccaggcattgattcttgctggcaagaaaaagcagaagatggggacagtgatgggcttgaattcaagagactcttttttttttaatagggtggtcatagaaaaccttccaaattctttataatgtggtttacttttgtaattaaaaaggattttgcgagagttagaaggcacagtccctaacactgttctcacctctgacaccatcttcaaaagtttagtcatgatgtaccttcagaacagcagacaaaaaataaagttcagtgaactataaattacagggaacactgcccaggactgcctcagttttggcaccaatatactagttcagtgggttccgaaaaccactcttaggttcagtgattcacaggaatgactcacagaactcactttaagctgttacactgatgattatggtttattacagggaatgaatacaatttaaagtaagccaagggaaaagactcataagggcagagtacaagaggggctgacatctgtagtgtccagtcctccagagaccaaactgatagtgggatcatccaaagtccgcatcgtgagtcacattgttaatggtccgcaggtcagagcccccaggcagagatctctttaccaagcaggaaattccaggggcaaaggccagacctctcctcgggtgaggttaattcttcactatacagatttttattccatagcaaattctgagggacgagaaccttaataataataaatggcaataccaaaatacatgaagaaaacaaggctagatttatcagaattgtggagtgtgtgcaatgtgagggatttttccagttgagttggcatattctttttttgttttaagtttgtattttgtcaactgggcacagtggcttatgcctgtaatctcagcactttaggaggccgaggcgggcggatcacgaggtcaggggtttgagaccagtctggccaacgtggtgaaaccccatctctactaaaaatacagaaattagctgggtgtggtggcacgcgcctgtaatcccagctacttgggaggctaaggcaggagaatcacttgaatccaggaggcggaggttgcagtgagctgagatggagatcgcgccactgcactccagcctggacgacagagcaggactccgtctcaaaaaaaaaaaaaaattgtattttgtcttttcttggttgtataaattctccaaaagttagccatttaaaaatgtttaaggtcttattttctactttgtgatatgtgtgtataatttttactgtgcaagttttagcatttttgtatagtctgattgtccatcttttccataaactttaagcgcacatgagaatcacttgggaaagaaataggaaattcatgttccttgactccattccagagactgattgacatgtcttgggcaggtccaggaagctgctttttttttttttaaaggcaggatcttactgtcgcctaggctggagtacagtaacatgatcatagttcactgcagccttgtactcctggactcaagccatcttcacgcctcagtctcctgagtagctgagactacaggaatacacaaccacacctggctttttttactcatttttttgtagagacagggtctcctcatgttgtccaaggtgatcttgaactcctggactcaagtgatccttctgcctcggcctccaaaagtgctgggattacaggtgtgagccactgcccccggcctcctttgtgctttcagtgtcatgaaatacctgtatttgtcaagaagattaagaccatgtcttaaaaaaaaacaaaagctagtgagatacaagagataatcttaaatatacctataaagtcctaggaactgttcgtctgatttatttaggagccgaagtaaaagtgatctttcctgacaaatacagaaagagatttttgctagcatcacttcttccaaaacaattttcctcatttatgcaataagtttggattttcacttctttatgtcactaagtttctgcgtgttgctaagttcctggctgcatatttggagtctctccaacagcagcattgtcagcattcccacagtcggttcttccgtgtacttttgatttgaatttcatttccagggttatgtcttgtgtgtttggcttctctcttttagcataatatatccaagattcctccatattgtagcatgtatctggacttcgttcctttttatggctgaataaaattccattgtgtggatattttataattactgccatctggaatttgttttgaagtttaagaagccaggttttttccgtttgaaaaagtaatacagaatttgttttttaaaatttcgagcattggccagtcacggtggctcagacctgcaatctcagcactttaggaggctgagtgggaggactgcttgagcccaggagtttgaggctgcagtgagctacgttcacaccactgcactccagcctgggcaacagagcgagaccctgtctcaaagaaaatttgtgcaagcacctcagaaaggtagcaaggaaagcaaatgcactctacccaccattcctgtcccctgccctcctacctcccagacaaccattatgtttctgtatataatctcctcagccatgttcttcatatgcaaaaaatatgtggtgtgcagaatgtttgtggtgtattgggagctgttttgtggaataaacttggcttctggtaaaattattgtttaatttgtgatctcaggaaaagaaactgaagggtataaaggccttaagattacacaattagattaaaactgaagagaacccatgttttctggaagacttcattgcatataatctcattctaattaattacaagcaaggagaagaaagtatgggctacattgtccataactcttgggaatcctaccaggctataagcagaaaaggcatttgtagaagaatacatggtagcctagaatcaaaagaaaagctggagaaccaagcatgagcattttgcagaaattaagggaggttagaggtgcagtcagaatcataccttagaaatgatttagaacactagagagaacacttctgttggaatagaacttgccattgtccctgctctttagagttgcttcaaattaagagtctgggctgggcgcatctagttggcataaagtaatctggggctagagtaactttgtgattcctacagtgtgtgtacaaactattgtgtgttttgaaaatcgctacaggttgagtatccctcaactagtgttaaagtctgttgacaaaaatgcagagtagcaggaaatacagtgaaactcaaaatccatgttttaaatactcttcagattatcaaatcactgaagaggcagagaactgtctgtccctaaaattgtgctctctcccccaccagtctaagctgtcatctgcttttactttaagcttcatcctgtttgactttttttttttttttctgtgactgagttttgctctgtcgcccaggctggagtgcagtggcacgatcttggctcactgcaagctccgcctcccaggttcatgtcatattctcctgcctcagcctcctgagtagctggggctacaggcgcccgccaccatgccgggctaattttttgtatttttagtagagatggggtttcactgtgttagccaggatggtctcaatctcctgacctcgtgatccacctgcctcagcctcccaaagtgctgggattacaggcatgagccaccgtgcccggccctgtttgactttcactgtgctgtgttgttgccttttttttcttttgtctcactctcacccggggttaactgcaaagtggtgcgaccatggctcactgcagccttgaactccccagctcaagctgtcttcccaccccaccccaccctcctaagtagctgggactataggcacacaccaccatgcccagctattttttaaattttttatagagaccagaggtctcactatgttgcccagcctggtctcaaactcctggattcaagctatcctcccccctcggcctcccaaagtgctggaattacaggcatgagccaccgcgccaggctgccctgtgttttagctatgctagccatccggttgtttcttcctctcggtttgcattctgtattagtcccagttctcatctcttagctttcgtggttttctgtttctaatttctcatggacctggaaactcggtaaatagcttgttggaattttgtagataacagtaggcccagaataaggcctgagagtctcttctggtgggttagatacatttttatgatgtctgttttgttacttcagaggcttttaaatttttcttcctgattctgggatcttttgctattaggcagagaggccagatcgatgagccattagtgaacttcgatttagtcagaacatttcatttgccagtgtttaagcataaattctgtacttcagggccacctaatggtattttctaacttaattctataaatataaaataattggaataaagaaattcaaggttggcctatgaattggtgtaagaatgtttgttcacacaagaatttgcataatttgtgacttttttctttcattgacctttttaaacttgtgaataataagattattctttttaaaacacagaccttctgccttgaagatttgcctattctggacatttcatgtaaatggaattgtacattatgtgatcatttgtgactgacttcttgcacttaccataatgtcttcaaagttgtagcatgtatcagtacttcatttcttcatagctgagtgactattccattgtatgaatatgttatgtccattcatcggttgatcaatatctggtggtttctactttttggctgttattaataatgctgccatgaacatgtataaactggatttcatttctcttgagtatatacctaggagtggaactgctggattacatggtaattttaggtttaactttggaggaactgccagacagttttccacagcagctgcaccattttgcatttccaccagcagtgtatgagggttccagtttatccacatgtttgcaacacttattaactgtcttttttattatagcctttctaatgaaagtgttatctcgtggtttggttttcacatacgcttttataaggcacttttcaagtgtttttttccccaaattttcttttaatagataagaaatgatagttttaactttgtaattgttgatttcacttttctaacaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtatgattattgaaattcaatttttttttcaagatttaaaccaggcaaaaggcaagaatgacagtattgcatatcatctgttttatggtctgttcagtttatagccccttaaaataataattggttttacatctttttaaaggagaggtgaaaaggataacttctgtgtattcccgataaatgtatcattctctcgagtagtccatagctgaagtcttggaatcatatttgactttatcacttatccgttatattgagtcagtagacaagtctttttaaatccttgctttgaaaagtctgttgttcctgtctctttctattttcacacagtttatcacttcacaattcgattgttacaatagcttagtaactaatatttctgcctccaagatctgatcccccccaaatccacctggcatacgctggccgatgaaatctcttatttaacccttttatattgttacttcctgttgattgcctgttgcctatagaatcaaattcaaactccttgcctggccttctatagtctagtctgaatttttgcctgccagcggttggtagcataaactctggctcaaatcaaagtttcttcttattcagtgctctggactctgtttatttccatagtcgatttcccccacgaggttatcctgtccctgatttcttacctttctgccaagactcagctcaggtctcacttcctccatgtaaccttcaaccattttagccttattccttctgctctaaattactatgaggaaacttattctcccagcccttatttatgctgcaaaagtggcttattgccttctattacttattattttacatatgtccttagtgaggttagtccctcaacagcagaagccatatattacatggtcatgggtcacttaactgcaggcatacattctgagaaatgtgccattaggtgattttgtcatctttggaacttacacaaacctaggtggtatagcctactgcacacaaaggctgtaatggtatagtctcttgctccagccaacatcgtacatgtaatctgttaacaaaaatgctgcccagcacatgactgtacttgtgtagatctggcatctggctttatagcaccaaacttacgttagacacataacggatgcttagtaaaatatgtatgaattgaagtacatacttgcagcttttagcttaatttgcagaatccagtgctttttcgtatttcttatcagatgcattcctaactaaatagtcgcttatgttttttaatagaaaggaaactattaatacatttgaaatcttgcccagttttgtcaagggcctgtttttgtgttattattggcaaatccaatcttcctgtgggaaataaaaattgaaaagggaagaagttaatctgtagagtttgtctcagcttcaaacctgtgattttcactactcattcagcagtaagaagtcatagtgttctagaaagatttaggaaagtagtaataatttgatgatgaagataatagaagcaaagtatcagatacaagtttattatagtaatataagtattagttaaaggttctgatgagggttgtcgaaacctgatgaaaaaggatgattataataaacacgtcaaatgttaaccagtaagacctggttatgaataagcaagttttttattttgaaactgaaattaacatttaatatactggtggccaaaagcgccgtgtttaaaaatgggtcagagactggtgtacttcacatgacactagtaaaaatgtgattttactatgggttttactccttttcttccaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacaggtatgtatatgtgtgcttacatcttgggaggaggtaaatggaagcagagattgactattggtaagctggggtctagattcatatgacctgtgtttctgcatctcctcggccttttcctcctccttcccttatacttaaaatttcaaagcagggaagtggataagtttcacatacatttggaccagcaaattttcctgttgttctcagatatgtatgtaaatcttttaaccaaagaatatgctgtgctttttaagatatcgataaacattataaataaatgtttaagacactgatgtatagtactagcaaagcaagatgttatttaaaactatctctgcatatacatgcagtgtctgctggttaccatgaataacttttcatttctattttcatggtaactgcaaatgttatattgtgtattacaccttccctgagaagtgaatgcttggctgggcacagtggctagtactttgggaggccaaggcaagaggaccgcttgagttcaggggttcaagaccagcctgggcaatgtagtaagaccctgtctctacaaaaaaaaaaatttaaaaattagctaggcatagtggcgcgtgcttgtggtctagctactcaggaagctagaggtgagaggatctcttcagcccaggaagttaaggctgcagtgagccgtgatccagcctgggcttcagcctgggcaacagcaaaaccccatctcaaagaacaaaaaaagaaaatagaagcaaatgctatttctgcatttgctgtaacaagtagtgcagacatgtcatgaaacattcaaaagtataagaagaaattatgcaaatttcctatttcaatttctagagataatcactgtaagcatgaactgatttaaatttaaatataaaacaaaagccgggcaagttggctcctacctgtaatcccagcactttaggaggccaaggtgggtggatcacctgaggtagggagttcgagaccagcctggccaacatggtgaaaccccatctctactaaaaatacaaaaattagccggggatggcattgcatgcctgtagtcccagtcccagctacttgagaggctgaggcaggagaatcacttgaacctgagagagacagaggttgcagtgagccaagatcgtatcacggcactccagcttgggtgacaaagtgagactccatctcaaaaaataaaataaataaatataaaacatataataaaactccataattcttaaattatgaaagcccagagttgtcaagaatgtaataaattctctcttagactgctcgtgggaatataatttggttataactttccctgtgtaatcctgacagtcttttttctcagccatgattttggacactgccgtgattaatttgaaaggacgatactttgcctggacttgttaaaagaaaatgtgaatttaaaagatgttaaattttaattaaggttgtttttaattgttttgaagcaacatagtcttcattaataataaaattgctggacagaatgatttttaaaagacagcctatcagttttaatgaagtatctagtttttaaaatgggtgcgttagtagagcttttatatatttttcccttcctccttccttcctttctttctgaaaagttactagaaaagaaataatagtgaacaaaactgatctagaagaaaagatggaaggcacataaaacactaggaatgaaataaggcataattataactatgcaggagctcgtgtatcacaagaacaggtgcagctttagtgcactaagtttgaaaagctgaatgaagcttactatagtaaaataccagttattaaaattggcttgcagaaattcgtccaatataagtaaacaaccaatagcaaccaggtgtaaatagttttataggctaattctaccaaacctttaaggaacatataatttctgtgttctagaacttgggaaaagatggagagttcaaaactcacaccgtatgcctagtataacctcaatgccaaaccagacgtggcacgcacagaaaaataaaatcagaccaaagtcatttggaaaaaaaattcctatatttatgattcaaaactcagttattttataaaataataatattaagtggataaagaaacgccagttgtactatcagctaaacattagaaaccttctcatcaggccaggtgaggtggctcatgcctgtaatcccagcactttgggaggccaaggcgggcggatcacctgaggttgggagttcaagaccagcctggccaacatggagaaaccctgtctctactaaaaatacaaaattagccaggcatggtggcacatgtctgtaaacccagctactcaggaggctcaggcaggagaattgcttgaacccggaaggcggaggttgcggtgagccgagatcacgccattgcactgggcaacaagagcgaaactccgtctcaaaaaaaaaaaaaaaaaaaatcaaaatcagaaagaaaatgcttgttaaaacttacgttattctctctgattcagaatacctagagcatggacttgaaactaggtagtttacaaaaaacaaaacagaaaacatttgtattattccattttattttagaagtcctggccaatgcactaagcaataaaaagaattaaaacgtataaacattgagaagaaaaaacaaaaatagttttgcaaatgacttgattatgtacttagaaaatatgaaggaactgaaaatttattgtagccagtaacaggaatcagagtgtttgctgtaagagaaacaaaaaattgtatatatcagcaataaccaacagaagctgtaatgacagctgggtacagtggcatgcacctgtaatcctagcttcccaggaggctgaggcaggaggattgcttgggcccaggagttcatggctgcattgcgcagtgatcaaggctgtgaatagctactgctctccatcctcagcagcacagcaagactccatctctacagaaagaaaagaaaggagggaagtggggagggagaaaaaaaagaaagaaagaaatttaatggtaggtaccaaggatggggataccattgaccagagaaaaggaagggagggagggaggggaaaaaaaaaaaaagaaatttaatggtgggtccccaaggatggggataccattgaccagagaaggggtaaagaagaaaaaatgatggacaaaatatgtttaaatgttggcactatttggactgacacttttaaccattatttactctttgttaactgtttggagttagtaaaacaaatacattctcttttgttaattcatacatagatattctgcctccatggtggcctctctccatccatagacacactggatcatataagagccctggatcgtttacaggaagttccacatgaggtaaacttaatttaaaaaagaagaagaaaggaaaagaaaatataaccacattttgaggatgataaagtatgactgataataatttgtaacatgtacttatttttcttggccagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggaggtatgtactttcctgacagaatgatctttatttcagattagtatatacttctgtaataaggcattatgacttaactaagaaacattcctcaccatttattacctaggtgaaaagaggaaaaacttgctggttttagcaagtagggaaagcactagtagaccagagcagaattataactcatttttgaaattgagacttagaaaaaagttacaaaaatagtaccccataattccctgtatgcttcattcagattcctgactgtaaatattttactatatttgctttatcattttgtgtctctcttcctcttcacccctcacactttcttctgaaccatttgaatatctgttgcagacagatactcctttactaccaactttctatgtgtattttgtaaaattaaggacacactgtcacataaccaccgtatagttatcacagttgggaaatttgtgttcatatagtactgttatttaatatgaacactttattcaaattttgctaattgtctcactaatgtctttaatagcaaaatttaattttttgtgcatactgtatgtgcatagtcgaatccaaagattaggttgtattcattctactttgatgtggaaatcctccgattttcattgttttccacattcttgacattttggaagagtaggagcattttatcttacagaaatatccctcagttggggtttgcctgatgttttccttgcagttagggattcaatgtatgcatttttggcagtcatgacatagaaagatggtgtgtcctcctccgtgcattgtatcaagtggtcctaaaatctgcttgtctcaatgctggtggtggcaactttaattgcttagttaagatgatgtctgccagatttctccactataatattaactgttatacaactactaagggaacataaacaacataatccctgcagaccagtagggagtggcttcaagatgtttagagaaaacttcgccagcccagtagaaacaagggagcatgataaaaaaaacacaaatttacatagtaaaaataaatttaattatatcagtgattataagaaagagactaaaattttagcctgaaagagactcttagattggataaataatcaaaatttagctgttatttgggatgtacctaaaacataaatgattggctggacaaagtggctcatgcctataatcccagcactttgggaggccgaggtgggaggatctcttgagtcttggagtttcagaccagcctgggcaacatagtgagacctcatctctatataaaaaaaaaaaaaaagtcaaaaagttagctgggcatggtggcatatgtctattgtcccagctactcaggaggctgaggtgagagggtcacttgaggccaggaggttgaggctgcagtgagctatgatcgtaccgctgcactccagcctgggcaaaagggtgagaccttgtctcaaaaaaacgaggaaaaagaaaaagacaccacaaactagaggtaagagttggaaaatggtatattggtatatcaagtaattaatcaaaatatcaaaaatatagctaatgagctggcgtggtggctcgtgcctctattcccagcactttgggaggctgaggcaagcggattgctggagctcaggagttcgagaccagcctgggcaacatggtgagatcctgtctctactaaaatacaaaaaattaacctggtgtggtggcacgcacctgtagtcccaactactcggggctgaggcaggagaattgcttgaacccaggagttggaggttgcagtgagtctagatcgcaccactgcactccagcctgggcaacacaggatgtgtgtgtgtgtgtatatacacacatacatacactaatgtatgtatatatatgtatacatatatacacacatgtatgtgtgtatacatatatgcacacgtatatatacacatatacacacgtatacatatatgcgcacacatacatgtatacatacatatatacgtgtatgtatatacacatgtatatacacatgtatacatatatgcacacacatatatacatatatacacgtatatatacatatgtatatacacatacattaattagcatgtatgtatacacactatatataatactatagctaataatatgaatgagataggctctaataaaaggtattattagaaataaagagattattgatgaaaactggcccagttctctaggaagaaagtattctaaatttgtatttacctagtaatagcttcaaaatatataaagaaaaaattggcataattcatgagggaaaattgagaaattaattatgattgtgggagaaattcagtacacatccttgccaagatttcaagcatagatacggcaaaacaacaattagcgagctgcatttaacagactcctaggcccacgaattgcacagtattctttacaggtacacaaactattaaagatggagaccttatatagtaatatagacgactacatttccacagagagtacctgtagtttttgagtttagttttttttaaatgtgtctgtgtcaaaatcataatattataatgaaataatgaatttgtttttatcctgcagggatacaattggtgtcatgatcggaatgtggttaccattttcagtgcacccaattactgttatcgttgtgggaaccaggctgctatcatggaattagatgacactttaaaatattccttgtgagtaactgtaaattttaattgtatatactttcagaaggaaaattttaaatgttaaaaatagaagatttctgtttctgaaattggatgaggagtatagcaaagcccctctccagcaaaaataaccattagctggagaacattatttttaaaaaataatttttcaaagcttttggaaattgtcctaagggcatacagcaggtggagaaacagttaattcaagaaaacctactaaatctcagtaataatagccgtagtctgtggcatttgagctatgacttgccccctccaactcctcccagatccctctcacagaaacgactacaggcgctctacgctgggttggtatagtcaggaggctaagggattccccctcttcatcagctcccagggctggggctgtgggttcactcccagagatcagatgccagcatatctcacctctcctagtctggagttacaaaagctctactcctggtagacacagtcaagcaggctgaggcccccttccctgccccagctcctggggcagaagctctgctccaggcatgcatggcagatgagaatgctgggtttcccaatgctgttaccccagcacctgcttataaaccaggtggtatcactgagcctgcactggcacagaagttctgctcaggaggaaaggcaggtcacagaagttcctcagctctgcctcagaggacttatcttacttaggtgatggagaattccaaatctgagtgctttgtggaaagcagtagatgtcatggtggagaccaattaagagggctgtaatagctcccatgatactaggagcaacatacaaaagagcagagcaacatgttgttcaacaaatagcaccagggaaaaagccaagaagagcccttctgggatcacagtcagccctgggggacaagaaggctgtgcacatgcactagccatacccactcaggagcagtcaagagtaggatgtggggtattcatataatattttcaagccacacatagattgtactgagttgaataatgtccccccaaaaaaattcatgtccacccagaacctcaaaatgtgatgttatttggaaataggatctttacagatataattattaaagatgagattgtactggattagggtgggcctaaatccaattcgaatgggattttagtaagaggaaaagaaacacacacaggggagaatgctgtgtgaagccagagattcaagtgatgcatctaccagctaaggattgccagagccatcagaagctagggagaggctaggaaggatttttcctagagccttcagagagagcgtggtcctcccagcatcttgctttcagacttgtagcctccagaactgtgagaggataaatccccgttgtataagctatacagttcggtaatttgttacggcagccccaggaaatggataagtagattgatcaacaaatggtgtaaccatcactagtatgtgaggcttaaacacaacctctcatcattgactgaacgacattcagttactctgatccaggagcacctcctaggtagtcaggctttaaaataaaatcacactcatccctgacagtctggcagaatatgtgcatgcccaaggttataccctctctggactgagtgcagtatgaagatccaactattagtccctggctgaatgggaagccaaaatataaactccttcagctttgatagcaatctgcaagtcacataacatttccggtggccattagggtgagctttaagatctaactggccaagggggcttaagtacaatctttgatcagtaagtggcttatgcctacccagagacagcccctcagtagccaggctgtgaaagattaaaagaagtaaaaacggtcaggcacggtggctcatgcctgtaatcccagcactttgggaagccgaggtgggcggatcacctgaggtcgggagttcaagaccagcctgaccaacatggagaaacccagtctctattaaaaatacaaaattagttgggtgtggtggcgcatgcctgtaatcccagctactcaggaggctgaggcaggagaatcgcttgaacctgggaggcggcggcgatcacgccattgcagtccagcctgggcaacaaaagtgaaactcaaaaaaaaaaaaaaaaagtaaaaacatccgagcagggccacaggggctgcacactatgggggaagtagactttacagttagttcagctaagtcactaaacaaaaataataaaccaccaaaaagacaagatcagtccccaaggacatgaattccagagctactgcaatatgttatctataatgtccaatttttcaaccacagattataagacatggaaagaacaaggaagtgtgacctctacacaggaaaaaactaagcaacagaaactgtttctcttggatagaacaactaggcaggagatgaaggcaggagaagacttgagcaacactgtaaactgactgtatacctcatgtctgtaaaacaacacccaacaacagcagaatactttcctctcaagtaaacatgaaacatagtcatatgctagactgtaaaacatgcctcaggcaatttaagaagattagattcttaaaaggatattctccaaacacaaggaaatgaaattagaaatcattaacatggctggatgctgtggctcacacaagtaatcccaacactttgggaagccaaagtaggaggatcacttgaggccagcctgggcaacatagggagaccccgtctctacaaaaaaatttaaaaattagccaggtatggtgccaagcacctgtagtctcagctgtatgggaggctgagatggaggatcacttgagcccagttgatcaaggctgcaatgagctatgatcacagcactacactacagcctaggcaacagagcaaagaccctgtctcagaaagaaaaaaacaaaaaaaaaaacaagaagatttgaaatcagtaacctatctttatacttgaggacctagaaaaagcagagtaaactaaacctgatgtaagcttatgaaacgaggtttagagtagaaataaacaaacagtagaaaatcattacagaaaaatcaacaaaacccaaagttgatgctttgaaaagccttaactagactggccaagaaaaaaaggagtaaagactcacattaccaaatcactagagaccttactgaaataaaaaggattataagggaatacaataaataactatatgccagcaaattcagtaactttgataaaacgtactaattcctaaaaagaaactactgaaactgactcaagaaatatgaaatctgaatgacctttcaaatgtgaaaatattgagccagcatggtggctcacacctataaatcccagctttgggaggccaagctgagaggattgcttgagactaggagtttgagaccagcctggacaacatagcaggaccttgtccctatttaatttaaaagaatataaataaatgagtgaaaaagttaaaactccccacaaataaaaggccaagcccaattggcttcattgatgaagtccaccaaatgtttaaagaaaggaattggccaggtgcggtggctctaaccagtaatcctagcactttgggaagccaaggcaggcagattgagcccaggattcaagatcagcctgggtaacatggtaaaaccctgtatctacaaagaatacaaaaattaacctggtgtggtggctcagcctatagtctcagctactcaggaagctgaagtgggaggatcacctgagcccagggaggttgaggctacagtgagccatgatcacaccactgcactccagcttgggcaacagagtgagaccctgtctcaaaaataaaaacgagttaatgccaatccttcacaaacacttccaaaaaacagaagaggaggactactgcattcattctgtcacacctgcactattatccttgataccaaaagtagacaaaggcaaaaacagaccagcatttgttacgaatacagatataaaattttccaacatacgtaccagcaacctggatctagcaatatgtaaaaagattatacaccatgagcaagtgggatttatcccaggaatgctaggttggttcaaaacatgaaaatcaatataataaaccatattaatattaagggattaaaaaacacatgatcatctcaatagaggcacaaaaataattggaaaaatccactagccagaaacactcaagaaaatagtgatattaggcctggcgcggtggctcacgcctgtaatcccagcactttgggaggccgaagcgggtggatcatgaggtcaggagatgagaccatcctggctaacacggtgaaaccccgtctctactaaaaaaaaataagaaaattagccgggcatggtaatgggttcctgtagtcccagctactcaggaggctgaggcaggagaatggtatgaacccaggaggcggagcttgcaataagccgagatcgtgccagtgcactccagcctgggcgacagagcaagactctgcctcaaaaaaaaaaaaaaaaaaagtgatattattattaaataatattaaacaattattgtttaattatttaaacttgatattatttaatctttaattatttaagcttttaaataataataacatttagaaattgttatgccaggcaccaaaccagacattctgtcttcttaaattttcaccatagccctatgaagcagttagttggaatgggagcatctgcagtgatttgcccatggccattccagccgtaagtgatgtagtcatggtgggaaagcaggactgctgtttctactacagtgtcttgttctttattcatttgttttctttgcaaagtcagatcctttatttgcttccttttttgccatttacagccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaacattcatttattgtgttgtgcattaaatgaaaactttattttttctagaccaggtcttgctctgtcatctgggctggagtgcagtggcacagtcatagctcacttcaaccttgaactcctgagcccaagccattctcctccctcagcctcctgagtagctgggactacactcaacataccaccacacccagctaatttgtaaaatattttgtagagacgggatcttgttatgttgcccaggctggtcttgaactcctggcctcaagtggccctgccaaattcttgagattatagatgtgtgccatcacacctggcctgctatcttgaaacgacataaaatctttcaaagcagggcaatgggacatggctatagtcccagctactcaggaggctgaggtggaggatggcttgaacccaagagcttgagggcagcctgggcaacatagcaagatgtcatctctaaaaaataaaaaataggctgggcatggtggctcatgcctgtaatcccattgctttgggaggctgagaaaagaggattgcttgagctcaggaggttgagacctgcctgggcaacacagtgagactccatctctgtattttttttaaaaaaatttttaatctctaaacttgaaataaacatttgtgttgaggaaattttattgtaatattctttgttacaggacttactttcagaagaaattcaaatagctgataacttttagaccataaaaaaaagccagtcgaaaaattttagtaggtaatttatattaatgtcacatttttaagtacagctatggattatatactaaaactagaatataactgggaagaaactttcaaaaacatatgtaatatatacatacatatatatgtatacgtatatatgtatatatatgtgtatatatatgtatatatatatgtgtgtgtgtatatatatatatatatatatatattttttttttttttttttttttggggggacagggtctcactttgggttgccccaggctggagtgcaatggcccaatcacaactcactgcagccttgacaataaatcagttttagaatattttcatgatttcagtctctctcttgacctgtgttgattttcattgccaccaaccagccccaggcaaccactaatctacttctgtctacagatttactacttctggacagctcatatcagtggaatcacataaattgtttttgtgcaggtttttcactagcgtgtcctgaagttcctccatgtcgtatttaacagttcattcttttattcctaagcagcttgccatggtgtgaatataacacatttctctctatgcattcatcagttgatgtgtccatttgaaacatttaggctatttccaatttttagttattaaagtaattattgtcatggttgctcaatttggtaaatttaccaagaatctttaaattgaacccttgaaatgggaaaattttatgatttgtaaaatatacctcaatgaagctgtctttaaaaagaaagagatgggctgggcacgctggcttctgcctgtaatcccagcactttgggaggccaaggcaagaggatcacttgaccccaggagtttgagaccagcatgggccacatagcaagaccccgtctcaaaaaaaataataataaaattagttgggtgtggtggcacacacctgtggtcccagctactagggatttgaggctacaatgatctatgatcatgccactgcactccagcctgggcaacagagcaagaccctcaaaaaagacttgtgcaataccaccagagcagtctttagaggaaaatttataactaaatgcttgtaacagaacaaaagctgaaaagtaattagctaggtgtttatcatgtaaaagttaacagattaagcgcaaaaatcaaaagatcaacagaaccacaaacttacttgaaaagactaataaaacaaatattacaaaaaaaccac

SEQ ID NO: 12333 - DNA, 85675 bp, Human
aatgaaatggtttttaaccaagctttagggattagagaggaaaaaaaaagtgaaaaagaaagggcaccagggtcttcccatctctatgctaaccaaagtgtggttttccagccctttttcttgcctattaacaaaaataaaaacaaaaaatggaaatgccactgggcttgaaaccccatttaaaatcagatttctctttcgagttcccttgcaatacaagtcaaagtcatttccaccaaaaaaaaaaagcggtgggggggggggggtgtgcaaattaatcctaaactcatggctcagataggacctggtatagtaaataaatgcttttaaaagtagtcatggcattgagaaatggctccatgcacctaaaccagaggcaccaatgtaaaaactagtaattgtgttttaacacaaaagattgaaaagcgttttgtttcacatcctaatattattccacccacttaaaaagagttacttaatattgactctgtattaggtataagacaagttcttgccctcaaagaacttataatttagttgagaaaccaaaacttaacatgagcttaaaaagaaggatgcagtacaaaacatggtataattaagtgttaaacaatgtagtatagatgctcagtgacctaggagatcagaggaagggaagggtcactgagggctgggaatgtcaaaagcatgtactttcagtaagttcttaaaatgatagcatgttagaaagctgttataattgctgctgatttgtaattttaaagcattgacatgattcaccattgctttccaaccagtagctgtttaaaaggacatacagttgagggtgaaaggagatatttctttatgatctccagagatttgtattgaggggaaaaaagacatactttcttgttgaataatagaccaagaattgagcatattttgcatggggaatattaaattcagtgaacaagaatccaaacctcaggctgtgattctggtataaatttttgtttctaatgaaccattttcttccttctaaagaagatttaagttttgggaataagtcacctcaaaaaaatttttttttattttctaatatctattttcacaatttatttttcttttaagaaaagtggactagaagcgcaagttaccttctcaaggcaatgagaattttttagctctaaaaaagttgtgtgtggtagggagaacatttagcatcctttaaaatggagacatctgaacagcaacctatcttttgaatcaccaaatctcaagtgtactttgcactcttggtcttaaaatgcttttcattttctagtttggcaaaaattccagtctctttacatttgctaccttttccgtctttgcaacacaggcagtgtgagctaaattaggtttgttaaaatgaagttttgaagtttaaactgctgaaatagaggcatgtccctaactttagacaaatttagagaatcgtagtaagcattattttttttctacatacttgtctgcattcagtgtcttcccaagaaacgtcagttaattccccgattcgaaaaaggaactttctcgtaacagttgtacaaccaggctaaagagcacaccctcgtcttccctgaaagggaggaaacatgcaataatgtgaggtaattaaatttagccttagaaaagtctttgaaacgttctaatcaagactttcagctttccgattgtgtgcgctttatttttcaattcttcctagtcccggttttgcatttctaatgacagtgaactgacaaagcgtgaaagtggtctaaggagcaaaacaaagccagcaagcctgcttctggtgtgccaagattaatcaatattccagaaacctcggggtttccccctcctccctgtgcggtttccattccccactcctcctttcccgggcacagactcctccccttttcttaagttgccctgatagtaacttgcagtttcagagcacatgcacactgtcagggctagcctgcctgcttacgcgcgctgcggattgttgctccgttgtacctgctggggaattcacctcgttactgcttgatatcttccaccccttacaaaatcagaaaaggtaagtgtcacattctgtgttcctgctgggtttaatttctcctttcacttctctgccgatgtattttgccttccaagcagaggagtagcctgaatcaaggctagccattttggtagataaagtccttgttagtcatctcacgtcgtgagagtgtggtgtctgtttatgccgggtccgctgttaattcggagttgagtcattcggggtggattgggggcagattgtggcgcgagatctagaaaaggatcaaggttgagcggatctgcttaaaagtgactggtaagaggaatcagagctattagtttaaaaaaaaaaaaaaatctggtctctcctatttcccggtcttcacttctccctaagcatttaatccagtgtgaagtcttaaacaaattagaagtcttagtatcactgaccccaacttgcaattttatttaaaaggcaaactgttaagacaagtctttttttttcctgcactgggattgcgagaagtcatttgcgaggagtcctttggtttccagttacctcccccacaggcgcacacgctggctgcttgcgttggcagcgacacacatccatggtacggctggttttcactcggattgattatgggaagggctatggattagagctcctgtaaagcaccaggaggaatcccttgatttttcagaacagctgatttccaccaggaaagagatttactgaaatgtagttaaatagcgtgagtgctttaaagaaaccagaaaccacaagctgtaatgtttggaatgaaaattggtttcatctcatctgttctagaaatcctaaattttaaaatgctaaaaagtcagcgatagtttcctcggaagattccagcatgtgtgtcacaaagaaaaacactacttcatacttctacttgtgataaacgaagctgaattgtgatttcagatgatttatagatgtgcccagagcactttgcttatttcatggaaaaaaaatgaaaaaattaccctgtaaaatagtcacatgtatttcccatgtactgtgggcacctgtgttctttttatgaccatatttactagtagatattattatatttttttcttaatgaagaaaatagctggttactttactgcatgtaacagagacaactcccacctatcagtatcttaattatttttattgacctggttatgctttcaaccatgtatacagcataatttgtcaagtaatgattgaatactttctgtgcattcagttcaattggacatttactgattgtgtacgttgtgcaaggcatcagctgggttctgcgggggagggtgggaataggggttctcagtcagatctagctctgaagaacccttttatagcctcattggaaggggaaggacggatttttaaaaagaaaatagaatatattccgaatttatgcacatttctcacacgtggtccactaaaatatgcacactgcaaccttgaggtctggtattgtggctctccagtccttgattcctgctgagattatgcaatttgccaagagcttgcctggtgtggagcagcactgatttctcacccctggaggctataactcatgtctctttttctcccattctagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtaggtatcaaaatggtagcctaggctttcctctgaacttgatgatttttctccataaaaatgactgttttggcttgtttggagcaatatatagtaaacacatcattaggcatcattaggcattatgcaaatcaattgtgtgaggaagaaaaataaataaaatattttcccatttcatgtaaggataaggaagtgatcatttaatcattaggcatgacaaagcaagcacgctagatttggccaaaatgtaattatatacaatgtcagttgcacttaaaactaatttatacaattagtacacctaaaatgacatgttggttccaaatagtaattatattctaactggtgctgacttgaagctgagtatcaacgcttaggcacagagaccgaatattttatgtgtttgcactctctcacccagcaactgggaaaggtagattggggaaaatgttaacacagatctctttcattcattgctttgcagagcctgccataaccagctatacctttttttgaatcatttccatctcttactaatttagcagggttgacagcaatctgtactaataaaatattattgttttgttttgtttattgatcttaaaagttatagtttattacttatgggtggcattgatcctactttaaaatatagctgaaaaaacctacttatttggaatttttgaccaaaccaatacagaaatccttagattgacaaacatatacgccaatgccaggttgtaaaaatattccaacttaacctaccaatttgccaccaaaaaagaggcattcagtaccgttttaatctctactttggagtttgccaagatttccatcaactttaaagaggtaatgatttaataaagattaagaaaattctgtagtgtgtaaatataacttttttcaagaaaattgaattcttaaattgtagacaaatgaagtatagcaggagagtttgtcacaagattttagatacatcccattttaacatcattgtcttccattagtaatcactggtgattaatgatggttcaattaatttagagatattcaaagagaacatgtcctaactgacccagagaagtaatggctttccacagtaggtttccaggcttgaatatattcctgggtgaaatatttcagtcccacatcattgtcctggaagtcaatgcaaaatacagtctgcttgcctcatttgtcactctgaatcaaagtcattgccaagccaagcaatagctgcataataataattgcaaacatttatatagtactattccagctactctgtaggagttttgtttatattagctcacttaatcctcaaacaagcctatgaagcgagtgagaaggtatgattactatgatcttcctcattttgtagatgaaactgactgtggagagatcaagcaatttgcccaaagtgacaacactagtaaactctagagctggaagtcaaattcagtctagcaccggaggccattctcttaaccactctattcttcctctgctctgctgctagttgacatcttttaagagatgccaggaagagaaataccctcatgagttgatgaaggccagttagctagcagtgcattcacacagcattgtcatttaactgcaagatttacccggttacctcaaaagaaaacttacagttctcctatagaccattaagccacttccttctcattcatttaacacatactcatttataattcatgatcctatacgtataataaatagagctcagtaatactggagtatatttgaaaaagatggagaaacaccattcaaaatggtgttgtaaacaccagaagagtggaatttctaagacagaaatgtttccattcaagaatacaggaatggaaattcataaaacttgaacatggaagacagattgatggagaaggaagttcctaagtcattagtacaaagcaataacatctctaataaaaagaagataatgccaggatttaaaagtctgtttttctctaggagttctgggatcatccctagtctatttttctctaggagttctgggatcattcctcacccagtgagggctttcctaagatttgtgagaattgcaataagagttggctgagctagggtagataagttggccgggtgccctcatggttggctttactaatggaaactgaggaggcagaagcagcaagaagaaggcactaacaaagaaacacataaaaagagctcattgacagtcaaagagaccactgagtctacatcaaagacttggaatagcaaatagacaacttaggagcaaacagatttaggagagaaggaagaacccttcagttatctgttagtgtgtcttccatcaagaacccagtgaatataaaggctctatttagcttgtcactgggttccatgtctaccagtcctaagagataggaaaagaatgtgtctgtacaccaactcttaatttatttgctgtagcataagaaaaaacaagaaagatgctagcaaggaagaaggagataattattttcccccaagatgagagatgagaagagctatagttattacctagttttcaaattcctaggtttttattgcttttagtaaaaaaaaaaaaaaaaaaatcactgggaaaacctatgtactgggttgaatcttttgtttagactgttttttttttttgcctttttgaaataaaatgtatatgatttaatgtgtagaagtggaaactagaaaaatattatgataaagacatgtgaatccatatattcaaaataaagcagaaaattataaatattttgatataaattcatctacaagcataagcatagaaccatttgtacaattttatgtcatttctactgtcatttctaagcaatgtcaaagtctgaatgtgccatgccatgacaaaagctcatgtaacaagagcggttagcaatccgagagaacacagtgccaagctccacatcccttagagggcccgtcatgaaagcattagataatggtctgccagggctgttgtggacatccgtctgacaaaaaccacactgggaagagtggttattgtctttcttcctccagaaagaaatttctccctttggactgtggtaagttgtgttagagtgacctcagacatctagctgaaagaaaggaaaagtcctttgtcatgttcaagtcacagaacactgactctttccatggctagggaatgaattgcacaataaaaatgaaatctcaggccaaacaatataaagaaatgggtcataagatcagctgcaaggttgggggatatgtataaataggaatgcatagaattgagtggtagttttacctgaaggcattcacaaacacagtaaactagcagctttctctgatgttggtcttggcgcacgcgcacacacacacacacgcacacacacacacacagagtttgcatttgagttctcctttttctgatggtctccttgcacagttcacatttgagttctcctttctctgatattgatctctcacacacacacacatacacacacactcacagagtttacatttgagttctcctttatatggatttgaaagaaatcggtgaatcatcctggctaaatttttataaagcatttccctctgttctctaatactctggcaatgaatttaaattgcactaaaattcagtggagggaggatcacttgagccaggagttcaagatcaatctgggtaacatagtaagttctcatctctccaaaaacattttttaaaaaagtatccgggtgtagtggtacatgtctgtagtcccagctacttgggggggctgaagtgggaggaggatcacttaagcccaggaggttgaggctgcagtgagccatgttcatgccattgcactccagcctggatgacagagcgagaccctgtctccaaataagaaaaaaaaaataataataataataataataatggtaatagctaacactcacaatgtatggaaagcactattgtgtttaagtgtattaactttatttaattctcacaacaacccagagagggaggtaattttattactctcattgtacagatgaaaaaactgaagcccaaatccttaccacacagctgatgaatactgagtgggattcaaatccaccattccggctccaggtgctcattcaccacactgttctgggtgctataacacccattctggctttactccagcaatttgctgagggtctgcctgaggtagcaacggaagagatggaaaagagaggtcgaactgaaagcccactggtgagacttggcaattgattcaatgagagaaggtggactgcagaccaatggcccgctttctggtttaggtggcagagtggctgatgatgccacatttgaaggtaggatacaggagaaagactggggccttgggggtgcacgaggataagttcagtttggacctgttgagtttgtggggcgggatgccaccgaggtgcatatacaatggaagaagcttgctgcaaatcaagatttagaaggtattcctacaacctccaaactgaacgaagacagttctgtctttggatttcaagtgaataaggatcagtgaatcgggctatcctactgcataaatgagtctactctgtaagtgagtctattctcagaacagtttccgtaactctagggccctctccttcatgcttaaaagcactaatctttcagaaatgctgtagtggtgttctgtgcctggacgtaactgaccaagccagttaggtcagccaagcaggttaatcaatgtggtttgctatcagctgctggactgaactgacctggtagtgggaccacaatagccaactgcttgagttcgtggagcaggcacagtcgggcgcccacacctctcaacttcctgaacccctgatagcggggcattttcacactgattgaacaacagcaatccaaacaacgatggacagataactgggttcagacttacggtttcttcaacacttcttggaaatgagcagggagagaggagcttcaagaagctgggggtagggggatcctgagtcccctggtgttaccagagctcagctgtgctttcactcagcagaggctgggagaggaggaggaggaagctatggatttgcagagtttttctctggagaagccacactgggttaggttataagaactagggtctgatttctctgtgctttatcttctcccctgggggaaaaaaaatacagaaaaattgtcagggctagtgataacacatgtacccacagcacacatgcctcccagccctctcccaccttctccaaaagcactccaggcgctgcctcctactgtgacggtgtagcccagtaaggtatagtggagatcagagctatgtgctctggagtcagacagcctaggtttatgtccagttctggaactgagcctctgtttcttcatgtataaaacagaataattataaaaactgtctgccaagatttatatcccagttctgctatgcacaagccatatcaccttaaatgatttccctaagtgcttgccaggtaaagtgtccatagacattgtaaaccccacatcttttatttacatctctgatatggcttcaagctgtcatatgcactgatttgatgatgctgatcttccagagagctataagaccctggcatttggggaggctggggggcagaagatactcacctggttttggtttagaagtggcttctatttccttagctagagaagagagccaagagagttgtaggaagagccttaatagttgtaacgggcttttagatgcagaaatgaaagcctcagagtaagtgataccatcattatctgtcccttaccgatctggcctcctgagcagaaccagaaagtaatccccaggcagccgttatcacagcagactacttagtggagggggcgcctgacagtagacgcctctctcaggaaaacagggaggtgctaagaaatgttttagtaagtgttgtaatacactcaatagtgaattttttgttcatacctctcagggccaatctgagtgttcaccacctccctggtttcttctttcctccagccctttggtgcctactgcccattaactgccactctggtcagagtgggggctggctggaaccctgagagaaatgtggctggtttccaagagagttgggaaaggttgttttgaagcagtgggtagaagtcttaatgttgttctaagtgtatctctggattctattttgctctttttcttcttgtcatttcagatattgaggaaacagagcaggcaatttcaaatttctctttcaagtaggtaatcaaataagcaagtgtgttcagaacaattaaccttcagtaataatacctttcatttttgtggtggtacagtttacaaagcactttctgttgcactctctgtagcacgtaagctatgaccaggccaccctccttctgatttgtatctgcaaatgtctgggacgcagctaagaaagcattgagagtctaaagatcctgggtacaggcccggctccatcaactaactcgatttttatggtgtaagacaaatctctgggtctcattttctcatcagcaaagtaagtttggactaatgtctgcttccaactccaaaattctatcattttaagtctagtttatcttcctctaaaatatctgaatatatagaataataaacagaggtgttttgctttgttttattttgttttgctttgttttgtttccagggcatgacactgtaccattgctagaatctttttcctagataacccattctggctggtctctccagtctaacaaatagcccccttctctccctttgacctcttgagggcccctggctctgggtctgataatcagtgtttcctagccagtgtttgagaacacagtgaggacacactttgcagaagccccttctgcccttcagtctctgcccatctctcataaattaggggaagaaaaccacaggcttttgtttttgctatggaataaataagattgtgaagagcctaacctgtttagaggaggcaaccagagtttgagcactgtcttttccaagctgtacattccaggtacttgatatttatggaacactaggatactatcattcatcaagtatttgctggcagctaggtgagctgcatcattgctgggagctgagaaaacacacagagcacttcagtgcacagagtttagcgactatactcactgagtataaaaatgatgaattttgtctgcgtgcagtggctcacgcctgtaatcccagcactttgggaggccgaggcgggtggattactacgtcaggagttcaagaccagcctggccaagatggtgaaacccggtctctactaaaaatacaaaaattagccaggcgcggtggcggctgcctgtaatcccagctactcgggaggctgaggcagagaattgcttgaaccgggaaggaggaggttgcagtgaactgagatcgtgccactgcactccagcctaggtgacagatagagactccatctaaaaaaaaaagatgagttttatgtcaagcttcagtgctatcaagattgcctagagcttattccctaggccaagaatattcacatcactatgccctatcaagagatatgctcaagagagtttgaaaccaaaaagagaaagataaaaggcccaaaaaggtttagataaaggaagatataccctggataagttaagggagggcgctccctttttccctttgtataacttatcaaagattggcgggtaaatttaggcgcagcaaattgaaaggcacaaccaaggtttgaatttcaagacggggtttctgtctccagagagggcaactccattcttcttgtcctcagacttctccagttctccaacaatgtttccaggctacaaactgctgctgcttcacacagagaagacagccggctgttagcgagagacttcttattcagaaccttgtatgatgaggctcgtttatccctaatgagagtagggagaaaaatataccctgcaaagatggtcccttcttttatacacatcgcattacttgaaatatcatctttcaagcaaataaaacaaaagcccgggtttcttgtgcttgtctagaagcttgctggtatcttcagctacttgatgaatgtgaagagaaacatcaagaaggaaattatgagtctatggagaaactccctgtgaaaaaagtagtcatgcttttatttagttatttatttatttttgttttcttagatttgcccttttagggcaaatgaagtagtttgtaagcaaacctgagattcaacaaacttttcagggccttgtaagttctgactttgcagtgctttccacgagacgatgggtgacgaggagcttgtcatctttgcagagcggtttcagttttctcatacttgtaactccaagggctaattgattgaagttgcacatgagcctataatgattgagttcaaagttttttcagattcgcttccttgtctccaaaaaaaaagaaagcggtttggtcagaaagtgatctactcactataaatctgaacacaattagtgactttcctctccatggcctaaactaagtaaactcctcgttaaagcaaattaaagcaggattgaggagaaatcaacccagactcaaagcgacattttagaaagatgcaggcatccagcaaaaatattgcagaaaagaatccaataagattaaaaaagaaagagggagaaaaggttgcgggcttttttttttttttttttttttggcctattttattttacttatgtagtaaataaattaacatagtccaaaataaaaaaatagaaaagcttataaaaagaaagtatctcattgacccctgtcccccaaggttcccgtttatcttgttattcatttctcgtatgcctttggagaaatgttatgactataaaaataaatatgtatttattccttttttgactctttgtatacaaataatagcatagtatacatagcccacttttcaccttgcttttttcactttacaatatacctgggatattattccttagcacgtagaaaggcccctcattcttagggctacattgtatgggcataatataacttatttaagcaattaccaattgatggacacttcggttgtttccagtctttagacatttttatttaaaaacgttgtaatgaatgatctttcacccatgtatctggatatacctagaagtgaaattgctgggtctaaaggtatactcattcataatgttgataagtattgctaatttgtaccccatagaatttgtagtcatttgctacaaatgtgggatttaaaaaagagttagcctcggtactgtactgcctctgccaaaggtaagcatgagtggactttgcagtttgtgcgggttccgcagacagactgaggaaactaaggaaatcagtgcattggaaaactgcaatttcaggatagaatcaggtagatgcaggtatctccctgcttctaaagcccaaatttaatccatatacaacacccaaagctttaatttgtatgttacattcaacttttgaagccctttcacatctcttaccatctatcatcttcacaataaactgtgaaagagatgaaccagggtttcagtttttatccctccctctaagccttcaccccctaccaccaatttagcagaagtttagaaagtgaaacattgagtgatgtgtcaaaggcgcttagaaataagagactgccagaaataagtctatagaagctaggatcaccccgctcccaggccagccctggctgctttagttacagtcttaggggatgcaacctgtccacaaataattccccagaatactggtgctaacagtctgagcacagatgggtctcggctgggctctagagcagaacataaaatcaggaaactagagcaaactttactcttcatactgcacagagacatatcagttagtagaacagaggctctgaaagaacagaaaagggaatagatggaaatgggaacacctttgctgtgcaccagcatataacacacaaaaggcaccaggggaacttgggaaattttaaacatatttcattcccagtttctacttgttcataataatttcctttttccagaaaggaaggcaacaagtcctgcttttaattgctatttctggaatagaagatttttaaaaataacaatggattggacatttagaatacctgtaggattatttgtaaattaaattaccacttcacatagccttttttggtgcagtttttggaagaaagcaccaggcctttcttaaaactccaaggttcttctgatgcagttgtctctaagagtcacacaccgtgtgcacataagtccgtgtctccactctacttggtcatcagtcacccagggctctctcatttgggcacccctggtggaacaaggctggggcaggtatttcccaccttcaacaggaaataccaaaggacaaaagaatgagccaggccaaggcccaaatctcccaaggatgtggaaacagaggagtgggggagggttaagaggttgcctccaacactgagtagcttctcaccaggaaacgcctgaaagtttgacagaaacaaaagaccagggaccagcagaactcttacccaggtagattcaccattatggctttgctttctttgtaaaaataagccaatacagcctggcacagtgactcactgctgtaataccagcaactcagggggttaaggcaggaggatcccttgagaccaggagtttgagaccagcctgggcaacatagtgagaccctgtctctaaaaaaatttctaaaattagccaggcgttgtggtgcgcacctgtagtccttgctactcagaaggctgaggcgggaggatcacttgaggccagaagttcgagaccagcctgggcaacagagtaagaccctagctctaaaaataatgaaaataagcgaatggaaatttatgtccaacagcttcatcaaactgtagtttgtaagcaaacataaaaatcataagtgtgagacaggcttatgatttctccaaattgggccaattcctgaaatagaaatttttatttgatttctcatataattattgcatgcctgccataataattgtaatggctaaattgctaaaacattttttgactcattaaatgctctcatatgcattatcaaggagtttagaattcattaacagaaacaagatgaattagtataaagcagctaagatttataatgcttttgatgaacatggttcttttaaactcagaacttaaagttcaggaggatcttagacaccacccattccaattgatctctctcattttgcagatttttttaaaaaagaaaaaagaggcctgaagagattgtgtgatttgaagatatggaaacaggcagacctaagtttgccatcccatcctctcatatcacttaccgcaatgtgccttgggcaagtggcttattctttctaggcctcaatcttttcattaatgagatactgatattaaacgctacaggtttgatgtgaaaattaaatcatttagataaagcatcgcctaccctaagttactgacaggatcaggcccagaactgtctttctacagcatcacacttgctctcccttctactcaaaaaaacctaccttaggagcaaattcgggatccatagctgtcattcctcatttgtgaatttagaaagctaagcctatgagaaatcataattcagtcaagatccagtcccacagaccatgagagcaaaatcacatggttttgtacagaggggacattccttagggtaggctactatgttcagggattgcagtagggaatcagatttactggggagcacagaacagagagattcctgcattcagaaagtgtgctcagcaccagctggggcccaggcactgttggatcctgctcatctgaaagaaaataagacatgtttgttcattcgttcaacaatatattaagcacctactgtgtgccaggaactgtttgaggggcttgatataggtcagtgaacaaaactgtccaaaaaaaccaaaaaaagttctaaccttgtggagcttacatttagcaggcagagaaaataataaacaacaagcataataaatagaaaattatattgtattttggaaggtgataggaactattaaaacaaataaaaccagctaagggataggaaagttcaaggtagacctcattcagaaagtgacatttgagctaggtctttttttttttttaggcagggtctctctctgtcacctaggctggagtgcagtggtgcaatctcggctcactacaacctccacctcccaggttcaagcgattctcctgcctcagcctcctgagtagctgggacaacaggtgtgcaccaccacacctggctaatttttgtatttttagtagagagggggtttcaccatcttggcctggcaggtctccaactcctgacctcaggtgatccacccacctcggcctcccaaagtgctggagttacaggcgtgagccaccacgcctggccgaactaaatcttaaaggaggtaagtgttgtggatatgtgggaatgatgttttaggcagaaggaagagccagtgcaaggaccataaagggggatcctgtctaagatgatggagaaatgacaaggagggaagtgtggaaacaggtgagagggagcagagtaggagatgggttctgaggcaaggtggatctaggggggcttgccaggagcacccattgattgcatggtcttgggctttgactacatgagaggaggagtcagtggagggagtaggggagagagatcctgacctaggtctcagtgttcttttgggaataggctggagagaggtgaagtagaggcagagaaaccagttagaagactactgcaatagtccagccaataaggagggtgactttttaatcttggagccttcttcatttacaaattagaaaaaaaatttgaagcatagaaggcaatagagttatccaggatcacacggggagttaagggctaggactagaatctcgacatcattaattccttaaacatttgtagagcatcttctctatgaagatagaagcagcctggtaaggaggcccagagacctctgcatgttagattgacctctaactgccgtgtatagctcaattgtcaagtgtgggtgggacttgtgacttctaaccaacagaatatggcagaggtgatgggatgacactcctgtgattatattacaattatacggcaaattcttgtaaccttgagacaaattagtgctagtttggttttggttttgctacctaaatggaaatatcctaactgtgaaatggcagcatttgtgtcacgtaaaaccagtgagtggtgtgctatcaacactgtgattttccttgagccacgaaaatggacatcctggtcccctttctggctagatatgcaggctgaggtttttctgggcaatgggtatgaatgcctcctggcattcctgtagcactaatgctcaaacagctggctggctcatcttggtcaggcacttagttttctcgtggttggcctcagaatgcgaggtctttctgtcaagatcattgtctctattgctttgagatttccttttgacatctgagctcctttggggcactacctcgttttctggaagatttggcgtagtaataactcttagaagactttggtctgccaaattgttcatgacaaagttcgcagatagaggaggtactttagtaaaattttactatttcaaactccaacatttaccaaaagttaagtagtatgatttggtctgaagtttacttcaaatcatgcctcattcttttactcttaaatattttctggcatcttaatattttcaatagttttatcatattaaatgtggaccaaattcttaaagttggtctttagcttgtaacttattgtgtgtgtttggccttaaagagtaaacctatgatatcttctttctgaggctccagtgtgcacgttgtgtcttagtttagaaaatgagacgatatttaattttccaaagaagtatttgttgttggccgggcgcattggctcacgcctgtaatcccaacactttgggaggccgaggtgggcagatcacgaggtcaggagatcgagaccatcttgtctaacactgtgaaaccccgtcactaaaaaaaaatacaaaaaattagccgggtgtggtggcaggcgcatgtagtcccagctactcgggaggctgaggcaggagaatggcttgaacctgggaggcggagcttgcagtgagccgagatcgcaccactgcactgcagcctgggctacagagggagactccatcatctcaaaaaaaaaaaaaaaaaaaaagaagtgtttgttgttaggaaaacaaggaacctctgaaggactcctttcttgaactttctgcattagcaaagagaaactatttaagcaaaaatgcaactttgtttatagcattcatccagcacagttattttgatcactttaaacattctagtcaatatattttctagattctagaaatcttgttaaaatactaacactggagtaaaacagaaatcttaactaatattgataaccaagggtgcatgatctgaatattgctcatgacatccatatattgtataacatcacctagatgcaaactttgcaaaatttgtttcagctctaacaaattctgctaggaagttattttgattttcattgctatttttgcagagtaatctataataaaggattcgttcttttgcactgaggatctggtggccataaagctttttgtcagctttgggactatcaatcaatgtgtttcaaataagtgaccactaatgaagctcagttttgcaaagggtgagctgctttaccacagagaaagactggttgtggccgggagaggtggttcacgcctgtaatcccaaaactttgggaggctgaggtgggtggatcacgaggtcagaagattgagactaccgtgaccaacaatgtgaaataccgtctctactaaaaatacaaaaaaaaaaaaaaattagccatgcatggtggcgcatgcctgtaatcccagctacttgtgaggctgaggcaggagaatcgcttgaacccagaggcagaggttgcagtgagccgagattgcgccactgcactccagcctgggcgacagagcaagacaccgtctcaaaaaaaaaaaaaaaagaaaagaaaaagaaagactggtcatgctacgtctccttggtcggaaagacagagcaaagagggctctgagaagtctgtgtatcaggctgtgtttccatgaaggcttttttcattgctggggtagaatgtaataggaaactagaactgcctaccaagataagcagccttcgtattcaccgcatttcctcttgatttgatgctgatagctggccgaccctacctctggcttcagctctaacgtggcttgtaggagcagaaagctgatgaaaaatgacttttgttgattcattcagcagtgagttgagaaaagctagctgttgacttcgttaagtaaaatcaacaaaacttttcctcagcttaagctctagatttagttaatgtcattcaaaatagatgaaaaagtaggcaaaatattgtgtacccatttagactccttcagtcagtaccatggctgttgagaggctgcgaggacagtagagtgggtgagtctggaccctggagctggacagtgtgggtatcaggtccacctcagccactccatggacttaggtgagcacgtaacccctctttaagcctactgtggcgccagcctgccagctgtgtggttttggcaatttacctgccctctcaatgactctgattcctcatctgtgagatgtggataacaataatagtcctggcctcgatacaatgcgtgaggcaatgtgcttgtgaggacttggtatctgccacgtggtcaatgactaggagctgttgctgttaaggatgcaaacgttgacacacgtcttcattaaattcttaattaaatgtccttctcacgttactaccgatggtttctagtgactgaaaatgtgtgcagtggagggaaaggcagactattttaattaataagctttatataagttttattaaatcatgaaaaaggatttggtatagccatttttgaaagtggctataccacctttgagatcttcagcaagtaagaagacctgtaaagggttccaagatgtgctggtgcttacaggacatgtgtaggagatccaaggttatttctccagggcgttcaccatgtaggagttcaagatgctaaagacccaggaaccaggctcttttgagacctatactcaggcctaggctacaagagcatgtttgtgtttgagaggcattaaaagagtaacggaaagagcactgggctttgtgtagaatccctccactcaaccacttatgagatctataagcctgagcaagttaactgacttctgagcatcagtttattaatatttaaaatagacacaaggcctggtacagtggctcacgcctgtaatcctagcacttcgggaagccgaggcaggcggatcacgtgacgtcaggagtttgagaccagcctggccaacatggcagaaccccatctctactaaaaatacaaaaattagctgggcctgttggttcatgcctgtaatcacagctactcaggaggctgaggcatgagaattgcttgaaccaggaggcggaggttgcagtgagccgagattgtgccactgcactccagcttgggtgacggagtaagactctatctcaaaaaaataaaaagaaaataaaatagatacaataatatctacctcataaagttgtgatgagtgttaaacaccatcgttaacacatagtaagggctcaataaattttcccctttcccagtgtaatctcatctttttcaagagtagaaatagctcacctggtaaacccagaaatagtaaaccaaccaaagcatagtcagggataaaaatgattcaaaatgtgtctgaatctactatcactctaaacaacacctctcttcaaaacttttgacctaaaactatcccttataaataaatgatgtctcctctctatagagaagagatgtcctactttagagaaatgacgtcctcctactatagagaagaacttttagacaatgtaggtgttgtcttaaggaatgtaaagaaatagagacacatcctagagtaggactgcacttcccagcaagaccagcttgctgactataaggagagacacacacaaaatatcaccacctcttgagactttgcttcccttactgtcttgcattgttctgttagatatctgtttggcaggtaagagactgtgtcattcacacattacccagaattcattcatggagctggcttactttccctcctaatacctaaataaaaattggttgcactgagtaagtgcagggcttgagtggggaagaggagagaaggtagtagaacacccaaggagaggaagaggctgtatacacaaccagtgttgttgtatcaatgggagtagagttagtgtaggctcagatgagactctggaagatgagatcaagtgcacctagtatttagaataatcgcttccttcatcagcccttgtttgacttttgcttctagaacctatatcattagcagaacagctattctatcaattacttataaataagataaattttatggactagatagtatcctgcctacccttggaaatattactgtatgtaagtaagtgtatttctaataacaaacagccaacttggatatgaatttgtaaaaccaagtctggtcttcaactgttgtttgcagaatatctaaaactcgtgacagcttgatacgttcaaattccagatgaccaaaatgagccccttgtgtttatcatgcacatgttttgttataattgaatgtcaagtgtttaaatccatttaaatgaagatcagaaagacacatcatcaattccagtaaaattaatttgattggaagtaaagcaaaatgtttgtttatttatatgtgataaagcacttatctttgtgtgacttggcttttatgtgagcaagcaggaaaaagacagatataaccaaagtattttattaattcctataagttatggatactgctgtgttaaataatgcacattgtaaatcagaattaaatgccttacaccagattgggttccaggaagattgaaagttaaatattttaaaacaaaacaagtaaacaaagaaagaaacatgaatttaagatctatcaaacttgtgaggggggagggaaattaaaatgtataaactcaagaagaaatcacctaataaaaaaggtgtgcagacattgttataaaaatgcaaaacacctgtacatgtttaatataatgtaaggcaaacaaaccagaaaaacagttatagcaagtattttatacataggcaaagggtaattatctttattatataaaaataatctacccaacatatacacacacacacacgtacgtacctagactcttaaacgattaggattgaatagatgcttggagaaaatacaattaggaaaaatagtcaacatcattagatgttaagtaaatacaaaataaaacaaagtatataatatttactcatcacattatcaaattttgcttgttttaacaatctttttatgataatactctgctcctgggggtagaggaaataaagcctcattcactaatagagcattaagctacccagccaacccacgcagaaagcaatttcgtaacatggattcaggtagtcgtatcctctgaggtagcagttccctttctctaaaactacactaaaaaaaaaaaatcccagatgtaaaatagccttcatatattcatcatgatatgcttcataaaagtgaaaaatgccaaacaacctaaatgttcaacaatagagtgaggacaaagtaaagcctgatacagtgaacgaatctgatatcaggagacctaaaagtgatgtttatggtgaccgtatatggaaaagtatattctgtatgatttccatgtgtttaactatgtattggaacattctgcaaaagagacacacaaagtggttgcctttgctctacaggagaagaggaaacacataaaggggttaagaacctgggatctgagtccaaattgtctgtttttaaatcctagctctgccacttgagtatatttgactttaagcaagttttaagttcatcgtgattaggtttctccctcagtaagttagtggtaaaatagtaccctcctcctggggttgttgcaaggattaaatttgctgctaacctaggcaacacccagcatatagcaagagctcagtaagcattagttatttactatttatttcagtgatacaaacaatatgggcaggattttgccccacctttctgcgttttccaattcaacttttctccttgaccatattactgttacattggaaaaaagcaataaatatttacctgaaggccctgagagctgggtcagctggattttttttagccacgtagattaagattcttattagaatatcacagtttagagacaaagaatggatactttatggttgctaagacccaagaattgaaattggagttgcagtgacaattcaaatgaactttgtgtcccatttcataagaagttaagacagttcagtttccgtaaaagactgcttgcctcctctagaaaagcttgtgccaacccggtatcattcccgcttctccccaccaacccaccacccccagcctttagctcctagttaactcagtgctgggcatgctgctttctctataacttacatggacttttttaaaaaatggaatcacatgtttcagtaataatagcaaggcaaaaactttaaaaacatttacaacactggcataagtaaattttctttggcaaggaaagtaaattaggtaaaggggagagggagtaaatttacacttttattgacaccaatacctttattaatttctgaacatttcagtagttatcatgcataatttgatttaaatgcaaatttctcattctaaaaagattttaaagtttcagttgtagagggaaaattaaggggaaaattgcgttctctttcccctatattctcccacgttttcagggaaaattttggggagaaaatctctgctcattttggagtcttctcttgccagcaactaacaagtctgtacaatacagttaccaaggcaatgtcaagaccatgtagacagagggagaaaatgtggtgtgaagacagggagatgatgaaaatggattaacaatgtgaacatgaggggtttttctaactggaaaaaaaaataaaatcacactatcctttaaaagtggttatgttagcaattctaacatctgttgttataaaggaacttaattaaaataaagccttttttttctatatcacctgttcgtgaatgcttatttgtttcctaattatgccccaatctttgtaactctgtattgagccaggtcagaatgagttccactgcattcaagttagacaaagggatttttttacttgttgaaactagaaagagtttttttctataagttctattgaaccacggattcagccagaccctcacagataatgactgcaaagatagatacatctcttgctcccaaagcagcacagatatttgctgcttaaataaatacaaccaccagccaaatacttactcattttgctagggctgttccttctgtttcaaaaaagactcaatttttctttttctttttttttttttttccttcaggtacaatccttggatttaccctccgaccatacagaatgagctaccgggaagtcaagtacttctcctttcctggggaacttctgatgaggatgttacagatgctggtcttaccacttatcatctccagtcttgtcacaggtaccataagcagttgttggtttgtttggttttttttaagtgtgtttattgcaaaagattgcttagaaaagccagtgctttaggtttctgctggatgcatgctctgttctagaaaaaaaaaaaaagtcccttcaaaatgatggaaaggaggctttagtaatgcatgaatgattataactctcgtattttaccaatcacaagaggaaacgaatttaaacagccacgtaatctggttcgcctcacagtgaacgaggtgccctgctaaacaccacaccatcagccttctctgaccacagtgatgtagttgacaacagcgtacaacaggtctgttttctcaccctcttatcccacccagataacatctggttggacagcctattagctattgatgcaagaatgcttgttctcagaaccaccaggacttgagcgggagccttcttggaagcctcatcaagaggtaatgcccacaacactcaccaactctgctgccaccaacacttatcttttcctggtgtacccgcatgatttcatttccttctccagttgcctcccacccccgttaccttttatgctagtgggagaagggggagggggcgggagattttcccatctgaatattttatcagtggacacttggatttttaacaagtggaagctttgcaggataggattctatgttctatgacaatgagataaccatttattcctgcatgggaaaaggtgaaagagtcatttgtctatgtgattggtgaatcagatggagccaagaagttgcagaaaaatgttactgtacattccttcctgcccactcttctctttccccacagcacatctctgacttggagaaggaatttccatagacactgcccgagcaggatgatttctgggtttgtaggtaaagctcagaactcaggtattactgaccctattctcttttccacccttggctcactgttcccctgttgggcatataccactctacctctatgtgagctggcactgagaatccttcccatcccagggagttctcaaggatatttatactatccttcaagatctctgtgtaatgagaacttcatagtacaactcaaaagtcatggaggaacattctattacatgccttggagggctggctattacttagacaggaactatgtcagattttccctcaatgccttgcagatctctgctggtttccacttgtccagggccttaaacaagtgattgcatgtacatatgctttcactggagaatgaattgcccataaaacagtcctggagttgatttgatgtacttgtttgtgaagctgggatggtccattgctgaccaggggtaatcacagcagctacagttcttaccacaaaagctatattcatgctgacatgagggcacatgcttattttattatccatatgctgatatttttctgggaaacaaattattcacagaaagcacttgtaagacagaacccacatctgacattttctgtggtagagcagagtctctcctcaccatccctgctggcagggcatctggattaagtgcctgcagttttcctatacacaaaccgaggggttctggatcttttatactttctcttcaagggtggaaccaatgtttagaggtatctgctttctcttaactgtgctgaaaatccaatgtgttactctttaaaagagaaaagcccttatatgatacaattagagaagtgttacttccccttagcagcagtcccagttgatcaccaccttgaagtggaatttcctgatttttcttaatacctaataacaaacaactttattgaagaaataagaactttggttgtgtaatttttcagaaaaaaaaatactatgatgcaatccctttgcatggctaaagagaaatttttggtcaaaacttggaaaaattgttaacatttataatattgttaaagagaaaagaattataagctgcaaacaactaatataaaatgaacttttaaaactgtaacctaattgcaagttgggagtgttgccaaattggaccattaagagagttttagctcttgtccaggactgtgctaaggcaaggagtctgaggggcagaatttagttcgccaaagatctttttaaggtgttagtctgaagtgagtaatttccaaactacacagtaatttagatatttatgatcaaatggaatgaatgatggattcagtaagaatgtcctttatggttttgaatacaataattctaacccaaatgagggtatgacccagctataatgggaagggaggaacttctacaaattacacagacccctggaggatccctgtgtatactgggaaatgttactggagaatgtgttgcctagggaagaaacaaaggcaggctccattgctttagagtggaaaggcaacctcaaatgcctccagtggccacgtgggtgatgcatgtacatgaagctgccctttcaggctattttttgttttcctattttgatagagtcatggatacagagaaatatttctcttcaacaagagaactaagagggacaagtatgatgataaacggagagggacccaactacagaataatatggcaaaaggcaggcaaagagactattgagacaagggccagatcttcctgtttttcaagagtatccagaaatctcaaattttttaagaacctgcagattctttgatacaattcacgaaacaaaccagtgcaaagcaaacacagtacacccattccaatgtaattccaatggcaggcccattccaaccctcagactaccaatatttgaactcaggtttgaatgtcagaatccaatcattggcagtcctgtgccaaagcttaactgataatgtggaattcactactgaacatcatgtttactgctgactaaacaaattgctattggaaagcctcttctctccatcttctgggtataactgcattgtgtagtagccattctggtcttttctgcaccagaaggaacactggagtaagaactcagaggtcatgctcccataggaaatatttcccagtggggaaatactttatagacttgtttctcctaagttcagttgtcccagggtctgtagacagaaactgaaatgcataaaactattattgtgtttcttggactaagctttttattgtggaagattctagaaaacatgctataagtttaattgtactaaagccacatttaaattctgagacatctaagttatattttttacttgaaacatccgtgtttatgagttgtggctctatagcccttgtaagccatgttcccttttccctgaatttgaaactccaatctttccaaacatccctggtgtgtattagcattccagaggctgccagaaagaagctgggaggaagcctaatggctagatttgtactcaagtacctattttttggacaagaagactatgtctgtgccaacacaccacacaataaaataggggtttggtgccagtttctatcgatttggtcaggatgggcagccaaactagaaatttcatgccagaaatatgagttggtttggctgacttagcctgattaaattcactggataataattaaatgtcacatctggttgtgcagggtagacataactattacctcctcacttctgaatcttttcagaaactagtgctttcttcttttctcattctaagtgtgcattccccctcaatcacttacctcagaagaaatctttggtgtcaccccagttttctggaagtggggagcacaacttttgacatgcaatctctgtggtgttgggcatgatgtaagtaaaagaggtgagagaggagtgtcaacacgagtaaaagcaacagtgtctgggacgtatggtagggcaccctcgaggcaggattatcaagtagatgaaatttctcatttaacattcattcattctttaacagctgtttattgcgcttctactatgtcagacactggggatacatgaacacaaagatacagtccccaagaagatgtatgttgggtgctgaggagagagcttccctgcatcccttaattcacataatattccagttccaactaaaaggagataagactcgttctctgtactcccaacaagaaagtgacaagctgatttttaagaacatgatttcaaatctgattttcatgacacagcatctccatcctaaagtcaactagcccagaattttccatcataggtaccatctcagtctcatttacttaatattttctttaaaccaacatactcttcttccacagcctacaatcattacccaaaatggaaacctcctattacttgtcatgtgaaggagataagtaacaatgttatgaaattgtaaattgatgcaattgcctaacaaaggctctgggagcctgagacccgactcccccgctcttgtagtatttttaaatggctgggcgtcgtggctcatgcctgtaatcccagcactttgggagactaaagctggcagatcacttgaggtcacatgttcgagaccagcctggccaacatggtgaaaccccatctctactaaaaatacaaaaattagccaggagtggtggcgtgtgcctgtaatcccagctactcgggagtctgaggcaggagaatcacttgaacccaggaggctgaggttacagtgagccaagatcgcgccactgtagtccagcctgggtaacggagtgaggctctgtctcaaaaaaagaaatataaataaataaataaataaataaatagaggggattagcaaatgttaacaaggtgttaaacacacattagtaccaaaataagactttgcctttcctgtaatccaaagaatcaaaagagaattgaaaagaatgactttctcactgtgatttaatattaattaaggtaggatttccacaccaccagaacacctatcccactttggaaagcactgatctggtggtccagacattcctgcagtgtcccttccaaatgactgtccagcttcttcctgaacatatctaaagacaagagctctttggaacccatttgtccttagaaaactctaacaatacttttttttttatccaaaataaaacaaataaatttaaaaaccagaaaaacaaaacacaacacctgcctctctggtcctctcctctccatgtgacaagctctatgatgtgtcacatattatttgggcagcttcttttcaaatctatagaccaacaacttcagtcaaatgtgggactcaatgactgttgaaggcagtgagctagaatcaccagcaaagggctttcttaattaaaaataataaatgttgtacctcaaagtacggtcctttggcttcagagagatgacagttacagtaagagtgaactaaagttttgtcatttcgtgtaacacaaaagggctagacaattcttaaatcttcgcatctgaagggtttgtcaagggcttgcaaaatgagtcgaaatcacttaagagaaatttaatatcttaaactatgcattgccatggctctggtgtatgtctgaggcctgtttgaatactctgagcatttatggacaagaaaaggagctgtagatttcaccacctgcccccctcaacacctacccgtacgttgtattgaaaaaaaaaaaaaacagtatctaacgcagggaggaatttctttaggcttccctttcattctctataaaatgtaagtgataagatacctgtgtcacaaggttgttgtgaggatttatgcctggcacatagtgtgtgctcaattaatggtagctgttggcggtaagagtagcagcaagagctgtcttctggcggttcccattgtataaatgaaaattctagagcaagaagacagagcttcaagtcagggacacggaactaaggctccagatttcacaagtctcatttgtctgtgatccctgaagcaaccactttcctattaaggtaaattgaagaaaccataaaattaatccggtaacaacatgggagccagcgagaattcctacctcattactggaagggataggtttctgccctgcggcatggaattcgattaccttatcacagctgcataattgtaaatattttcattggttatacaactgctgtgtcttttctgagaaactcagccccaatgtgtaacaccctggattccacggggcagcaaattccacacactgcacccatgttgtgagcggagattttcgggctgaccaaaacttgaggcgaactgagtctccatcttaacactcaaacacacttcatggcggcctggaaacaaggcaatcattatgaagcttcagcccagttcttctgaaaccaacgtattgggcctgcttcattgtctctctaggggctaatcacaaacatgtgggaagggaagctaaggaatgcctgtctagaaagggaggttgtataatgtagtgggaagaacctatctgtggggtaaactttttttgcatcatgtagaaagcaaatctgggtaattaaatgtttgtgtgtgtgtgtgtgtgtgtgtgtgtgtgtgtatttaggttttggtgaggtataaagccatttaagtctagctataccaaaaagaatttacctttccattacagatgattcattcagtaagcatttgttgaggatctttatatgccaggtgcttctctaggagctgaggataccaaaatggagaagacaagatttctgccctcaaggcgttcaacgtctggttgggagatggactcatgattgcagtattcatggtatcagtgacatgggtagtatcatctcaatgaaggaacaacttagggaaggaacgatgcacccgtctcttgccctgcctctccagtattcgggcttccttgctgggaaataactctattagcagagaagaagggggtcttttctttttctttctttctttcttttctttctttctttctttctttctttctttctttctttctttttctttctttctttctctctctttccttttctctctctctttcctttctttctttctccccttccttcctttctttttcttcctttcttctttcttttttttttttttttgccctgaattgttttcctctcacctgagtctttcaccattaaatgcagaaagaaccagaggtggggccctgtgaaattcccaagaaaagtcaacctgaggaacatggcctcacaaatgggaagtaaaggagaaaaggtgcttgacaggctttcaacgacagaaaccttccctttcgaagggagcttgcaggaagggagccaggagacctgaggatctctgggctcatgcaaccttgctaccagagcaggaatcccctctccagcccctggaaagtggccatggagctcccctaaatggtccattcttaggtggtctcaactacgaagtctgtcttctgtgaggtccacctattggtcctaattgtgttatttggcacaattaggatggcagtctttcagatggtctcaggggagcacctagcagtctcttgggcacctaagcataagcaaagtgtcccagtgcttcttctgtgcctgttctccaggacttccaccatcctgattgcctctccaccatccactgtgctcccagagctgatcctggtgctccagatgtcatgtgactgggtagggacagtggtctagatccaatcctctattaatgcaggccaaggttgggtccgctgctttaccagccacgacaaaccattggcttagaggagttaagcttgtggtcaactaaatcctgcagaactgagtgtggaaagatttttgtggcaaaaatggaattgttcttcaattaaaagatcagtaataaaaggcatacggctttgttgtgagatgctgctttccagaaggcttgagcctgtgtgagttagaaattcttatttgctaatttcagcagcttcaagtgagccagagattttgatcagttctcgtttggaagaaatttttgaaaaatttaaagaaaaggtaaataagaaaggaaaatttaaagcttcctttatctctaggaaaaataagattttccacccttaaattatcaacttaataaatctccttcagaatgctgtggaactgcaggtttcttctgctgatatcatggtttccaagagagtgagttacctggttaattctgacttggaggtttgtgcctaaggattggaggtggcaggttggggttggaggtggggaatacttccgaagtgagacactgtcttaggctcttctaatttctagagctcacattctgagaggatgcactgtcccatcagattaattgcactacatagaggtagtgcccagcttccaatccctgccccccaccccagagttctttaattaattgatctgaaatggagcttgggagttgacatttatttgtagttctctagatgattctattgtgcacccatggttgaaaactaccactttacagtttttctagaattgttgttttctggcgccacagtcccccactgttactactttagttgatacctttattagttcagataccccctcttctaggaagccttccctggctttcccctgctaatacagggtcgcagaggtgtagatacgtttccaccttatcacagttactgcatcacaatggaatgcactgttaacatgtctatcttcctcatagaggcttcttgaaggtactgtgtctttatctggcacattctttgcattgcctagaggacagagtctgcattcttggcaggacaaataagagccttagcagccttcgcaagcccctctaccagctttattgcctgctgctctcctggcagaaaccctgtccctctctcaacgtcctaatgccctcagcacttcatccttagtatgcttccctcttccctagctccatcagaattctttacctacttcaaagtaaattgaaagcttagctttcaatctttccgtaaagttagccctattgatccctccctggagtacctgtcactgtcactcatacattaccagcacatgctgtcatgctccaaactaaactggagggttccactaggaccatgtttgatgtatttttgtggcatctggagcaaagttcatcctgcctgagaagtgtaccatttttaatggttttttgtttgtttgtttttgagatggagtctcgctctgtcgcccaggctggagtgcagtgacgcgacctcagctcactgcaacctctgcatcccgtgttcaagggattctcctgcctcaacctcctgagtagctgggactacaggggcccgccaccacgcccagctaatttttgtatttttagtagagacggggtttcaccatattggccaggctggtctcgaactcctgaccttgtgatccacccgtctcggcctcccaaagtgctgggattataggcatgagtcaccgcgcctggctagttatttttaatcacaaaagcaatgcattctctattagaaatgacacatacaaatattgatgagcataaagtaaaaagtgaaatgctactctgcaaaggtaacaaccgttaacagtgctagacctgttgctggagaagcagtgtgtggtagggaataagtgttcaggctagaaggactgagttggaagcccagcgtggccacttcccagctcagtgaccttcgatgggctactttatctctctctgcctcagtttctttatctacacgatggggataatagtagtatctacctcattggattgttgtgaatatgcaagttaatacacattaaacatactgcctgacacacaatcgctgctaaaacatcggcactattaatctttcacacgctttgttaaaagcttacacacaaatataccattgtttttatgaaaacggaatcatatgtattgttctgtaatatgctttatttggatagtattctcctatgcagatatgtcttatcactgaatgattagggtatctctaatattctgctctttcaaataattctgcagtaaacttcagcatgtatgtatctttgtagtctatttctgaatgattgatgactaaaagcagagctgttagagcaccaagcatgtgcatgtaaaatccagagagatgttgctaaattacctcccaaaattattctcccaaaaggatgctgttttctcctactccttcagaagatattctccactataaattccatacagttttatttaaagtcatttttattactcgggtggtgcatgaatgcttactatttgtgtaagtaaaatagaaaatgctatatataagggaaaacatgaaagtacgctgcgcatgcacgcacgcacacacactcacaaacatgaagacccccactacattcactctaatttgaatagacttctaaactgattaccctggaaatgactgggaacccgcattccgttataaaaagactctgtgcaccataaagccaagtaaaaagatgctggagtttctgctagcagaaatagacagagagagagaggaagaggtgggggcggctgggggaagggtctatatccagataaggatttctgtggccatgtcatgaattgtatgcctccagaggacagttctgttttttccctctgtttggtatttggtggtcatttcatgataagcagaaagaaaactttgggatagtgctattctctgctgaaggacggatttacctgaatgatcttccaattttgagtctgggtagaatctagggtcctaagtcttaagtgtctgcaaattcattttaccaggcaagatagacttctttttgcttcttcatggtgaagatccttgcaataatctcagatcctcaggctggaagccggtgcattaccccatgatgtacttctttcactaacccatcaacttctatactaccagtgtaacactcttctcaaccggactgcctcatatggggatataggcttgccatctttgtgtttattttttaaaacaattgtttgagtttccatccaggttttcttcaaagggaagaaatttcccctaaattaccaagccagtttcctctcataaggcattggattaagagtggccagtagctgagttttgtgattctgaggataagtaataagtcaaaaagagctgttggctaatcctttagaaggatactaaaagaagagtaagatgatcgtaagcttcctagatccaggctgttaaaatgacctccatattaccaagacttgtcagtactgttaagggaaaaaagaggggaacccctatatataaaaccacaatcttgtttcatctataatacccctggtccccctccttcatctacactgccacccccccctacacccaccacttgatcattttatagcagatattttattacatttttgaaaacaaaggaaacataagacaggtgtactattttaagattatattaacatatttcatgtttctttaatgccccaacacacacacacatacacacacacacacacatacacacacaccaagagctgatcacttgaacaaatcattaaccaattgacttgcttcccatttctggtataagcttctgtaccagtgctttatattaattaccaaaaccctcctgcagacagagcatgatacatctttagtataggatgatgcaataaaatgtttatgctgtgaaatttggggacaaaatttttcatcatggcataatgtgcatgtatgggcacacatagctttgtttgtttattcttttttcagaagtccttccaattctaaaatgtattgtagtctgacagtgcctctaatattggtaattctttttaagtttataacttttcccgagtttgtttctgcactttaaggtttcttaactaggttatttctagttgagctgtaatttcagtgtatagttctccagagtgtttgtgctaagtgctgaagtttcattattttaaagctacctccctgaaagtatattacaaatgttctacaattgtaatatagtgattcacacacaaaaaaatccctattatcagcatacctaaactacacactaaatatttaagaaaaaaaaagtggaaacattagtagcttttatactggaatcttgccatttctttttcaatttagaatagaatttggttgtcttatcttggtactctatgcttcatgacatatctgaaagcattcttttggcatggatctggaagatagttttagagccagacatcagtgtagtagttctcaagatactgaaaattcataacattcttatgggtataataaaaaatgtttacatattgaattctatgaattctataatataaagtaggagcacacttactatgtgaaatataactcctatgcaatataaaagtaaaattataagcatatttccataaacagtaaaagctattaaatctaagcatgattgacaatttcaaatgttccaatatcatttaggcataatacttcaaagatttcaagccctttttctgctagcattcagaaaagtagaggacaagaaaggatgaagaaaagcttacagtgaaaaaatcttaaaattgagagaattcaatctattaactttaatctataaaccttttttctccgaactgggtacattggcatcattatttgattttagcagcaaacatttgggtttagcttatggaaggcagatgtcctgtgggaacgtgacttgaagtcaccatataacttcccgctaaataaacatctgaactgtaacttgacagctaccaagtgaggtcaagtgtctgaaagtgctgtgtacaccacataagcacgttttccttatgtgaaggatgcatttctagcaatgtgtatcagactttcaagtactcaaaacatacttgctgccaaactttgccacccaccactaacctccatttgatccttagaaggtagaaacttattttacaatagaaaaagagattattttatttgtatgatgtccctaaaattatttcttggtattgatagacctaggtttatcttatttcaagtttgccttattttttaagaggtttattgagatataactcacatacatgcaatttacccatttaaagtgtacaatttaatggcttctagtatatttacagagttgtgcatccatcatcacaatcaattttaggacatttttatcaccccagaaataaagcctgcattcgttggccatcaccccccgattcccccaagccctcagccccaggcaaactctagtctactttctttctctatagatctacctattatgaacatgtcatgtaagtgatatcattcaatatatggtcctttgtgactggcttttttcactcagcacaatgttttcaagattcatccatggtgttgtatatatcagtacttcgttcctttttatagctgaataataatatgatacatacatattgcatatacatggacatgtgatatgtccatataatggaatattacccattcatataatgaacatatcacatgtccatattccatatatgacatgtccatataatggaatattatccattcattagttagatatttgggtttttcctattttttggtttggtttggtttttgctattataaataaggctgctttgaacattcatggacatacattttcatttctcttgtgtatttacttaggaatagaattgctgggtcatatgataactcttcttagccttttgaagaattaccatgccattttccaaagtggctgcactattttacatccccagcagcagtgtatgagtgttctaatttctccactttcttaccaacacttcttattatctgtcttttagttattattcatctttttatcagggtgggtattaaatgctgtctcactgtggtttgatttgcacttctctgaaggctaataatgtcaagtatatttttatgtgcctattagtcattcatacatcttctttagagaaatgtctattcagatcctttgcccattttttaatgggggtggctttttgttattgaattgtaatcgttctttatatattaaacttacaccttgtaaaaacgctgggcactagactatacagggattactgtaccacttgtcataaatcatagctatggtcctccttgagaagaattccttactgtagttaacacctgctctaaataagcactctgaagtgcttcttacaaagggtaacgtgggccaggcacggtggctcacacctgtaatcccaccactttgggtggccgaggcgggtggatcatgaggtcaagagttcgagaccagcctggccaacatggtaaaaccaagtctctactaaagataccaaaaaatagccaggcgtggtggcatgagcctgtaatcccagctactcgagaggctgaggcaggagaattgcttgaacctgggaggtggaggttgcagtgagccaagattgggccattgcattctgttaagccattgcactccagcctgggcaacagggcaagactccgtctcaataaataaataaataaataaataaataaataaataaataaataaattgcaatgtgaataatgaaacatcagtgaaaataagtagttttatattattatgtacttttgaagtaaaacgtctccccccaccccccatagcaaagagatataatagccaaaaccaaaaaggaaatacagtgggatgtcattagtaataccttttgtttgtcttaggtgtgagaggattcttgctcttatccgtgtgatacatgttttggctaaagctttgaagtcataagatatgtagtctaggtattgtaattgtgcatttcatatttcaaaaattgtaaaattcaaatgttaagtctttggctacactaaaataattgttgaaatcccttaaaatgtagatggtaaactcatcagttataactttttgttgcactaaaatatgagtttatttctttagttgtagtgaataaaaataaagttaattacaaaagtaaagcaggtaacacaactatttgaatatgcttaacactattgaactgtacctctaaaaatagttaagatggcacattttattatgtgttttataccataattaaaattttcaaaaataaggcagatataaatattttaatgtcaattcttttgagtggactattctaaatgattatttgcttatcagtctaacttaagcacagttaatcacttttacactgctttgagttagatagctgctccctatcctaaattttactttctaagatgagtaatacagatactcaagttaaccaggatgttagtctgtgggtcagtgatcaggtatctccaagtcaagacattcctcagccgcccctgtggttgtcctgtgaggtggttggtggtgagggtgggcctggggggagacaactgcaacaggaggacctctggattacatacccaagttccctctcaggaatgtggatgctaaaagtgaagtgctgataacaaatctcactggtatgaagtagattttacaagctgcttcagtctcaggctatatctcaatttatggggcggcgtcattgctgaaagttctgtgtaggtcttttaccatagtattgaattttacattcattataatgctttttattatgagctctaattccaagttagttatttttaattcagaaagaaagtaaatatttgctttctggaggtaactgcacttgagtatctgcaaggagagcccctcaagttctgtttttggggatcctccccttttgaaaacactaatcggacctcaaaaccagattttatctttgaggactgacttccactgcctttttttttttttttttttttttttttttgatagagtctcactctcacccaggccagagtgcagtggcgtgttctcggctcactgtaacctccgcctcccaggttcaagcaattctcttccccagctgcccaagtagctggaattacaggtgcctaccaccacgcccagttaatttttacatttttagtatagacaggtttcaccatcttggccaggctggtcttgaactcctgaccttgtgatctacccccacctcggcctcccaaagtgctgggattacagatgtgagccaccgcgcccggccctccattgccttttgaccatcaacaaaaaaggccaaagtgaagcttgctggaaaggctttgtaagccaaccattctcagtaattttggggttgtttcattcgtctttatttggacgaggttaaaatcagttgcacatttgtactgagcattttggagtcctgttatttgaattatccattatttcctatataattggagagttagggttaatgttttcttctatctcatgtcttgaattcccagcagaggctacacaaaatttacttctacttcatataccagtttatcatggtacagattattgctcatttttattcttgaatagagctacaggccaagcaacttcttgcattgatattgatgtcttctttcacatatgtaagtaatatatgtagtgattacaagacattccttttgttcattaaagaaaacccccaggagactctttggagtaagctatgggtaacccactgaatactctttaaagaagcaaacctatatcattaagggaaagctaaagatacgtaagttttttgaagttgacatcaaggagggcagcattgcttggctggtgcaactgccaaagacaggacagattattggtctgacgaaggacaatctggaattgtaaagaacgctgatagaatattgcatggacaagtttagataacaagggctggtatttttcactaacacttggtttcctctgtgtgttttgctttttcagatttatcttttctgtgttgaaatccacacaagggacataaaataaccctcaaaaaaatataaacacaatatccaaaccttttggaaatttaaatgttaagtattattcagtaatgtctgcccactgtagttggacaaaaccacattcaggtctatgtgtcagctttgtccctcagccctgtgatttgcttttggtggctcagggccagctctccaagggcaagctccatgaaggcagacagtgcgtctccattttgatgaaggcttgcagtcaaggtcctcagtgtgtgttagagaggcatagagctctgcaagggtaagttcatgtctataacaataattgacctccctagtggaaagacaggattttcccaaggaaaatagtttgcggtgtcatatttgtggtctctctagagagacaattccgtaagtggttcctaagccttggaaaattctcttttacaatagtacccacaaataatgttcaaagagctatttttgaggaaaggattcctcacatttttgcaggtgtaagtcattcctgcctcagtggagtacaaagagtgatgtgagggaagcagagctgctggcaggaattttaaaagtatactatatttgtcccacattaactgtgcttctggggtataaaggtcagggatagaactggtcctgtgggatgtttctcatcgaaaccacctctattccaaagccttggtgtcactagccaagatgtatctattctaataaaatataggtctcatatgacaccacattacaaaatacaaattttcatttgtttttgtttatctagtctattggaaatgtgtggttcttttgtagtttcagttaagagtctaatttggtcatttgcctcttaaaatactcttcaagtcctgtgagtactcaacaaacactcactgttgaccaatttctatttccagccacatactgttcataatgaaacctacttagaggatttgaatgaaataatttaattattttcaatgtacaagaggcaaaattatctgccatgaatttctctggagtaaagcatcctcagtccatccaagtaaatgtttccatttttgatgttcaatcaagaaacattcaaattcaactgtattttttgttaagaagaatatttcctttggcattcaaaatgatcccaaacattgcttggaagagagaagtggggagagagaccacatgtattaaagcacatttaaccaattttactttggcacattttgttttgccattccacctatcagtcttctcacaaccgaagagcacttataaacattaagatagaattttaatctttcatggaaggagctttttgtcagcattggaaaaagggagatttgggtcaaattttgactgaagggccatttccttagcaaacatccagactccagggatccattttgttttatttttgccattgaaaactgtttttgagaaaaggcaaaagtcaaaattattaggctttaaaagacagcagtttcttttatcacaatttgccacactaacttcgtggcttcttgtttgtttgtttgtttattgtttttaatttattccaatatttattgggaggagactaaaatcagctgtaagtgtatggtgaacattttggagttagggttaatgtgtaagccattctgcatttctttcatcactgagatttttatttaattaacgcattaattatcatgaagcttactatttggtgtctgcttatctctttttttgaggaccaagcatataaatatgcgaggaatagtgttttattattctaaataccttgccattattaagagtttttttatgattatactgtctcaatgttgaaagaaaaatttttaaagatttgcatttcaatttttttacctataggcaagactgtaccactctgggcaacaaacttaagtttcagaaatttaacttaggaacttttcaaggaaatttgagatttgtgtcaagaaacctttttattaacgattaatgtaaaatttggaatacggttcttaagttaatgtgaacctgcaaaatctaccatttttgcctccataataagtcagaccttgtacaacttaaaaatgcattctgtcccacgtttcatgctgtcccttcctcagaatagtctgggagttcagcttttataacctttggttgcccttggaaggtatttatggcttggatgggctttgttcataatcactgtgttcttgtaggataacccccctggccttcttgtgacactgagctactgataacaacttctcacgtgtacagataatccaaatccacattcaaaaagtgcagcgtcatcaagacagacttgaaaaggcttttttaggcatcaacaggtcattaaagatagcacatctcaccatttttcccttcaactacatacattgtgaagacttaatgggggaaggtgtaagattttgatctctcatgatcctgtgttaatggcctgtggttcaagggttactaagattgcaatagaagaaaaaaaatataaaagcaaaaaaatttcccaagaaactaccacaaatacatacttttatactgcacataatgaacattcccgactgtacagtgctataattatagtccttatgtatgtttaattgtaaaagtcacacatctaccctacttgaatgaatgtatctgattgactcattggtaaaagattatttatcttgacgaggcctggtggctcatgcctgtaatcccagtactttgggaggccaaggtgggtggatcacctgagattgggagttcgagaccagctggaccaacatggagaaaccccatctctactaaaaaaaaaatacaaaattagccaggtttggtggcccatgcttgtaatcccagctactccagaggctgaggcaggagaatcacttgaacctgggaggtggaggttgcagtgaactgagattgtgccattgcactccagcctgggcaacaaaagcaaaactccatctcaaaaaaaaaaaaaaaaaaagattctctatctctattccgtatctctatccacacacacaaaaagggacaattggcataaattcctatttttaggcttcccaaagaaaaacacaatcctatgttctgttggctgacaagactaagattaaaaagtgacataaagcgtaggactgcagcctttctatagtttattatttgtctcctgaaaaggaagatatttgtatttcttttaggaacttcactccaacagatttattctaaaacaattcctgactgtgttgaaataatgaggtacagttcactttgagaaaataccctaaagaaaagtcctgatcaatgattctcaaaatttttccggtctcaatatacttatgggataaaaagtcattcttctcagtaattaatagtagctaatataaccctttgcttttgtgtttattgttggtgtagagagagcagaaggagctatgttaatttgtatggcttttaaaaactaaagattattctgatatcccaatattcatttcccccagtcctcaacccttgagtgagatgggccttccccattgaaaatcactgtgtgagttttccaaaaacaattaattataatacgttccatcatggattactttagtgcacttaaaatttgactcaaaattttacaagcattgattttactttcagaaatacgtttgtgggcagatgtgaaattttcctatgggaatatcagtctaccttactgttttggggacatccaagtcttagtgtagaggcgggtggggaaactagattaaatgttgagtgaacttgtctactgtttctaccttgacctctaactctcaggtgagggtggaagtcctctctcctgaatacaggatagggattgtctatagtctgagggaaaggctgctttccactggggtcatttatccatctgtaaaagaggatttttctccccttaaatataatcataatacccattatcacttgttaaaacataaataataatcctttaataatgccattagtcagttttcaaaaatccccatttcttttctttctcttttcacagtttgtttgaatcaagccatattcatacattgaatttgtttgacagagtctctgaatctgttaagtttgaaggctagctctcacattctctatcaccagctttatctctgtcttcctttcccacccttcttatttgtaatttgtttgttaaagagatcaggttgtcaggtaaaattagtcttccacaatctggattttgatgattatgtcaccatggtattgtttaacatctttctctttcccccaaaccattggttttcagtcatgagagatagatataagcattaaaactctatagctgaaatggccttgaagatcctttgtaacccatagcttttaaaagctggtacaagtcaattggccaaaggatattgagttaggcagggccagcctttggcaatgcaattgctgcttcctcagactcaacaaaaattatttgttttctttgaaaatgggaaaaagctacaggataagtcataaggcataagcataactagaattgtctgcaaaataagcttatacacatggtaaaggcctcatgattctaagcctgtgtcccaggttccctttcaagttaccaagatttgcagagttacttcattattatgaagatggtgagtgcatgcagaacaaatgtattcctggtaaaagaacattaacatgatggggaatgcagctattctagatgtgatatataagagtagggaaactaagttttttttaaaaaaaaaaaaaaaaaaaaaaggaaatatagaaactaggggctaaactagtaacttggcccctccttgggttccttccccacaccaggcttgctgactcttcctccctaactccactgccctctactatggccaccatctgcaccctagtctgggcaacaccatattgatcctaatctacactaacttcctttctagtctccctgccatccgcctaccccacaatccagggtcttgctcttttcttacctactttttttgcacaaaggtagcatgttcttcctaaaactcaactctgggctcattccccacattgcttttggaataaagatcaaacttctcacatggctccagcttgtgcctttctgtcttatttctcactcctcctccccaccctcccacccccagcccaaccccactcccaccctagtgtctgcctggactcttttccccagcttcttcacctgaaacccctccttaccctcaggtcttaccttgcatgtcactttctccaggaaacatctcctacacacacagtacagttaggcagccccattgccagcctccacctcctccagccaactgtgtcatgaaaacagggaccattttgttcagctctccatccctggggacagacagaaatcatctttcgagattccagagagtcttaagttattttataaagtgttgtgaaagtctccactttcatgttaaaaagtactatatgctgcataacatttttcagaaagggttattatggaagggccgagggtcaaagttccaaggtcctgaaagtattacactgcttccctgagcagtgtcagaccagaaaaaccaacaccggactcttgactcagggaaatattgcaccctactgccaatttatgtggttggcttttttatctttttaaacaggcaaagagagctttgccatgcttttcctggaaagattcactgattcaatccttcagctaatatttggtggaatgcctactaaagccatggcatgcaattctgccgtaggacatgaagtcgtgtgtgcctgctgttgaaagcagtgagtgttacatgagagttttctgattgccagctagtttgcttccctgacaggcatttccagatgtgaggaaagatttattttggcactcccagctccaagtggcgtgagcgcacacacacatacacacacacacacacacacaacattcactctccttcagtgcttaggatcatcatcctctgccttcaaagttggtaaattgagtttgcgctacagcagaatagctggctgttggtaactttcaaggggagaaagggcatctctccctcccctgcagctgagtacaacagcttaaaaatagaacaatgtgtgtttggtgtgttcttttcatcctctgcatcaataacaggtgtacagttacagacacaaagagctagattcacgtcttctgaagcctccagagaattcccagagttacccatggagcaagaactgggcctaaaatatttagtaaaaagaaagtaacccaatatatctatgtattactaacactgctgtctcacatggctttattcttctcctcccatagtgatccccagatgtaaatgcacagcggaagaaaattttaccaagaacaattcttagcgacattacatacccacactttccccaaaacaaaataaagttaatacctctaaaaattgaactacagaaattggcgtgactgctgtgaatagcaaacttggaaatgctttgggtgagggtacaatactgaacattcaaatgcttccactggataatgcaggtctagcttcataaacccagtgtgagaagtcagattgatttgctagtttgctttttatgcattttctaagatgtttcttcttgttttatgacctcttagaagcactgacctcatatttgccttgagattgaatgctttgcccatcttgctgcacatctgtgatcattaatggtattacttaatgaataagttagcatgtaaatttgcaatgtggaaactgcatcccctgccatcacacttctcagcagctgcttacaattctttcacgttccctccccaaggaaatggttcataacagaattgaacagatgctaggtgtttggcagcattgtgagcgacactggttttcaaaatttaggttatttcatgtcagataattacaatttcaacagcttttaggcctttaatgtgtggcggtgttcacataaatacttaacctctgactccacatttacccctcccaagttcccctaacttatttattggttctgacaacaccactactaaattcttggctctcaaagtcgaatctggtaaacacgcatgggcagatctgacttggcactaaaattgctccttctttctagatgagcttttacagttgttcctgacagcagtcaagtgttgccagaactccaatgtatagtttagtagagtttcccaagtgcctctctcctgggcccctcgcttctgacacacacagatctcttctttctcaacctgatgcactgttctgtctcatggaatgctgtgatgccctggacttgtgagctttgagagcaaacactaggtctttctagagctcctgagagtggcatacaataagtgctcaataaatgcatcccacatgagctgaggataattagctaaaaataaggaaaatattgatgcttttgtttgtttgttttgtttttgagagagcctcgctctgtcgcccagactggagtgcagtggtgcgatcttggctcactgcaaccttcgcctcctgagttcaagtgattctcctgcctcagcctcctgagtagttgggattacaggcatgtgccaccacatccagctaatttttgtatttttcgtagagacagggttttgccatgttggtcaggctggtctcgaactcctgacctcgtgatccaccctcctcagcctccaaaagtgctgggattacaggtgtgagccaccacgcccagcctaatgttttcttcctaatcagctttaatgtcagaagactcaaaatccacatctgaggggttcttacacccctccaggggctgttaggaaacacagtgaaaatggtttgggcatacagaaaacactctgtgagtgggatgagccaatggaaatgttctcgtgctgcagaacactcagtggtagatgaagggtggtttgtgtatcttaatgactgagtccctgctcatcgatatcccaatcacttgacttcttaacacagtttatctccctacttgaaatgttttacctttccccccattcgaaagttattccacacacattcatgaagcattttacaaatgctgcagcctccctaagactggatgctgataacacttctaaaggggcacagactccataagactgtggatgccgatacacttctcaagaggcaccatttcctttcccctagcaagccttgtatagctctgtcccctcactggatacacagaaaacagtcttgaccgagcatctgccatatgtcttcatgctaccttcccttccttgtccccattgcatgtgtgctctgcgtcatgcagggctgctattgtctagctgaggttgttaattcattcagtattgaggccctccagttagctgtgctaggtgcctaagaaggaagtcacagcactgttaaccatagactccaggtcctacatctccttcctctgcagagtgaggagatgtttgcatctgaaaaggtaaacaggggccagctgagtggtgcaggggacattcgctctggctgcatttatttgtagtaattcctgtttggttcttaagaacacaaacttctggagctaccagttgcagcattgactagctgtgggagaagtcactttggcattcagggcttgtttatggagtggaaataatagtagtgacagtaataaacatgtttgttgtatgtgcctcctgggggacctggaggtgagctcacggggaatcatggctgtgagtgtggtctatgtgaatctataggcattggctaatgtcagtgactactacactctgagattctgctttaatattataaacaccaacttcaaaagcccttttggcttctttgccggagagtatcaggtgtaaggtctctctttgcacttgcatctagtgtctgcctagagaggatcatttcctcagcctcggcttggtcaaatgatggcattctcactggctgtgccctggctttgtcactaattgttaggcagtttcagagatcgtgttgcatgttacttcaccccgtttctgctgactggctgcctcctgagtgctgcttactgcagttcatagatgtttctgaaaactgcttatgggtgaccctgagtaaacaattaaaagtcactgtattttctatgttagaattaaaaaatctaccttgccaagaaagcttgtgaccttgtaaagattgggaaaactccacttgtcataaacttaaccagtttccaactcatgcactaaagcaaagctttaagccactttgccttatcaaaaggccatgaaactttcattctgtcctagcctcaccactaactagtggtgtcattttatacatcatcaagccttttgggttccttgacctcactcaccagacctggagggccccggccagttttaggcatttaattttgactttttgatgacagaatggtttccaagggtgtttgagattccctgtggaattatgttcactacaatcaagtttccattgcattaagatgagtgcaagttagaggaaacacatcacagggtttacttagcctggaacagagctggacgcatgattgctcctcagtaatcagataaataagatgtgatttacatcagaagctgtaaatgactgagaacattggtgttgcagtaaagattatacttattctaccttaaagtactaaaatcctaatcttgattaaaggttaattctataattggtcagtgactttttaattttacctgccataataattgctagcaactactgggtaaaaaaaatatgctggttattaaacatatgtacttgttattccttctgaaaggtcattgttattattcccattttatagatcaagaaactaggtctcagagaggttgcataatgtctcagggtctccctgctagcaaggggctgagcttgaattcaaactcaaatctacgtgtcactaaagccccctctctctagagccatgtaacccctgatgtggtatgtggcctctagattagtactggatcagtttataattttaaagtgcatttgttcccttaagtcttttctccacatgagctaaatatttttcataatttttctgtactcgtgtacttagccctttacatcatgtgtggttgaacattctattatttggtgagactatgactgtctaattggtcagtgagaatctgacttgtctagcaacaaaagaactccttgagaagaggagcgactatttgtacatttgcattgcagccctggttgcagtgatgaactcttgctatagtatgttacaaaattatgtcattgatttgtagattgagtatagttgcttaattattctcacctgctgaatttgcagaatttgtcattcatcattcattcaacaaagctatactgagttcctgcagtgttagtcactgggcatatagtaatcaatgtaaaccatcgtgtattactatacttgaagggctgtgacctggaaaatcactgatatgttattccagaatgaataaaagtgaagttgaacttaaggcatatactttaaaagaatggactttttaataatcattgtagcacaaccagaaatttttgctaatgaattatccaattaacttttctgaagcctaaaataattatgctgttatttcttttgcatatgaataacttctgtttgtattgatccttgatgcatttacatctctgcccaaatgatatgacattcctatctagaggggaaggatatttattagcttatacttctctagattgatactactgattcttttaggaaaacagtaattcctgaagttacaaagtcaggctaacagtattcccacaaaacatcttgtaatagcttcatgtgctatagggaatttttttgtttaaaaagtgctccctttctataatcactttttggttgtggaattcctgaaacaatttgttttggttattctgaaaaattctgaatcttccctaatacctttagtaataaaataggacctgataaaaatcacgaagtgtctttgaatctggctgaatatctagacttaatgagtgtttaaggctccatgtcaacctgcaaagatacctggtgaagcacccttatgtacttttctaaaaaaaccctgccctgttccatactttaatcaacgactcaacaacatagaagtcatctacatagtgttttcatacgacataagcccaaaaaggatggcttccactgcatatgcctgtgatcatgattcataatgatttcaataggctgcaatgctggatggaaaccaacatgatgaagttgagcaaggaataagtgtacatttctgcttttagattcaaaaggcaattgcgcaattacaggatggggaacaactgagcttggcagcagttcatgtgactaaaggcttaatgtgaaccaacagtaggaagtggtggctaaaaaagaatgaatgtagccgtgtgcttcctcagtagaaatattaatagtcactgtactctgcgctgaccgcactgcattgggaataatttgtttggttctgagcacattcaggagaggctttgacaaagcagagtagctactaagagggtgttgaatccaatccaagacacatttattagactcctgttttgggcaggcaatgtgctaaccagggcaggcaataaagacacaaagagactttgccagtctctaggctcaaggagttgaaaatttaaatagagagtcagacaggtacacgcatgactataaaacaaagcgccccacgaaaccaagaagcacaaagaaagggttgtgggaattcaggggctgggctagtggtcagatttccacaggaaatgaggacgagagcagaagaagccttaagagcaaagagacagagacaggaaaacccaaggcatgtctagggaatgctgagaagtctgggttgcctggcagaatagggtaggcctgcgtaggaaatgaagctgaaaaaagaaggtttgggccagagcgtgaggacattgactggtaggcagtgggaggcattacaggttggtgagcatctgaaaaaaaataatgatatatgaggatctgttggagaaatgatgcatattgagtctatagaaaagaagaccgaagtcccctggtaaacgtatctcagacttgctttgggttcctccagaagcaaaaatttatctcaaagggaaagggttaaaaggaatgagattttagatttctaagcagttttttttgtttgtttgtttaatcaaagctgcccatggtgaagacttaccttagaagattgtgagcaccattgtggtgggactcagagaaagtttggtaactgacactctaaacagagttgggggagaaatgctgcagcttcaccaagtggcctgggcattctagggattacccatggcctttgcaatgtgtaattatccatggttgaggtttttttctttcttctttgacttaagacatccattagtatgtcattttctgaataaagccactatgttatgactctccagttcaacgagagatgtcaaactaactccagtgcaggtcccagggctgtgacagtagccactcaccatgactgtggcactttacaacttacccattttttttttttactgtgatatatggcttcctttcaaacatgactttaagcagattactatcacaattccacattggatagatcaaatgcacatcaatgattgataccagtctagtgtgaagaagaatttattttacagaaaatctccaagacagtaggcataatgatcaaacagtgggcactggagttggagagacttcagatgccagcaatgccacttattagctgtgtgatcctgagtgagggacttaacctccctgtttcctaatccataaatgcagagtgaccattgttagcctccaccttgaagggttgttaggaggataaaggaggtgaagcactcagcacagtgcctggcagtaggctctaatttgactgagttcttatggtttacaatggtgttccaaggagcccttcagagctaaaaatccttttttaaaagcaaaaataaaaacatcactgtcatcatgccacatattattaaggcatcacgtatgttaatttattgaattctcaaaaacatccatttgccaagagagtgagggattacataccttgaccagtcacaagctgataaatggggggagccaggattcaagccaagcagccctggagttcatgttgatgacaaccatttccttccagttcgtaccaacacgtttctgttttcctccaattccattccaaatcaccccgctagataatttgatgtgttttatttgtttaggccagtttcacaatatttttttaagtcctgttgactgtaataaatacatcaaaggcttaatgtttatgtcctttgccagagtatcaagaaggtccttaataaatgttgaaagagtgcacgaataagtgaaaaattttaattgtaggagtaatttatagtcacttttagaagaagcatgttatcctgaatgtaacttcactaccttaccaattcattccattatttgtgatgagccatagtcctttgaatccttcatttaaaaatcattgttttgtacctggcttctctttaccttatgtatagttcttctattccatacttctctttaacaacaatgtccccagttctatcactcgctgtctttttaaatcatttagtgtgactatattttactcaaatatatccatctaccaattgtgtttgttccaaaccctggtgactgtatcttcatcactcactctattcctaaattccagattaaagaattattttaccaacccgtctcatgcaactcaagtcaaccaaatgttacttccacatcctttctctatacgccttcctagacccctgaaatctattcaggataagtgaagtttgctataagggactgtccacaattttcttgtataatttttgggattcctaaatactccttgaaaaaaaacattggaatatgaagctgagaagaaactatgcacgtaagtattacaaaactaaagtagaatgtgcagaaacaactccctcctagagaaggaagaaagctacaaaagtgttatgccactacttgtggaatatatcagcaattattcaattccattgctgcccttggacctgggggcaaaaatgtagcttttcctgttccaagggaagaatgttctgttacaatggtaaccagaaacagggaagccgaccaattctagagtttactccgacagtgttttcactctatgcagtaacactgctttattgtttggctctggtagctgagagaacaatctcccactccctaggtgagactattcttttataggaactattcttttagataaaacaaccaatgagcttttaaatgctgagaaaactaatcagaactgaaagggggtgccgttggccacagctcaagaaatatgctgactaagataaaagccccttctgaatttttctccatcccatcttcctttgctttctcatctcccttccttttctctacgttttctcttttctctttctcctcttgtcattctctcagctctatctccacaatcttccctttctcctctcctcagccccagctctatcaccaaagatttcattttgcacactctttttactggccaaagtgtggacctgaattttttaaatgtattttcttatatagtagataagattcacatctctggatttaatttaaaaaatagacaaagtggtggctcatgcctgtaatctcagcactttgggaggtccaggcgggcggatcacctgaggtcaggagtgcgagaccagacaggccaacgtggcgaaaccccgtctctactaaaaatacaaaaattagccaagcgtggtggtgggcacctgtaatcccagctacttgggaggctgaggcaggagaatcacttgaacctgggaggcagaggttgcagtaagctgagatcatgccactgcactccagcctgggcaacagagcgagactccatctcaaagaaaaagaaaagaaaagaaacaaggtgaacatgttttattcactagttgcttttttttctttaaagaaatacatctgtttgaaaaatcttaatttcagtttcaagcaacaaacaacttcagtccatttcagagtgctaacgttggaatctggttccagaatctttgcagagtgtgggtgggcacaggtgcatgtggctcctttggccataagaatctgctgcttcccagcctcatgactgggcctggagtcacactcctgcttcagctgttctttggcaaagcagggccagaatgaactggtctttaacattcatatattgctttcaacttctatgaggctttcatttcaattccttttcttctgtgagggacaggccttccttgggaagaaaggtcaccccttgagtctgacatgctctgcagtcagtttgagaagccttttggttaattttggacaagtcaagcctggtggtggaattcggtcccatttagcattctgccagctaggaagcgtgctatctcgatcatcttcccaagacagtcatgcgggaaggtcttttcgctaacaagaaacacaatccaaagtaaagacagcttttgtggaaattgcaaactactcatccagtggtcagttgtaaatcatgattcttttggaaagaaagggagacaggctggggctctggccctcaaagaacttcctctcattaaaccaaagcaatttgctgctctccccaggctctttctgtgcgtaaattcacctacttttcccgccaccatcagtggtcctggtgctgctggtgaatgggcatcatggggagacagggctttccacgtgatagaggtttctttccaaacccaggctttacaggtagatccaagggtggctttcgtcagcctgttgcccccactgcccaacacacactttgctttttgctgctattttctgcggtcctgggtttctaaatcttggcaagaggacagtcattcctttgtgctcggctgttacaatgaggtagccagagaaagggtcttggtctgaggctgtcagctgttactaatcacgactccccggcccatggtgggtcccgctcgcctctccctcttgctctgcttagcacacataaagaagatgaattactctctggttcctcttcaaaaaagcatattgtgcggcacattccaatacagtgagcgaaggatgggctcatgtgaagggtaaatgggtatccaaatcacctcgcagcggggctcgcgccggcagctgtgggcctctgagaagtgaatttcggagctgccccttctgagagtttccggcgacctcgctgagagtgagaggaagtccctgcggtgggccctctggcaaaccacatactgggaagatcgcgggactgtgttaagctgtcatgagagtcaattgaatggtcaagaccagcgtagacagaaataaagcttgaccactcagaggccgccatgggctgcttacccgggagaggcagtctccaccccaaaggttaagccaaagggcgctagaagttctttgatgttagaagtagcagtggtggaagttgtgcctcagtttcctctcattgcttccgaattaaagttcatcctcaaaggacgactgtagccagagaaaagggattgtctgcttagtcctatcagaccgaggatacagtgatttagttgactttttctgccactaataatactgtcttcgccactgatttttttctacttaacaatctttcaaaagagaatgtttctcttttgcttttctacacttcattttcttttcttgtttgtttgtttttgtttttagagacggagtctcgctctgtcccccaggctggagtgcagtagcgtgatctctgctccctgcaacctccgcttcccaggttcgagcaattctcctgcctcagcctctcgggtagctgggattacaggcatgctccaccacgcccggcatttttttttttttttttttttttttgtattttttgtatttttagtagagacggggtccccatgttggccaggctggtcccgaactcctgacctcaggtgatccacctgcctcagcctcccaaagtactgggattataggcgtgagccaccgcgcccggccctgcacttagttttcttaaggaacactagagcttgaagaaaaagacgtgttgacaagttttaagggtcaaatttaaaaatcagtttccctgataaagtatgtgccatcacacgtggcaaatctgtaaggaacacttggtgttttcatgtaatgtaatcttataaggctaagctgtgttataggctaataaaatgtcatttgtgatattataaacagccataatgagaaggaacctttgaccagggtgaaaacccgtgtgaaaatgcttgtgactgtgaattctgcaaaatcgttctccgctcttcatggagatggtttcattctcttcaccaagaatcactgataaaagtaaattgccttctttgctcaaaattccgtgaagtgaacctttctaaaatgtattcccttgttacaatgtccataaaatttctgttcaagtgaaatgacccaatacccaaggtcactatcctcattctgtggtctccactagtgagatgaagcaagttcttgggtatggtggacagcccaagatcataggaaacaaagatggtaggaagggaagacaataaatagttcatggttcctttttgttgctgttgttgttgtttttagacagagtttcgctcttttttgcccaggctggagtgcaatggcatgatctcagctcactgcaacctctgcctcccaggttcgagggattctcctgcctcagcctcccaactagctgggattacaggcgtgcaccaccacacctagctaattttgtatttttagtagagacagggtttcactatgttggccaggctggtctcgaactcctgacctccagtgatccaccctcctcggcctcccaaagtgctggaattacaggtttgagccaccatgcccggcccatggctcctttttaaagcctctactattaaccaaatgggggtttatgccagtgtttacaaacatttttttttttaccagaaactacaataataaatatattttgtattgcaacctggcactcacacacatacacacagagagctgaaaaaaaattctcacaaaacaatacttacctttaccacatgtgacacactgtgatattttctattcactttgattaattgatgaaaatactagttatgacctactaaattgacttcatgaaggcacacatttagaccacaggcctctctttcattcccttctctgcatttctattttaatttactcattcattcacctgttaacatatggacagatagagctatagcagttacttctataggctcatctgcaagagggaaatatgttagcaaaacagggaaaataatacaggtgtgccagagagaaggcaaaggaagggaaagcaatagggtgcccattccatggtggtgagtaataagtggaagttttccagcctcctggccttcctgagcagcttagggccaccttgccgggaactcattcccagctctggaaatgaaactccgggtgccgctgggtttgcattgacactctttccccacaaggtttgtctcttgttgttccagacagaatgaacctcattattttggattaattgggggaagatcaaccaaaattagtgagtcagaattaaagagtgttttaaacaaaagcaactttagaatttgtaattcatatagtaacccaatctaagtgttagaaaaaaaaaaaaagcatgtggcctctatccagcatagcaacaaaaacactaataagaatggctggttattcaaaaaaatgattattgagcccctctatgtgcagacactatgctaggcactgaggccactgcaatgaataaaacagatggtcccgctctcttggcactaaaattctggtagcaggagacacagaatgaacaaaactgtcctttatcaaggacctactttgtaccctgtaaatatgttttctctaatcttgcaatgtagatattgttagtgtattttctacatcagaagtaaggcttagaggtgaaataatgctttgtgaacagcttgtttattatgtacctgtttaataagtaataataacacctaacatttgttgaatgcttaccacgtgctgaacactactttaagtgctttctatatggaagcccctttaatgccagtgaaaaccctatgagggagcttctatttttcacattccacagaggaggaaactgaggcttggagaagccacatggtaccagagccaaaagtagaatccaggtattctaacgtcagagtctgaactcttaaccactgtgccactgtctcttagattacattccgaggctatcactggcttactaactgtgatgcaaaattgtgacataatcattctttaccaacaatttggaatctaacttttaatgatttgtcttcggttccagaacccttagaatcatagcactttgcagtgtttttataagctagtctataaaggggccagaagaaaatatttttgcacagaaaaacaatatagttctagagagagatttgaagtgactttctttgtgctccctccccacccctcactgcctttcctgggtgagttttttcaccctcctcctcactctcttcctaggatggcagtgtaccctggactcagcagtgggcagctgcctaggacacacggccccatttttcaatctgtaattatgaagtatattgtatttttagagtttgattttcttattaaaaaaacttatattcacatgaatatggtacatattagcactcatccttgctttccttgtaagtttgcccatcttgaaattctaggagggttgagaacaggcgtctttcattagatgcgtgtatgagaaactcattgtggagaaggggtacatctaaaataaaataaaaactgaaacagaacaatcttcttgaatcagcagttgccatcactcttttctttccttctggacctgttccagtggccctggaagaacaatgaaacatcatggggataagtgggaagacaattcaaaacagaagactacttctctagattttgtgtttcaaaaccagagatgggaattgttgaggggagtacactgatacatgttaatgtccaagtcacagattttcagcagacaggagaataaaatccatgccaatgatggaaacttgggaacttggcacattttatgttgtcctttaatacttgactgaatgtatattttatttatccaagaagtcatattaattattataccataagagatctaatttaccatatagacttacagagtaccacatacacatttccaaaacattccctctctgccccctaaaatcccatgaatttggtgcatatttgttgtgacaaatcaattgccaaaagactgtctttataattacctatttgctcaagaaactcccttcctttcctctctcttccatgtgattactgcctaaaatactcaggtgtttgaagcaaagttttaatcttttactttctagaaagcatcttattcagtctccttctgatgcttaactcattgttgaacagaaataggtttggagaaatgattgcttgcttgataagtggttatttatgggtagacttgtagaaaagaaaataagactcaagtgctcacagcagccagcaaatatccacggctctccaccctccattaaacatgctctgggctgtttttctaggaatggtgaagaatttgcactgatattatcagctctctagctagtccttctggtgaccagtgttaatcagcttgatcttaaagtaggtttagggaatactgagtaatgggacagagatttttcacaattatattcctccacagaattatcttcaagccaagtggctcatcttagcaattaactcaaatgcaagaaagttagagaaagtcagcatggataacaagcaaatgaaacatgggtgactcctggcttgtccataaaaagagacgtatagcagtaagaatactctcttggaaatgtgggttcaaatcctgccactgtcatttattagctgtgcaatgccgggcaagttatttaacttctctggtctcttgtttcttcacctataatatagtatcaacaatatctgcattatacaattgtcatggaattaaatgaccattaccatcaatcaaagataggacttagcgagtgagtctttggaccacataaaagttaactcaaaatgtacaaaacacacacacaaatgtgtcattgtaagtgaaagagccatcatggtacttataacaatagtacaatacagtatttctttggatttcaggggggtcttgattctgaaggcaggttgttttcataataaagatgtcatgatgtcttgaattgggctagtttagctaagcccagatcaaatgaagaaaaagaaactagtcaagatcattatctttaccacttgctctggaatgtgtttctcaaatatgtatttagatgaatgcatggctgtcgtaacacactcccacaattacctacataccaaagtaacttcccgtctccccatcaccccagtgcccttttctcccatatattttaaagtgataaggctcaatgtaaacttcctccttcccaaacgtttagggcagttcctgccaaagtgccccattctacaaagtgatttagtactttaaccttgctccagacactctgacatctctgtttagtctctggtgtaaaaaggttcgtctctcatatttcttgaggttggggaaaggaaatggtcacagagtttaggtgagcgtgggaaagtgatgccctgctcatttggggttttgtcttccagagttcttcctccattttcctgatgccaccagtattaaggccattgtgtgtgaacagattgcacacatctgtcctgctgttgccctgatgacagtgtactgccttgttcctggtggtctcatttgttttacaagctagggtacctggaacagaggtggtcaagtaactctgtgtgggacttcgatcctcctttaagggaaggacctacatggagatgtgattaatgaatatacctcccttacctttcttggctgaaagaatagcagctgttactttattctctttcaaaggataagggccaatatgcagaggtgagtgaggcctctcatttgatgattgaatctccttctgtgctttttgggaaaaaatgccttgatggttgtcttcagctatttagaattagaaagtatgaagaaaatgttttcatattggtttttactttaaacattttttaaaaacctatgaactttattttctagagtcgacagccctgtagccgtgggtattgggataactttccctatccctctccctatggtgtgagaagggacattaaacctcatcctttgtttgccactttggtttccagtgctctgccttgaccacttagcactctctccgaatagctgtaggtcgagaatagtgggcaggagcatcagagaagagttggcgtgagaacggaacagcaccacaaaatagaaggcgagagggaaaaaagcatctcggaggaagaaaatactgccgcctggtactccctggtacccagagatatccggcgtattgtgcttacactactcgccggttccacagggagagagccggaagaattgcaggctttggtggtgacaagttcaggcactcatgggaaagagagtgggcccctttctgagagaaatcattttgagcacagccaagccaagatattttgagatgtgattcagacctgagaatgaaactgcggggggatgggatacttcggttgggaacagattagcccatttttaacatagttgaaatgttgaagtggtgccatcctaacaaatgaatacttagccccgggtttcgagaaagtggccaaggataaaagaggctaagtgcatggcatcaaagccaaagctggcctccttatctgtgggagctgcagttggttttctcagaggcagaaagtacactgaacctagttacataagacccgagttcaagttcccactccattccacttggtgttaagtcctttaaactgttacttaactgctttataatctgcattataggttgttaaaaataagaacatatgaaatactaagggcttataatgaaaattataagtgatacgattcaaatacgaatgaaattataaattgaaggtcatggcttcaatttccacttaagctaattacctttgtattaagatttttgagcaaacccaaccagttatctggcaatcgtagacaccattttaatcagtactttaccttctaaatatgcaaatatttagagttcacacaaactctaaatatgttcatgtgaacagggccactacctgaatattaaaccaccattagaatctgatactcgtcattgaaatacagcataaccttttaatacatttgtggaaacaccattttaaattgttaaaaaaaaaaaaaactcaattaactgtaattggattacactataattggattttagtgggattggggaggataaagaatgaagaaaagtgaagatacagctaataaaacagaagagctcatattaatatagataatttaatcttttgagagttttttgtcttttccaatagtttttcagcccaaaaagcatggaactgtgttccattagctacagcctttaggaaaaccttaaaagtcatgcctccttttttctctaggatgacaccttgcctgaggcagactttgaagatgttctgaaaatgagggaaagagggatatttagcatgagatgaggcatctcagacctgtgggacaaagtagaggaagacagggtacaagaatgagaactgtgccatgataatttttaaaaattctttgattggatgagatgaaataatagcagagaaactatttgagaaccttataagccaatgtctactttaaatgcaaattgaagatagatcaccaggtgatcagaataatagcttaaattgtacattaaaacatcaaaaaagaatcccaaatacatatataaaataattcttttgaaagaatttaatggcagttaatctgtgtgtgaatcaccagagtgcttgaacttgaggtaaacttagattatcctgccagaaaaatgttttaagtatttatttacacacacatgcacacaggcacactcacacacgcactactcacactcatagcttccccaactaacagtaacctaggaaacaatctgattgcacttttggaccattagagaacagtattgatttggccatgtgaaatcaactcttggggcagaaaatgagtgactgcatgttcactgacactgctgatgcctcaccattctagcctcggccttttcccttcaccttgtgagatttggggccaggttctcacaacatgtacgaaatcccatggctgggtgggataagggtaggggagtataaaggaaatgctgttcccattgttttccactggagaattccctggactgacttcctgaaaatcttctgtttgcctccaccaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggtatgtccttgcaagcccgtcctttggggtgtattttcgccatccagaccctcttactggttactattcaaaccctggaaggggtgtgtgactgaaccagccttgccaggcttgaaatgaaggtcatatatctttacctctttcttatagaaattgaagaaaggatccattttctgatcttgtatgagagaggcgaaaagagcaaggagaggatatggattttgagagccttgcttttcggattcagaatctggtcactgacctctctcaactatgcagctcaccttggaattttaataattcttaacctatttttcttaactgctgttctttaaggctaatttttattcaagtatgccctattctttggacccttctgattttgaacttgtgatcagtatcattgcccactatgcacaacgcattatacacagtttggttccagagggactttagagatcatcttgtcaaacctgtcccaaggttttcctttcataatgtttatggagaaagaatttggcaggtctgtaataaaagaataaaggatggcttctttagcattgttttacatacaaaccatacgttgattacaaatgagttttatctactacttgaagcagacttggtaatagagtcagccttatgtagaactgtgaagtaagccaaaatccaatcccagcaccttcctgcttcctctcccctacacacctgcccttgctcagtcaggtcctggcaggaagcataccacatactctaaaggaaccttgaagaaggtttgccaaggtgcgggcagccttaaaggaacctacaaacgatggtaaggcctcaaagccctaacagtaagaaactattttgttaacacccttagctatgaaggagcaaagggaacccagaaagagctatagccttgggagggaagggcctcaggagccctaaatggaggaagggagctgccacaaaatctgtcaaagagagctctgggagaatatagactccctctgccctgtgatctgtcagtgcatgtcactagacaaacctaataggagtaggaagccagagggcaagagaacccatgtgttgtggtccatagaggcctggatcccagggcatagacagagtggagagtgaatctagaatgacaaaggaaagatatctcagcataggctctagatgccccatctgctcagcattcccccactgtttagtccctcccagcctgtcttcccaaagactagctctttcctcccagcttttcagctaacttacctgcagagtgattgggctgccaattatagatacctgtctaaagggcccattccccattgatcttctgaaggaaattcctctatgccatctcaaggaatggggctgtggcaggtaaagccaagagagatttggggagcagagggtaccttcagcagcacctctcaattcccaccatgggtgactttgcaccatctctatgtatgtaaacactacccaaggggcctcttcttgaaagtcctttttcagggagttaatcacaatgatctgcaggtatcaagccaccctataacattatttcataccaagttgacattcaatagctatgtttttatttagttcatacaattaattaaggcttttcaccatttctgcatgaactttaccctcagatagtttagattagaagtattttattatattacattttctttccctgtaatttttattccttgtttgaagaattggaatcttgtcatccccagtctggttgatccatcagaagactgtgtttctgccctgccttgctgcagtgaaaaatgtatcctgcctacaaccaatcacttggtttgaacatttatcctggaatctcctgaatgcatatttctatcaaggttgatagcaacaacctcatagagcatagataggaaggaaaagaaaacaggatgatctagtaggaagaaagggacaagcatttataatactaaaatataactttgataacgtgcaactgctggattcttgagcctgtgataactgctggatcatttctccttctcccatagtctttcatcttggagctctaatgatagtttaatccaatctcctctttaagagatgagtcaaatgagacataaatgggtgccatgacttggccagtgtcacacagctgatgacagacttcccagccagagtgttgtccctcactctaccccctacaaacacaaacagtgctttgacaaagtctctgaagaagtaacaagtcctgccacatgggcttcaagttcaaattttgcaggtcatctctccattggctaccaaagagttgcagaagctttagcaattcagtgccaaaaccccattccccagaacgcctttgggaggcttttctggagaacaaaattccataggctgaccatggcttttgattcagaacatttggttcctagacacatggcacaataaccaaaatgaccactgctaaacaataccttagttagccagaaagctaatgataaaagtcatttccagtcttactttgattattcctagtagcagggtttttaataatataatggctgagtgaagaaccccattggctgacaagaggataaatgagtcaagtttggactcccctgaaaatatgaactacatgggccacacttagggaggaccatatattcttttcaagctgtaaaatccactaacatttttgtttttccatttgttgcttggttcaatgcaatctttaccttacacacaatgaaacagaatttaaggagcaaacttattacttggaaaattttgcaagtgactattactttctttgcaggaacatgttccctccaaatctggtagaagcctgctttaaacaggtaaacactctacagacattaacttgccttttaaattcctcttttctataccaaaccaagtgggaccctcttttccctgctcatttctctgctataagaaacacttctcttgtcaaccagattaaaaacactagcgttttctaggaattttggggggaaaggatggttcttaccttgtattgaaagcttagtagttgtcagacacagtgtgtcttgcatacaaatatctcattgagtctgctattgttaagaaggctaatcacaagacccccccttcctatcacccaactccccactggcaaaagcccaccaaccaaacaaacatcaatataaaatatatttataacttgccttaaagaagattagagagattatttagatttctgggtttgatttaaatatcaatggactgttttttttttcaagtctaccaagcacctaatggactctaaaggagagccaaagcagaaaggaatggcatcatcattcatggaaatcctgctatatgccaagcactaacattatttttagtcctcacataaatactataaatatcattgtcttcatttcactgatggggcagctcatctataagactcaaagcaattatgtatcgtgcacaaattctcacaagtagtaagtgggaagactcggaattcaaattcattgtgttgactccaaattctatctgctttctgctactccattctgcttccatgaaaggaatattcagggcgatgagacaccgacctggaggctatactgaggtccagctccttttagctcatatacaagcaactcttggctctgtgttgcagatacaaataccttttaccattagaagataaaagctcactttaacctcacttgaatataagagctttgttgcctaaaatattaaaaggaaaacagacactcttggttaaataatatttcccaaacatttctccagatggtgtcaattcactcctgttgtaattccctaacgcttctgcttaggatctgtaaaacaaaccaaacaaaaccccaacctagtagaagactggattttacacatataagtctccctttgttttttttccccttgtaataatttttaagactatttttaatatgtaatgcatgcacacattgaaacattcaaaccaaattctttctttaaaaaaaaaaaataagcctgaggccaaaatctaactttctttgttcaaaaacaactataactataaataataagcgcctttcaatccaaccagccaactctagcaccatggggctgacgattccagtaagtcagctggccctgtgtgatatcaaaaatgctgatttccagatccttcagatggaaaaagtgctgacttgtacagattgattgtgtttgatttggatttgcattcacaggattttgaagggaaagaaaatgtttctccccaggtctagttggcttagaccaggatgcaaacaaggttgcagtttctgtgcatgctgcaaacagagtctaaggggaatgagttagaggcataagaaagcctgatcaggattgaaaatctgccctggacaatccataaaatgcataaggacccaacggaataaagaaatttgagagttggttggaatagatgaatggggccaatttttttgttgcttgaaattaccagtgctactaactgttcatgaatgtgtccatagtattgacagctggccatggctttgtttgggagtagttgtttcccagtggataagaaacttttccattaacccttggtaaagaaatgaccaagcacttcatatacagcagcactttcttcccctagactctagattcactcaccatcactcaccattattactctcactggtgctttccctacaatcaccatcaagatcaggaattctattctcattaaaatcacagagggatgagtttacttgtttcatgtggccagcatctcctgactggggcatctatgcagaaactgaatagatgatgggaaaaagaccatctcttgagttagaagagaaaccccactatagacttggagaagatgagctgtcatcaccaactattaatcaggcacctattcttaagaactaataacatcaagaatggcttggaaacagcttgtttagggatttttaatttgtaatacccactgaaatctctaaacaggtctaatccctgaagggctttttcattgagcaccattagcagaaattagtacaatactttaaaatttgcaagatgttctcctatattctgtttaatttgattatcacaacaacactgtgaggtagaaccagcacaactgttcttgtttcacagctgtagaatgtgagagaaaggataccaggtgatttatctattataccatagcacgatccccacagaaaagaaaaggactattgtgaatatttgggtttatggttttaaaaaaatcccattatagtcattttattagggtttcagaagaaagcaaaagcacatgcatgtgtttagtccagcatctttagctggatatctctttcctgttatcatttgttatgtatttgagtgtgtgtatgtgtgtgtgtgtgtgtgtcatgatttgtatgtatttcagtatgtgtttctgtctgtctgtgttgagaaactagtaggggtttgccacagattaaagagagagagagactttctataacactcatctctgaatacaaagtaacagagtaacagtaatcattttagaaaatttgacaataggaaaatataaagaaaaaaataaaaatcacctttaatcctcgttgtgctttttatttttaagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgtatttccattttctatatatgttatatacgagatggttattgccatcaacatgtgttctgtactgaggaaggtgccacgaggcaggatggccaattgcagttatctcactctggtaagcccaggaaaatcaatgaatctctgggcctctagaggccttgaacctatctgcaagcctcttctaataagtttgcttccttgttttcaaaagctgtcacctccttttaccccagtgctgatggaatctcattcctcatttctccattttttatctagtttttcattcaagacataattattgagtgtctactatatgctaagcatatagtgccaggcactgtggatatagcaataaagaaaacatacaaggatattccagatcttacactcttttaagggagacagacaataaacaaacaaatcaatcaaccatatgctttagtcacaggtgctgtggaaaaataaaataaaattgcaggtaactaggagaaggcacaaagtttgccttggatggtgcagaaaggcctctgaggaggtgacgtactttgttaagacctgaatgaacagaggaagcagtcataccaaagtgccagaagaagggtgtttccagtaaagggaaaagcaaacggagaggccccctaggccatcaggaaaactgagggctcctcatctgtttcagccctaagaaagaaatgtaaatggcagttctgctgcaatatctaaaagattcacaggaagtattacaaaatgccaagccacaatttataacaaaatttgctttaataaagttgacagcaggagacaaaggaagagactataaatgcaagaggaacattgaccttggaaagtaaactttacccaacggggagagaacgctttgattgacctaggctttgtgtggaggttgcttctctttcattctttatttttaatccagtctcctctgtggtacctgaggcaggaaagcatccattgctaagaaaagcactcagtcaccaacatgattaaaaatgcccttgtctttaatgccaacaaagcccagagaaatccatttttcaggaatttgtacaagatggatatgaacttgggcacaaagacagatcagaatgtggtctccacaggagcccccacttggaaggctcctttgaaaccctggcaggaataaaagtggacatttatcttcatattattaaatgcctccacctttcacctcttttatgaaagaagcccattcaaggccactgaatgaacctcacatgcagcttgtctagctgtacattcgcctgcacattcaacgctgagttattatatttctgaaaacaggtattcctatgatttcctggcctgggttcttaaaggacttttgaaagaagcattgtatttttcgatttgaaacaagtcctccatagttcccaggagacccttcttcttaagtgtgattggcttctctgtgtttggtaatgtgagtttggttgtagtttgctgcacatatgaaacaaacagaagggaaatccaggcagcgaggcctttaagcaaactctaggttatttcaacatgtagaaatcattttgagtctcagtttattgtctgcagaaggaaagctcataaatggcagtagcagcctgtggggaataatgacttcattagaacacctataacctgattgcagtagtacatacatgcacattattaagtttaataatgaatttattttatggacatcttctatttatggcaagtggtactagatttccatttgtactataacatagaattttctcttaaagtaaatttacttaagtaaaaaaggtgatctgaagaataatactaagtaatcttgtaagtggtatgaagatatggaaaggcaataataaaagtggcccttgaataagagaactgactgcaaacctgagacactggtgtagcatcgtgtgcctcttgctttaacttgggaatcaggctctgatgtggaaaatgcttccaaaagtctggatattggtacagtggattccggctgttcaggacacttagcaagggagcaggaggcagagggagtgagtggcatctgaggaccagaaaagtgacccccatgtagtgaaaggagggctggctaggaagacagaggtgggtatcaaaagctctgtatctgccttttcccccaggtctaagagaaaaacattgtgtcctagagcaattctcagtgaggggaaagcccgattctgcaagaatcaggggaaatttatatttacaaaagaaaaaaaagaagtccacagtttctgtaagaaaagaagtccacagtttctgtaagtcctaatggtatcctgggcaggaaagtttggcagtcaactctcttttccctttttcttatcacttggaaatttctgtggactagcttggtggaaaccagactccaaccgtgctggtgttgcttctccccaggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaaggtatgtatgtatgtgtggaaaatgagtctgaaatgttaccttgaaccagggcccctcaagtagggtgtaggagaagccattttattctgagttttaaacttccaagaatgatgagttagctttctcatttctgatgtcaatcacacctgtttgggattcaggaaatgcctggctacatatcttttgtggggacaaattggaaatcaactatcctttcccgtccacttcatctctctttagttgacatttgcctgagggagaagaggcagagtgacttggcacaggctgtcgtgatgagggcatgatcacaagtgatgcctcacagaggaacccagaagcaggagagctgccaaatgaccccgtgaggggaccacactgttcttaacctgctcccctatttatacaattgctgacttagttccctttaagttagaacatgggagaggaaggaactgtctgtcccaaagaccaaacgcacagacagtcagaactaccaggacactcagctgatgtgccctatttcactgttctcagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcaggtacaaggaaagagttctatacaccctttcttaagaatgcctttaaggctgggcgtggtggctcacgcctgtaatcctaacactttgggaggccaaggcgggtggatctcctgaggccaggagttcaagactagcctggcaacatagtgaaaccctgtctccactaaaaatacaaaaattagccaggcctggtggcacgggcctgtggtcccagctacttgggaggctgaagcaggagaattgcttgaacccggaggcagagattgcagggagctgagatcatgccactgcactccagcctgggggacacagcaagactccatctcaaaaaaaaaaaaaaaagaatgcctttaaaagacaagaggatgaccagggttgggaaggggatcccacataatcaagaggtggggatttggggtaatcattctatatttaggtattttaattggtttttttagattatagatgtatacactcattaataacaaggttcaaaaaatataaatatgtataaagtaaaaagggaaacttgcctgccatcacatcgctccacatccttctgtaagtgaccattgttcatgtttggtttggaaagacttttcctatgcatagacatgcacacacttcttttttgtagttagtgaaatcatactatacatacatgtttgcctttgattggtttgcttattaatagaccaataaatatgtctacttcatcattctttttaatgtctgtaaaatacatagtatggatatttctcctttttaaaagtgttagattatacttcaatttttaaaagcattaaaatatgttagcttgtatagatactactagaaaataaaaagttagatgaactttttctcttgggtgaatttttagacagtgtaagatagatgacagaccacactgacaagtagttcaagaatctgatttttgtggagaattttttttaactattatatttgaggtgttcagtgaaaagttattttcctttccataccttccccccatctcttagtttccttctgcagaggcaaccagtgttacctgcaagtttcttctgcatccttccagagatacgccaggcatacgcatgtgcatgtgcaaatataatccctcctttttgcttattaaaagttattttgcacaagggacccatgagtctaatggcaatgggacactttaagcctcactatccagatcagcctctgctcttcattgttgtggggttttttttaaattgttattaaaagtacattttggagagcaaactaagtcagatttggggggatttttatcactcaacattttgttgtgaaatgccctacatatagggaagttgaaacaatattataccaaccatcctctaccagatggaaaaattgcaaacgttttgccatttttgcttcttctttctctttctctgccattatgacatttcacctgtacaaaattcagcatgcatctcctaagaataaggatatttttctacataaccacaatagtaagaatcttaaacatacttccagaatatccaatctatattcaaatttccacagttgtcccccaaaacatgtcttttacagattttacttccagaccaagttcaaatccacatttatggcctacatttggtgtcttagtttcttttcatctaatcagtcaccacacatttgttgttatgtttatttagaaataagttgttagactctgtgtatatgttttgtgttagtagaaaatgataatagttgtagtaggatgcatcggagtaaaaaggaaaaggctgatcagggccagaggtcaatgactgacctgggggttctgggaacctcaggcccaaagtagttataatgggacttaggagatcattatctcagctcacctgtaacctatactttggcatattgattgaaaggctctgggttattaaaaaaaaaaggtgacagagttaaaaataacagtaacagtgacaagcaagatagaaatatatttctctttcatgcagcacagctctgctccacaaagccttcaaggctgattgataggtgttctgtggtataagagactaagtctctagggtattatcattatccaggtggtccgggatgactcaccacccccagattttagtcagtcggaagtggggagatggtataccctgcaagttgctcagtacctccatgcatgtctgactggccagaacttaatctaagcttcaagggaggttgggaagtgtagtcttcattctggggagccatataccagctaaaagtcccagtatcttagaaggggaccagtatggggaccatgaatactttctgtgacagacttaatactttattaataccacttataaccagataatactttactatttataaaacatttgctttgcaagccaggtctacactgccttcataaaaagtatttctaatactataaaactttgttcataaatcattttgcttttgaattaactaagcaaaccaaactaagaaaccaaatttgattcttttgacaacattaatcatgaatgttcagtaactttacaaccctccacttggataggggaattattagaaacaaattattattgtaactctacagcattttagactttgccttacaaaatactttcagggatgtttaaaagtgtatagctgccagtttatttaaaaacgactagaataataggtccaacttcacaagggtcattgtacgaggaccaaattagataaaccatgcttagtatatcagaagacacatagtaagcacatgataaatattagttagcatgatgattagttcaatttttttttttttaatctcatttacgggccaggcatgatggctcatgccggtaatcccagcactttgggaggccaaggtgggtggatcacttgaggtcaagagttcgagactaacctggctaacatggtgaaatcctgctctactaaaaacacgaatattagtcgagtgtgggggcatgaagctgtattcccagctactcaggggactgaggcacgagaatcacttgaacccaggaggaagaggtttcagtgagcctagtttgcaccactgcactccagcctgggcaacagagtgagatactgtttcaaaaaaaaaaaaaatctcatttacgttttttctgaagcgcgtcctcttgtgttacatggcaagtcaggcatcggcaccgtgcgtattttgcagcgtatatgctctacgtggggagctttgtaaaagtgttttctgttctggtacttctgttaacagcatcacagccacagctgccagtattggggcagctggaattcctcaggcgggcctggtcactatggtcattgtgctgacatctgtcggcctgcccactgacgacatcacgctcatcatcgcggtggactggttcctgtgagtatgcttggcctgcattccagctcactgtcacagggtccccctctgtcactctagggcaccaggcagcctggcacatctacagaaagaactctgaggagaggggcctctcggcccatagttaaattgtccttattgtctgacccctggtccttatctggagaccgagccccagatgccatgtgcactcactcccctgtcagcctaaggggcacatctggctgccacacatctcactccataaagccattcaggaattgggaaacccgctgtctgcaaaggcaacataaatcagcaaggctgtttctgagttgcacaacatgacaccacagcagctggaacaaagctgcaggccccacatgccagcttaggccctgcctctgtgtgcttcccattccagtgggaatgattttcccatcctagcccaatagggtgaggctgagctatgccgacactgggaagagagctagtgtcattaagtggaattgagtttcggatctagggaaagttacaagaaatgtgccctccacattctcaaactctaacctctacaggcccatcccttcgcccccttccctcgctcttccagctggcattctctgtgccttttctcttaaaaatttccttccacttttgaaaatctttccccaggatgcccaaagcaaagcctagaacagagtacgtgttggagttaacacaacatatgttcactagaactgcaacatgaaaagagcttgacagtgtgcgtgaaaccccagactgggcgagaggattcactccccagttacttggacctgtgtttgtgtcctgaccttgtgtgagaccgggcagattacccaaccaccctagtttctacctctgtaaaatgagggtgcccgtgtcctctacctcctaggggtactgcaagattcagtgcaatgatgcctagaaagcatgcagcctactgtctggcccacagtcagcatcagttaacatgagcactctcatataaagctacagttctccacagtctttgatctttacacttcaaaattattgagaactgaaacagcatttgatctatatgggttgtatctattcatatttatcatattagacacacttataaatttccacttgttaatttattacatgttttatttaaaggtgataataattcataaaataaaataatggaatgaatttattatcatctttaaacaaaaaggttatatatgctaacataaatagcatttttttgcaaaaaacaaccatttcgaccccaaaatttattttatttatttacttgttttgagatggagttccattcctgttgcccaggctagagtgcaatggcacagtcttggctcactgcaacctccgcctcctgggttcaagtgattctcctgcctcagcctcctgagtagctgggattagaggcgcccgccaccacgcctggctaatttttgtatttttagtagagacgggtttcaccatgttggccaggctggtctcgaactcctgacctcaggtgaaccacctgccttggcctcccaaagtgctgagattacaggtgtgagccacggtgcccggcctcgaccccaatatttagtgaaaagaatggtactattttatgttttgcaagttttcttaatgtctggcttaatacaagacagttggagtttcctgtttctgcagtttcacaactgcttcagtgagttgtgacatcacacatcatgtagtctttgcaaaactccactatacattcatgagaaaatgagactgagagggacaaatgacatcttagtattattatgagaatggcttaaagagaaggctcgttccccactgttgggactctcacttcagtcaaactaataactgaacattcatcatctatatggccttataacctttaatagctactattatgaatattatgtgtctattacgtaatcttgcagttggtagatacggcgaactgaatgttaagaggtgcttcgctggccagttcctaacgtaagttgaaaacttgtgatgctcacgggagcctcgtttttccctcctccccaccctgcctgcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacattaacatctttgcacgttgttgttattcttctcctcaaagaaaaatacattttccattcatggaaatattacaataagctcagggcagtctctggaaggatcccatgcagcaaggtaaaatcttggcagagccagccacaagaaaataagtaaggacatgctctcctgctcaactccaagaactggagctggaaacaggaggaggtgagcggagcactttgctgtagcaggccatacttccttgtccatgtcagattcaaatttctcagatgaattgaatcatttccatgtcgggattagaaaagtgtgataccaccatgggcccttccgaaaaagtaacttcctgtctgacctccaaattaggtagatttatctctgtgattattaccaccatttgtgaaaagagctaactaagatctcaagggatttccagaaacagccattgtgctggtgctctattcattaagaacagcttacggatgactacttttcatcatgctttttagtaaagaattcgcaggcaatatcatgaaatctccagattgaagtagtgtctggagcctataatctgaccctctctaccagcaggtggcagccacctagaggaaaggctcttaagttggatccatggacccctaggtcatccacatgagagttcaataggttcatcgcccttgaagttgtggggaaagttttgtgcatttgcctttttctgggggtaaaattcttaatttcaatcggtttctctaacagatcttacgactaaaaaaaaaaaaaaatttacaaatcgctatgtttgaaccatacaccctaacttttgtgaaggcatatgtggtatttacatgaccagtttgggaaaagaaaggctgctcacaaactgagggaaccaagcctggccaccctgagcagatcaatatttgccccctgtgaaacgttctgggaagtgccgcataaaatcaatccactgctaggaagtgctcccttctgccgggaccattttcttcccttctgcagcccacgctgggttttggccacctccacaatgcagacataagaagcaggtcatctgcctgtgggaggtctgtggaaagccccttatggttaagggaagtgcctctcagccagagtatgacaaagagggtggagaagcaggccttagatcccaacatgtggtagtcacacatgtgctcacaaatggaactatgaaaaatatgcaggttcacagcttttttttttttttttaagatacagggtctcactctgtgattatggctcactgcagcctcgaactcctgggctcaagcgatcctcagcctcccgagtatctaggaccataggctcacaccaccacgcccaggctaatttttatttttattttttgtagagacaggatctcgctatgttgctcaggctggtctcaaactcctggcctcaagccatccttctgcctcagcctcccaaagtgctgggattacaggagtgagccgctgcacccagcctctggctgacattttttaaaatgtttcttataagttattacatttaacaaaatatttaaatcctaccctcagaagttaggagtctatgtcctcctgtatccacattcatcctggtaccaccactgtcccttcccacccaagcaaaattctccttttcaagagaaaaaatctcactttacctcactatacctataagtaaaggcatagaaaaaaaagtaaaatccttgactcatctacacagtgttgaaaacagaagtgtgagttctgttagctgaacgggcctggaggaagcgtggcgggaaggctggatccccgccgcaggggctgcggggctgtggctgcctgcgggctgggcagggccgggcgcacgccctccttccgggtggccgcgggccccgaccccaggctgccgtcagtcgagcggcctccgcagcggccgcgcttccccttctcccacccgggtggtcccagaactggagcaacaatggccggctctgtgtggc

SEQ ID NO: 12334 - DNA, 57859 bp, Human
  misc_feature (1)...(57859): n = A,T,C or G
gcctcactttcccccaacaacccacccaacacacacacacacacacacactcctcatccttgccttttgagagtttgcaggcccagctggatacaaacatacaggaggtagaacaacatagaaatgttacaccaacaaatccttattcacatactcaaccggttttattgcttctggctccgtgcagacctcagccagcttgagaaggggacacacaccacacactcgctgtgcttgcccttcatctattcagcatatagttattaagtactgactctgtgtcaagcaagcatcatgctaagggctggcatttacactctggtggagaaacatgtctcaaagaggtgactctcagggttgtgcagggcaggatattacaagtgttccaaatgagggatggggcccctaagattcaggagagctggaaacccgcgggtctagagacttaagaagcacctgctttaaataaaagggagaaggagatcggtttgcattgatagggttctgggtacactacagcaaggagtctgagcaagaaaagcagttcagaacaggagctttgtcggtccgtgcgcaaccttggacgagtgagtgaacctccgccaccctccatctcagcatcagtaaaataaagatgggaacctccctctcagggttttgtgagaatcccgtgagataaagcaggcacgtgcctagcacatagtaagaactccatgggtttgctgctccctttgtggagcggcgctgtgggtgaaggggcggtgatagaagttgcttgtctagattggaagccatgtggttctgacgccaaggcccggctgcaacgtgcccgacgggctactccgggctggcagccccgcccttcttcggaaagctgacttacttgcgccccctggtgtttcacatgctgtgaatctctcacgaccgaggtctggccgcgcgccacctctctgagggaaggacagggtcagtggccaggaaggggcccacttcagacgccggcgtaaacgaggatgcgcctcctctcgtccccgtgctcagccgcctccctggtgtctaagttcggagcacagcagcttaccctgcctgaaaagcggaacgaagcctagactgcgtaaaaaaaaacagagaacagaaaccacctcacagcattgttgtgagccttaaatgagcaaatttaagacttaaaactggtcattgacataagccttcaaaaagtgatagctattagtattatgtagctcctagaacagtggctgacatatagtagatgctcataactgttaaaaaggggccaggaggattctatctatttatgcattcatccatttaattatgcttcagaaatgtcttgctctttttatactgtcgatgctgtaaaatacaaaacccataataagccaagtaagcaagcaagagccagcactctgggaggaaaacaaagagattttcttcattgaaatatccatgccacagttcctactaggtgccaggcactgtgataggcactaggatagagaaataagttacaggcctttagggattttaggtgctggtgggagagacaaacatgaaacgcagtgttatgtggattataataaatagagcaacaagctgtggctgcacagttaacccccagtggagtcaggaaaggtctcacagaggaagggacacttgtcttggtcttgaaggagaggtagatgctcccaggtgaagaagagaatgaagggcattccaaggaatgaggatagcatatacagtgcaccaagttgccagcaggcaccgtgtttctggtgagaagcctgggatggaagtctagatcaggagaagtaagcaggaactcgacaggaaagggcatggtctgcccaggcaaagaatttgtgcccttatttggtgggccactggaagcctgaattgaggagcatcatgagcacaggcacatttaccaagaagctaatgaggtttaagcttcgaggcccatcactggcatggccccttccaaaccctgaagagcccaagcaatgtggttgtaaaatttgcaaaataagattaaatcttaactgcaatctgttaacactgctgtctcctttcactctttctcctatatcacactttcccacatgttggatggccttggagtggtagccataagcatttttggaattcaactaaaagtaagttgaatgaagcactactttatttaatacttgtacctaattttctccttttcttctcgatacataatactttacatatttatggggtatatatgatcatatacgtagtatgtataatggtcaagcttgttatacacgtagtatgtataatggtcaagtcaggatatttggggtatccatcaccttgagtatttatcatttctatgtgttggtatcatttcaagtcctctcttctagttactttgaaacatacaaagtattgttgccaagtatagtcaccctattctgctatcaaacattagaacttatttcttctatctaactgtatgtttgtaaccattaatcaacttctcttcattcccctcccaccaaccacccttcccagactctggtatctatcattctattctctatggccatgaggtcaagttttttagctcccacatatgagtaagaacatgcagcatttgtctttctgtgcctggctaatttcatttaacatagtgacttccagcaccatccttatggctgcaaatgagttgatttcattcttttttatgaccaataatattccattttgtatctataccaagttttctctattcattcatccgttgatggacacttaggtttatatctttgctgtcatgagtcgtgctgtaatacacatctgaacgcaggcatccctttgatatactatttattttcctttagctagatacccagtaataggattcctggattatggtagttctatttttaggttttaataaatctccatattgttttccatagtggttgtactaatttacattcccaccatcagtgtataagagttccctgttctctgcgccctcatcagcctctgttatttttttcttctttataatagccattctaactggggtaagacgatatctcattttggttttgttttgcacttccctaatgattcatgacattgagcattttttcatgtatccattggccatttgtcagtcttcatttgagaaatgtctattcatgccggtttcccattttaatgggattattattattattattatttattgtttagttgtttgagttccttgtatattctggaattagtcacctgttgcatgagtagttagcaaatattttctcccattcaagaggttgtctctttactctgttgattgtttcttctgctacatagaagtttttccatttaatacagtcctatttgtctatttttcgttttgttgcctgtgcttttgaggtcttggccataaaatctttgcctagaccaatgccctgaagagtttttcttatgttttcttctagtagttttatagttttccatcttacattaaaattcttaatccatcttcagttgtcttctgtatatagtgaaagataggaatccagttgcattcttgtgcatatggttattcagttttcccagcaccatttattgaagagggtgttctttccccattgtatgtccttggtgatttgttgaagatgagttagctgtaaatatgtggatttatttctgagttttcaattctgttccattggtctatgtgtctgcttttataccaataccatcctgatttggttactaaagccatgtaatccattttgaagtgagtcaagaagtgactctgaagacacatctgaagatagtgtgatatatccactttattgtttttgctcaggattacattggctattctggctcttttttggttccatacaaattttagtattttttttctattctgcggaaaatgacattggtattttgatggggattgcgttgaatctgtagattgctgcaagcagtatggtcattttaataatactaattatactagtccatgagcatggaatgcctttccatttgtttgtgtcatcttgaattttgttcatcagttttatgtagtataccttgtagagatctttcacctacttagttaagtttattcctaggttttttgttgtttgtttgtttgttttttagctattgtaaatcagatttctttcctttttttttttgagacggagctctgtcacccaggctagagtgcagtgtgcgatctcagctcactacaacctccgtctcccaggttcaagctattctcctgcctcagcttcccgagtagctgggattacaggcacatgccaccatgcctggctaatttttgtatttttagtagagatggggtttcaccgtgttagccaggctggtctcaaactcccaacctcaggtgatctacctatcttggcctcccaaagtgctgggattacaggtgtgagtcgccgtacccggcctatttatatcttcttgtactatgtcttcaaaaattgttgtgattattatttctgagtagctcatcttttagtcattctactcaagatatgagtagtttacacaccacaattacagtgttatgatattctgtgtttttctgtgtacttcctattaccagtgagttttgtaccttcggataatttttgattgctcaatgaccttttctttcagattgaagaactctttttagcatttcttgtaggacaggtctggtgttgatgaaattcctcagcttttgtttttctgggaaagtctttatttctccttcatgtttgaaggataatttcaccagatataattttctagggtaaaagttttttccttcagcactttaaatatatcatgccactctcagcggggtgcgatggctcacccttgtaattccagcactttgggaggctgaggcgggtggatcacctgaggacgggagtttgagaccagcctggccaatatggtgaaagcccatttttgctgaaaatataaaaattagccaggtgtgatggtgcacacctgtagtcccagctacttggcaggctgaggtgtgagatcacttgagcccaggaggcagacgttgcagtgagtcaagatcacgccactgcactccagcctgggtggcagagtgagactcgtctctaaataaataaataaataataaatcatgctgctatggtgtacaaatgggggaaaggcgtccgctctctatgcatgagcctaagcactgaggctgctccaccagtgggggtagggtcactgcccaggccccagacagtcagctctcaggctcacccacttgggctcctggtggcagcaactgctgcatttgtgtgggtgtgggggaggaaggggaggcggtgggatgggtggaaggaattccactttccgattatgagccccagaatagagtctgtgccactgctgggggcaaggtcgctctcacagggtctggaaagtgtctgctctggcttactgtgactgtgtcccaggggcttcctccttggtgtgtggcaccatccttttcctgaggagtagtagttcatgtgggccagggtactggggaccctgtgcacatttgggtccagccagtgctgtgccactgtaaccctctgagtggacactaagggacatcagtgggggattctgaaatgtggacataggagggtgtggttcccagggcaggatgcagtccagtggtggctgtgctttcacaatggtgctgtgctgcagccacgtacgtcttggggaagcatgtgaccctgcatgagtcccctgtctggtgagatgccctgacagggcctccagaccaccacccacactagtctcagagtttgtatgggtagaggagctctctcatggttaggactgcagcagtctgcagcagggatgtgtatagcagagggattctcaccgccaaccttggctgagttgaccactcacttcctgctccatctgtgcctcaggtatttcccataacttctctgttgaactccagtgttctctcctagatgttctattggaggtatgattatctattcacaattattgattccttctttaaagagtgagtgtctaatgtctctagtcagccattttgaacccctatctcagttttttgagagatttctgtggtttgccgtcacttccatgagtttatgctagccacgccaataggaatagcttctaggaatactcccatcaatccatgtgctgcctgacctgacataatgacatgaagcagcagtgccaaaggttgtattctaggaatataccctgtagtatctggcactaaaagtaaagtgggaagcaaaggagaaacaagtttggaatatgtggagccagaacacatctatagaaaattcatctagttctcagctgtgtaaaattataagtgggcaattaatttcttattaaatcctagccaaaacaaaatttatctcttgccaaggaaactggtcagtgatgcagtgtacataattataaatgcagcatacatatgaagatgtaatcaaggagtatgaagtcaaaagatagatatatggttttttattttcaagaattctacttctgacttcaaaatagagtaacaggaactggatttattctcacacctaaaaaaaaactaagcattaagccaaatatattaaagacattgacgatcagacaacaaaggacacagatgggaaacaaagtgagtcttataattgccccccaacaggaaggagaattccaggcatggcctcatgatctccttaagttcaggaggtaaagctgggagtcttgggagggaagagtattggatgtaagacagcttcagtgagagagatcaccagaggatgtgagaggcctcccctggagtcttcaactaagtgctaatcagcaaatgtatgaggaaactacccaagaccaatgagagaaccacccaaaaggattagaagaaactactcagagatctcatgggactgggagtagtttctgttctcattagcgaaaaatgaaaaatctcataatttgcagcacattcaaagagtcttcagagttttgtctctatagtgggccaaaataagccctagaataaatgatgctctgttcccaccaacccccaaccaatgaaaaaaaaaaaaaaagactcaaaaggataaaactgtttctaaataactatgtctcagaataaagctcaagaatatgtataggaaaacaaaaatgtccagcagtcaaaaggtaaaaatcacaatgtctggcatccaataaaaaattacaaagaagtagaaaaatatggcaaataattagaagaaaactcaatccttgaaaattacttcagggtgggcaacatggagaaaccttgtctctacaaaaaatacaaaatttagctgggtgtggtggtgtgtgccaggagtcccagctactcaggaggctgaggtgggaggatcacttgagcttgggagattgatgctgccgtgagttgtgatcatgccactgcactctagcctgggcaacaaagcaatactaaaaaaaaaaaggagagaaagagaaagagagagggagggaggggagggaaggggagagagagagagggaaggagggagaaagggagagggagaggaaagaaaaaggaaaggaagaaaaagaaagaaagaaacacggaaggaggaaggaaggaagggaaaaaagaaagaaaaaagagaaagaaagaagaaggaaggaaggaaaagaaagagaggaagggagggcgggagggacaggagagagggagggaaggagggagggagaggaaaggaaggaaggaaggaaggaaaagagggagggagggagagagggaaggcaggctggtcaaaataacacaatgacagaaatagcagacaattacattaaaatagctattataactgtactgtatattcaaggagatagggaaaagattgagtttggtaactagagacatgaaagatgcagaaaaactaaaatcaaacttctagagatgaaaatcccagtatctgagattaaaaaaaaatggatgagattagcaacagattacacattgtggaagaaatgattattaaatatgaagaaatattaataaaagcaatccataataaaacacagagcataagaaattttttttaatgaacaaagcatcagtgagctttgggtcacattcaggtgacctaatgtaagtttaatcggcatccccaaagaaaaatatttgaacaaacaatagccaagattttccaaatttgatgaaaataataaattcacagatacaaaaaaagccaataaatataagcataagaaacatgaaggaaactgcaacaagaaacatcataatcggctgggcatagtggctcatgcctgtaatcccagcactttgggaggccgaggcgggtggatcatgaggtcaggagatcgagattatcctggctaacacagtgaaaccccatctctactaaaaatacaaaaaaaaaaaaaaattagccgggcgtggtggcaggcagttgtagtcccagctactcgggaagctgaggcaggagaatggcatgaacccaggaggcagagcttgcagtgagccaagatagggccactgcactccggcctgggtgacagagagagactctgtctcaaaaaaaaaaaaaaaaaagaaagaaaaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccaagtagctgggactacaggtgtgagccaccacatctgactgatttttttttgtatttttagtggagacggggtttcaccgcgttagccaggatggtctcaatctcctgacctcgtgatctgcctgcctccgcctcccaaaggggctgggattacaggcgtaagccaccatgcctggccaagagaacacttttaaaacaaccagaggaaaaaaagctattacatacagatgaacaaacataaaagaacatgagatttctcattagtaatgacacaatcctgaagacagtggagcagttagtggtagactactgaggaaaaaaactgtcaacctagaattctaaacccagtgaaaatacctttcaaaaacaatggcgatagtcactttttaaaatgtgaaacaccgttcagaaaaatgaggatcgtgttatggtttcaatctgtatccccacccaaatctcatgtcgaattgtgatctccaatgttggaggtggagtctggtgggaggtgattggatcatgagcatggatccttcatgaatagtttagcacccttggtgctgttctcatgataatgagtaagttcttgagagatctggttgtttaaaagtgtgtagcaatcccccacacacacacccagctctctctcttgctcctgctttggccatgtgatgtgcctgctaccccttcactttccaccataattgttaagtttcctgaggcctccccagaaagggagcagatgctagcatcatgcttcctgtacagccaacagaaccatgagacagttaaacctcttttcattataaattacccagtctcaggtacttctgtacagcaatacaagaatgaactaatacagattgctttccttgatgtgtgagagtcatcatctctcctcttggttcattattgggtgtgctataaataaaatcattagcaattaaagtgagatttgcccacacacacaaaaagcaaaataaagatatttctcaaacatgcacatgatgaaagaattcctcatcagcagaactgcagtacaagaaatactaaaggaagtagttcaggcaaaataaaactaataacaaatctgcatctatacaaaggaatgatgagcatcaaaaaatggtaggcatatgggtaaatatgaaagacttacccattttaaagagatttaaagaacaataacttttctttaaatatttaaatctctctaaagagttatcacagtgtattgtgggctttttcacatatgtagaaataaaatgtatgacaatgatagcacaaacgctgagggaagagaaatggaaatatactgtagtaagattcttattctgtaaattcatcggcataatatcacatgaagctagaccacaataagttaaagatgtacacaatgagccataaagcaaccatgaaaaaaagcaaaacaaaactaataaggcaacaaagaagataaaaatagaatcataaaaataatctataagaaggaaagaagaacaaagaacctatggtagaaaaataacattattgatttaagctaactatatgaataatcgcttacaatttaaatagcctaaacaactcaattaaaggcagagattgtccaattgtattttaaagacaaacactcaaaaatatgctgcccacaagaaatccaatataaatataaagacatgtatagggtaaattattattgactaccccacccaaatgcaacagaatacatattattttttaatgcacacatagaacatttacaatgatagacaatatttttggctactgaaaagtctcaatacattttaaaagatctaaatcatgcaaattatgttctctggccacaatggaattcaattagagtaaataaaatgcgggtttctgggatatccctaaatatttggaaaataacacactaccaaataacccatgggtcaaaggaaattaaaggagaaattagaaaataatttgaactgaatgaaaaggaagatgtaacatatcaatatttatgggacacagattgagtacttaaagagaaatttataacactaaatgcctatattaaaaaagaagaaagatataaaatcagttaagcaaatagaagttcaaatgacatcaccaagatggtggatgagaaggtaatgcccatcccccactgagaaaaacaacgaataaacaactacataccaaccaaaatagctctgggagagctgcagagtacaatgaaaaacttgcagcaacccaaaggaccacacaaaccaagatagccatattaaaaaatacagaaagtatcctacctactccaccccatcccccagtccaagcacagctttgcaccaagaggcatctcctggacacaacccacaacctccacctgtgggagaaaaggagagcaggaggaccccagcatcctttgccaccaatgcaaacattgaccacttttaccactgaggacccctgcagtttccaccagtgatgatctcaactgacagagctttccagggtccatgctgctgtgtccccctggagaagaagctgctgtgtccccagtggccaagattaccaactcaccgtctcacaattgcatgtatgctctagaccccagagccaaggctgctacatgtatgatggacacttctgacactggcaccaccactgccatgggcacacctgtaccccagatcatagagccatggctgttctgtgtgcaaccaagcatcaaataccagcaccactaccaacatgagcacacctgcactgtggatctggcacaaaaagggatcccatcagctgtgaagttcccccaagcaggaataagagaacaggaaaatgccagcagcctttgctgttgcatttgggtggggtagtcaataataatttaccctatacatgtctttatatttagagtacccaagcaactttttctgctgctgtgtacacccacagccttggctgctgagggcctccagagccattggccatgctgatctcagctgatggagctttatagagagtatgctgctgtacccaccatggagttggagctgatgctgtggcttcccagagctagaaccaccacacccaactcagacagcatcttcatgcccacttataaatggtctttccctattgaaatgagtccatacagtctggaagaggtggctattacttcaaacatgcagacatcactacaaggctaaagaaacataaaaaatcaaggaaatattacaccgccaaaggaacacaataatttttcagtaattaaccccaaagaaatagagatctatgaactacctaaagaataattcaaaataattgtttaaggaagcttggtggctacaagaagacactgggaattcagtgaaaccagaaaagcaatacaagaacagattaaaagttcaagaaagagatagaaatcattttaaaataaccaaacaaattatggagttgaagaatacaatgaatgaaattgaaaatacaatagagaatttcaacagcagacttgatcaagcaaaataattttaaaaaaaaatctgtgaacctgaagacacatcatttgaaattatctagtcagcagacaaaagagaaaaaagaatggaaaacagtaaagaaagcctatgggatttatggaataccatcactgaaatcaatatatgtatttgggagttccaaaaccagaagagtggctgagcactgtagctcatgcctgtaaccctagcacattgggaggccaaggcaggaggatcacttgagcccaggagttcaagaccagcctgggcaacatagtgagacctggtctgtacaaaaaatgtaaaaattagctgggtgtgatggtgcatgcctgtggtctccacaactcaggaggctgagttaggaggatcacttgcacccaggaggtcaaggctgcaatgagctgtgattgcaccactgcactccagcctgggcaacaaagcaagatgctgtctcaaagagagagagagaaaataaaaaagaaaaagtaggagagagggcagaaagcttattaaaaaaaaataataaaggctaaaaacttcccaaatcttgagagagatatagacatccagattcatgataccaaatagcccccaaatagaatcaacccaaagaagactacatcaaggcatattataatcaaattaccaaaagttaaggacaaagagaattttgaaagcagtaagagaaaagtaactgatcacatataagggagactcgatgggactattggaagatttctcagaagaaaacttgctgaccaggagaaaatagggtgatataacccaagtactgaaagaaaaaaaaatgccatttaagaatactattcctagaaaaattttcctttaaaaatgaaggagaggctgggcatggtggctcacacctgtaaccccagcattttggaaggctgaggtggaaggatcacttaaacctaggagtttgagaccagcctgggcaacatggcaaaacctcatctccacaaaaaaaatttaaaaattagccaggtgtggtgacacactcctgtagtcccagataccagggaggctgaggcaggaggcttgcttgagcagaggtgtttgaagttgcagtgaggcatgatcacaccacagcactctagcttgggcaacagagcaagattctgtctataaaaataaaactaaagggctgggcgcagtggctgatacctgtatcccagtacgttgggaggccaaggtgggcggatcccctcaggtcaggagtttgagaccagccagaccaacatggtgaaaccttgtctctactaaaaatacaaaaattagctgggcgtagtggtacatgcctgtaatcccagctactcaggaggctgaggcaggagaatcgcttgaaccaaggaggtagaggttgcagtgagctgaaattgcaccattgcactccagcctgggtgacaagagtgaaactctgtctcaaaataaataaataaataaaaataaaactacaaataagattaaacaaaacataagacaaaaatttgcaggggctgggcgtgggggctcatgcctataatctcagcattttgagaggccgagacgggctgatcacctgaggtcaggagtttgagaccagcctggccaacatggtgaaaccccgtctctactaaaaatacaaaaattagccggttgtggtggcaggcacctgtaatcccagctacttgggaggctgaggcaggagaatcgctggaacctgggagacagaagttgcagtgagccaagatcacaccactgcactccagcctgggagacagagtgagactccattttaaaaaaaattttttttctaatggatatacagtataaaaacaagccagcagccaacaagatcacaaagtgtgcaggggtgcagggatggagagtaaaagtctagtgtttttgtaagcaattgaagttaagtttttttgttgttgttgttttatttttgagacggggtctcgctctgtctcccaggctggagcgcagtgtcgcatctctgctcactgcaagctctgcctcctgggttcacaccattctcctgcctcagcctcccaagtagctgggactacaggcacctgctaccatgcccgactaattttctgtatttttttagtagagacggggtttcacggtgttagccaggatggtctcaatctcctgacctcgtgatctgcctgcctcagcctcccaaagtgctgggattacagacgtgagccactgcacccagctgaagttaagttgttatcaactaaaaataagttacaactccaagctaaccataaagaaaagacctatggttgggcacagtggctcatgcctgtaatcccagcactttgggaggccaagatgggcagatcacttgaggtctgaggtcaggagttcaagaccagccttgccaacatggtgaaatcctatctctactaaaaatacaaaaattagccaggcgtggtggcaggcacttataatgccagttacttgggaggctgaggcaggagaatcacgtgaacttgggaggtggaagttgcagccagtcaatatcacaccactgcactcagcctgggtgacagagtaagactccgtctcaaaaaaaaaaaaaaaaagagaagacagtacaaccgataccacagaaacaaaaagatgtataaaggactattatgaacaattacatgccaacaaacaggaacaaacaggatcacctagaagaaatggataaatttctagaaacatacaacctaccaaaactgaagcaaaaaatagaaagcctgaacagaccaataaaaaataaggcaactgaatcagtactcaaaaaatctcccaaaaaagaaagcccagaaccagatggcttcataggtgaattctaccaagcattttaaaaagaatgaacacctaatctttcttaaactcttgtgaaaaatagaagaaaagggaacacttcagaagttattctgcaaggccaaaattaccctgataccaaaaccagacaaagatactccgagaaaagaaaacctcaggccaatatacctgattaacttagatgtaaaaaccctcaatgaaatactagcaaaactaattcaacagcacattataaaaattatacaccataggccgggcatggtggctcacacctgtaatcccagcactttgggaggccgaggtggatggatcacctgaggtcgggagatcaagatcagcctgaccaacatggagaaaccccgtctctactaaaaatacaaaaattagctgggcatgttggcaggtgcctgtaatccgagctactcaggaggctgaggcaggagaattgcttgaacctgggaggcaaaggttgcagtgagccgagatcgcgccactgcactccagcctgggcaacaagagcaaaatttcgtctcaaaaaaaaaaaaaaattatacaccctgagcaagtgcaatttgcttatttatttgttcatttgttttattatccctggaatgcaagtatggttcaacgtatgaaaatcaatcaatgtgatacaacatattagctaaagaaaaaatgtgattatctcaatagatgcagaaaaaacgtttggcaaagtacaatatctattcatgactctcaacaaaagaggtacagaagaaacttaccctaaaataataaaggccattatgaaaagtccacagctaatatcataaccaatggggaaaaactacaagctttccttctaagatctggtacaaggcaaggatgcccactttcaccttcttttcaacatagtactagaagtcctagccagagcaatgagacaagaaaaagccatccaaacaaaaaagaagtaaacttatccttctttgcagatggtgtgatcatgtacatagaaaacacagaagactcaatgaaaaaactgttagaactaataaatgaattcagtaaatttgcagggtacaaaaatcaacataaaaaaattaatcaggccaggcgtggtggctcatgcccataagcctagcactttgggaggccaggtcaagagaattgcttgagtccaggattcaagaccagcctgggcaacataaggagacccccatatctacaaaaatttttttaaattagtcgggcatggtggctcacgtctgtaatcccagcaccttgggaggcagaggcgggcagatcacttgaggtcaggagtttgagaccagcctggccaacatggtgaaaccccatctctactaaatacaaaagattaacctggtacagtggtgcatgcctgtaatcccagctacttgggagtctgaggcaggagaattgcttgaacctgggaggcagaggttgcagtgagttgagattgtgcattgcactccagcctgggcaacaagagtgaaaactccatctcaaaaaaaaaaaaaaattagccaggctaatttaaacggtggtgcatgcctgtggttccaactatttgggaggctgatgtgggagaatagtttgaacccgagaggtcaaggctgcagtgagtcgtgattgtgctactacactccaacctggatgacagaacaagaccctgtgtcaaaaaataataataataatcacataaaaaaattttgagacagagccttgctctgtcacccaggctgcagtgcagtgatgttatcatagctcactgtagtcttaaacttctggactcaagcaatcgtcctgcctcagcctactgataatctgggactacaggcacatgccaccagccccactaattttatctttttgtaaagacagggtcttgctatgttgcccaggctagtctcaaactcctggcctcaagcaatcctcctgcctcagcctccgaaagcactggaattacaggcatgagccaccatgcccagccctagtcacatttctagacacaaacagcaaagtagtcagaaagaaaattaaggaaacaatcccattcccattagcaacaaaaagaataaaatattgaggaataaacttagccaaaaagacttgtacactaaaattataaaacattgaaggaaattaaataacattatagataaatgaaaaagatatcgcatgtccatagattgaaaaaatattggtaaaatgttcatactacccaaagtgatctacagatttaacgccatccctatcaaaatcccaatggtattctttacagaaatagacaatagaatcctaaaattcacatgggatgacaaaagacctagaatgtccaaagcaatcttgagcaagaacaaagctggattaatcacacttcccaattttgaaatgtattatagccagatacagggtagtcccagctacctgggagtggagtctgaggcaggaggatgcttcagcctaggagtttgaggctgcagtgtgctatgattgcacctgtgaatagccactgcactctagcctgggcaacatagatacacacacacacacacacacacacacacacacacatatacacacacacacacattatagtaatgaaaacagtatggtacttgcataaaaacaatatatagagcaaagggacagaatagagctcccagaaacaaatccatgcatctatagtcaactgatcttcaacaaggatgccaataacacacaattggaaaaggatcatctccttgatagtgttggaaaaactggatatacaaatgcagaaggatgaaattggatccatgtctcacactatatacaaaaatcaactcaaaaaggattacagatctaagcttaaaagctaaaaccataaaactcctagaagaaaacataggggaacattttcttgatattggcctgggaaatgattttttttttgatgtgacacaaaaagcacaagcaacagaagcaaaaatagacaaatgagactgcatcaaactaaaaagcttctgcacggcaaaggaaacaacagagaaaaaaggcagtctaaggaatgggagaaaatattttcaaactatgtatctgataagaggttaacatttaaaatatataaggaactcatacaactgaataacaaaaaaaaaaaaagaaagagagaataaatttaaaaaataaataaataaccctactttaaaatgagcaaaggacctgaatagacatttcccaaaagaaggcatacagatggccaataagtatatgaaatcatcggagaaatgcaaatcaaatgaaatgtcacctcacacctgttagaattagtattatcaaaaagacaaaagccaggtatggtggcttgcgcttataatttcagctattcaggagactgaggtgggaggatcacttgagccctggagttcaagacgaacctgagcaacatagtgagactttgtctccaaaaattatatatatataattttatataataattttaacaattttatataataatttatataataaattatatatatcatttttatatataattttgtctccaaaaattttatatatatatacacatatatatatacacatatatatacacatatatatacacatatatatatacacatatatatatatatatatacacacacatatatatagagagagagagagagaagagggtctcacttgtcacccaggctggagttggtggtgcagtctcagctcactgcaacctctacttcccaggctcaaatgatcctcctgcctcagcctcctgagtggctaattttttttttgtttttgtttttgtagagacaaggtttcactacattgcctagactggtctcaaactcctggactcaagtgattcatctacctgggcctcccaaagtgctgggattacaggtgtgagccactgtgcctggcccccaaaattttttaaatttaaatttaaattttttaaatcaccaaactccatgcctggcatgtgcctgtagtcctagctactcagaaggctgaggtgggaggattgcttgagaccaggagttcaggctgcaactccagcctgggtgacagagcaagactccctcttgaaaaaaaaaaaaaggtttatttctttatattagcaatggaagtagaaattaataaataatactatttataatagcatcaaaaatactaaatgtaaagatatctgacaggagatgtgcaagacttatacacaaaaactacaagtcattgctaagacaaattgaagttctaaataaatggagagatatactgtgtttataaatcagaagacaatatggctatgaattcagtgctctccaaataattcatatatagatttaatgcaatcccagtgaaaattccaacaggcttttttgtagaaattgacaagttaactctaaaatttgtatggaaatgcaaaggacctaacataaccaaaacaactttgaataataaaaacaaattagaaaatgtcactatctaacttcaaagctttttataaagttatagtcgtcaggccagggggcatgatggctcatgcctgtaatcccagcactttgggaggccaatgctggcagatcacctgaggtcaggagtttgagaccagcctgcccaacatgtcaaaaccccgtgtctactaaaaatacaaaaattaaccaggcatggtgacaggtgcctgtaatcccaggtacacaggaggctgaggcacgaggattgcttgaacccaggaggcagaggttgcagtgagccaagattgtgccactgcactccagcctgggcgacaaagtgagactctgtctcaaaaaaaaaaaaaaaggttatggtcatgaagactacgttttattggaatagaaataaagaactatatcaccatatcaatcaaacagaatgaagagtccagaaacagtctctcaaatatgtgcttagtttattttttgacaaaggtgcaaatgcaattcaatggagaaagcgtaatcttttcaataaatggtactgaaacaactggatatctatatgcaaaaactaagctttgatccatacatcacaccatatacaaaaattaactgaagatatattttcgacctaaatgtaaaacctaaaaaaactgtaaaacttctagaagaaaatgtaacagaaaatctttgtaaccttgggttaggtaaagatttctcttaatataccaaaagcagccaggcccagtggcatgtgcctctaatcccagctactttttctgaattcattgacatgatcatatgggattttttgacttgttaatatggtgaaatacattgattgattttcaaatattaaaccatttatgcattccttccataaacccaattggtcatttatgtattatctttttatatattgttgggtttgatttgataaaacaccagctactggaaggctgggaggattgcttgagcccaggagttcaagaccagcctgggcaagataatgagtttttaacacacacacacacacacacacacacacacaccaggctgggtgctgtggctcatgcctgtaatcctagcactttgggaggccaaggcaggtggatcccttgagctcagcagtttgaggccagcctgggcaacatagcgagaccccatctctacaaaaaaatttttaattagttgggcatggtggtaagtgcctgtagtcccagttattcaggagtctgatgtgggaggttggcttgagcttcagaggcaatggttgcaatgagccaaggtcacaccactgcactccatcctgggcaacagagccagaccctgtctcaaaaacaaaacaaaacaaaagaacataccaaaagcactacccataaagaaccaattgataaattggactttatcaaaatttaaaacttctgctgttcaaaaacattattaaaagaatgaaaagacaagccattaactaggagaatatactttcaaatcacacatttaataaaagacttatatccagaacatatgaagaactttctaaagttaataagaaaaaaaaaacccaataaaaataggggaaatattttactagaaacttcaaaaaagacatacagtaggcaaatgaaaagatcattagtcattagggaaatgcaaattaaaaccacaatgagatagcaatacatacctactagaaagcctaaaattaaaagaactttttatattatgtgttgacgagaatgtagagcaactagaactgcaaatgggagtataaatgatacaacaactttggaacatatttcgatagtttctttagaaaacatacattaacctgccacatgattcagttatcccatgcctaggtatttactcaaaagaaatgagggtatattctatgcaaaggttgtaaaataatgttcataacagttttacatgtcaaagccaaaaacttgtaattacccaaatagccatcaacaagtgaatagataagtaaactgtgatatatccatacaatggaatactattcaacaataaaaagaatgcagctacatgaatgaatctcaattatgctagtgaaagaagacatttaaaatcaatacacactatatgattctgtttatttaaaattctataaatgcaagataagatacagtaaataaaagattcgtggttgcctggggattgggggagggagcaaagagaatagaaatgtgattacaaaggtgtgatataataagaaatatatacagatgcttctcaatttatgatagcagggttacctcctaataaacctatcataaatttaaaataccatgtcaaaaatgtatttaagacacctaatctgctgaacatctcattgcttagtgtagcctaccttaaatgtgctcagaacacattagcctacagttggacaaaatcatctaacacaatccctattttataataaagtgttgaatatctcatgtaatttattgaatactaaagtgaaaaacagtataagtattgaagtagtttgtggaaataagtaattcaaaatctaagctgggctgggtgtggtagctcacgcctgtaatcccaacactttgggaggctgaagcgggtggattgcttgaggtcaggagttcaagaccagcctggccaacatggtgaaaccctgtctctactaaaattacaaaaattagccaggcatggtggcacatgcctgtaaacccagctatgtcaggaggttgaggcacaagaattgcttgaaccaaggagacagaggttgcaatgagccgagattgcgccactgcactccagcctgggtgacacagagaggctctgactcaaaaaaaaaaaaaaaaaaaaaatctaagctgttggtagacgactcatataaaaaattttttaaaaacaaaatctggccaggcacagtagttcacgcccataatcccaccactttgagaggccaaggcgggcaaatcactggagctcagaagtttgaagagatcagcctggccaacatggtggaactccgtctctaccaaaaataaaaaaattagctgggcagggtggtgcacgcctagtaatcccagctatttgggaggctgaggctggagaattatttgaactagggaggtagagtttgcagttagccgagatcgctccactgcattgcagcctgggtgacagagcaagactctgtctcaaacaaacaaacaacaacaacaaaacacacacacacacacacacaaactctaaaatattttgcgccttaagggaacacgattatggcacctgagtcacatgacaggcagtcaaaacctttgtttatctgattagattggccttccttacctgccttacctgccttgttttgtaaatgctgtaaataactaaagagtgtttagtgatgttgcactatggaagggaagactccttccttctttatttacttactgttttttttttttttttgagatagagtctcgctctgtcgcccatgctggagtgcagtgtcacgatcctggctcactgcaagctccaccacccgggttcacaccattctcctgcctcagcctcccgagtagctgggactacaggcgctcgccaccatgcccggctaatttttttttgtatttttaataaagacaggttttcaccatgttaaccaggatggtctcgatctcctgacctcgtgatctgcctgcctcggcctcccaaggtgctgggattacaagcatgagccactgtgcctggccctttatttaccgtttttttagagacaggattttcctatgtcacccaggctggtctccaacttctgggcttaagcaatcctcccacctaggcctcccaaatgggaattctcattcactgttgtgagagtgtaaattgcagtgaaattaagcatctgtgcatcctaaaaccaagcaatcccagataaatttgcactcttaaaggtcaggtatgaagatgtttgcggaggcattttttgatatttttgatagcatgggttcaaggtacttagatgttcactgggagaacaggtagcaaattgtggtggctatcactacagaatacagtgcaacactttgagggaatgaactatgcacatctatatagtaacaaggacagatttttttttaacatgagagtgtaaaaaaaagaaaaagaaaaaaaaaggccaggcacagtggctcacacctttaatcccagcactttgggaggccgaggcgggcagattacaaaaggtcaggagttcaagaccagcatggccaacatggtgaaagcccatctctactaaaaatacaaaaaaaaaattagccgggcatggcagcaggcacctataatcccagctactcgggaggctgaggcaggagaatcacttgaacccaggaggtggaggctgcagtgagccgagatcacgccattgcactccagcctgggtgacagagggagactctgtctcaaaaacaaacaaacaaaaaacccaaagaggtctaaagtccattgcattattcccagcaattcactcccttctaccagttgtcataaaacttgcaatgccaatactcgcaatggatatatttcctcatcccattgttgagtttagttatcatgtgtgggagcagatgtgacacatgccaattcaagctgaagttttaagaaacatcacaaattctgcctattttttttttactattccttttgcaagaaaatatagcatgtccctcgccagtatgttccttcagcccagatcctaaagtgagaagatggaggaagagaacttcagtctccacccacaattactggtttttaggattttaaattttaggatttttttcttactgctgcaagtctaatacaagcttcatgtcagaatatcatttataaaaattaaaaattagaaatacacatgcaaacaacataaaagaatacatatatatccaagtgcatatttcagttacattagagtggatgcctattaccaggggaaggaataagagtgggaaatgggatacaggaaataaagaaacaaacaagagagacacctcgcacaggtcgatgatgatcagtgttaagaactaagcagtagcattaactcgactctctgcatgtgctgtacaaagacaacaaaaacctctggagtgacaagtaactgttggagaaaggtcctgggggacttggaagaggagggaattcacaatccaggtagagaaaatcggccttgggatcacctcctcgttctgagagagaagctgagagaaaggcttcttagggattctgttttcaatgtaacctgtaccaaaggtgttcttccaagtgtgagtgagaaaggggctcaaagagagagagataagagaacaataaattacttttctcaaagaactcatattctttttttttttttttgagacggagtctcgctctgtctcccaggttggagtgcagaggcaggatctcagctcactgcaagctccgcctcccgggttcacgccattctcctgcctcagcctccctagtagctgggactaccggcgcccatcaccacacccggctaattttttgtatttttagtagagacaggctttcaccgtgttagccaggatggtctcgatctcctgacctcgtgatctgcccacctcagcctcccaaagtgctgggattacaggcgtgagcccccgcgcccggccaaagaactcatattcttaatgaaaagactaaaatgcccatttttgtatttcaaatcctactcatctatcaaggtctaggccaaaatttacctcttccggaaagatcccccctggattcccaatagctctaccctaaataaatctacaaatcactcctcttcctgctgaaaatccatagcatttattatgttaaattgcgcctgtgttttcttttccgaccagactgaaggatccttgaggacggcagtacctggcatacctacacagtcagcgttcaacaagtgtttgcaaaggtacatgataattaaaatgtcagataaccaattataaaaaataaattggcctgcacggtggctcgtgcctgtaatcccagcactttcagaggctgaggcgggtggatcacaagggcaagagttcgagaccagcctggccaacatggtgaaactccgtctctaccaaaaatacaaaaattagctgggcgtggtggtgggcgcctgtaatcccagctactgggagactgaggcaggagaattgcttgaacccaggaggcagaggttgcagtgagctgagattgcaccactgcactccagcctgggcaacagagcaagactccgtctcaataaataaataaataagtcaacagatcagatagcatttcagaagaggctaagaacatgttgaactgttcaggaaagactacatggaatagggccttgaaagaagggcaggaatcagctaattagaagacaggaagagcatttcaggccaagggaaaatggtaaataaacacaaagagttagaaggattggagggagggccaggtgcggtggctcatacctgtaatcccagcactttgggaggccaaggcgggcagattacttgagctcaggggttcaagaccaacctattcaacatagaccacatctctacagaaaatttttaaaataaaaaaattagctaggtatggaggcccacacctgtggtcctaactactcaggaggctaaagtgggaggatcacttgagcctgggaatttgaggctgcagtgagccatgattgtgccaccgtactcctgcctgggtgacagagcaagatcttgtctcaaaaaattttttccaataaaataattttatttatgttcataaatgtattagggaaaatttaggatatgagtttcatcatcatgggagtgagaacaacttcctaagtaagatagtaacctggaagccataaacatatatgtatgacaagtcacgtaaataaaattaagagagaaagaaaagaataggaaaagacattttcaaaatatatacaaaggacttattttccacaatatgtaaagaaactattataaatcaatataaaaaagacactcaagatttagcaatttcccatctggcatgtaaaaagcttgcaagtcatcgccccagcctaacaataagtaaaaacctgaacaaactgaaaaatcaacacccttcttacatccaccagagtcatgaggccacagggcaaaccactgcttcctaaattgcagagacaggcaggcaaatgcagggaatcacagcttaccagagcagaaacccatgagcaggaaccagtaccagggtaccaaaacctgagctgtaattgatgaattgctggagactcagtatggacaactctgagaattaaaaactccaggggaagccagtcatgggaggacctcacatattgtgagttttacctcctagagctcaccaggttctcacagtaaatatcagaaaaatatcccctgtgcttctggctgggggaaggaaaagtaaccatttctaaatacacctaagcattctgttcttcttaacaagtcctgttctctcaagagaaactattttgccagaacctaagcttttattattactttttttgcagagtctatccaaactaggggaaggaaaatatccagtttcagcccgctgtagcctttacattggggaagggaatattaaattccatcccactctaaccatcctatactacctaaggagtggaaggattgagaagcttttgcgaggtgcgcagtccagaggcacaggctcactaaatgacagagacctaagcatagaactatagaatgcttcctcacttcttaacaccttaacacattactaaatgcctatttacagcatttctttttgtctaatacatcatgcctggctatcaagaaaaaactacaaggcacaccaaaatgcaaagaagacagtttgaaaagtcaaaacaggcaccagaaccagactcagatatggcagggatattggaattatcatactgggaatttttaaaaaactgtgatcaatatgttaagagctctctctaatgggtaaagtagacagcatgcaaaaacaggcaatgttaacaaagagaaaggagaagcaagaaatgctagagatcctgctccatcaatagcactacgacgaaagaatgcctttgatgagtttgttagtggactgggtccagctgaggaaagaggctctgcacataaggctacctcaaaagaaactttcaaaactgaaaagcagctagacatgatggctcacacctgtaatcccagcacttcaggaggctgggaggattgcttgagcccaggagttcgagaccagcctgggcaacatagtgagaccctgcctttacaaaaaaatgtattttgaatcagccaggcatggtggtgcacgcttgtggtcccagctactcaagaggctgagatgagaggatcacttgagcctgggagactgaggctgcaatgagctgtgatcacacccttacactccagtctgggcaacggagcaagaccctatctcaaaaataaaacgaaaccaaaactgaaaagcaaagagaaaaaagactagaaagaagaaaaagaataaccaagaacggcgggacaactataaaaggtataacatgtataatgagaataccataaagagaaaaaatagagaaaggaacagaaatatttgaagcaatgactgtgaatttcccccaaattaatgttggccaccaaaccacaggtccaagaagttcagtgaacaccaagcagattaaatgacaaaaacgaaaccaacaacgacaaaaacactacacctaggcatatcatatttaaaactgcaaaaaatctaagacaaaaaaaaaaaaacgatattgaaagaagccagcgatgagaaaaaaacccttacttatagagaagcaaagataaaaagtacatctaccggccaggcgcggtggctcatgcctgtaatcccagcactttgggaggctgaggcgggtggattgcctgagatcaggagttcaagaccagcctgaccaatatggtgaaaccccatctctactaaaaatacaaaaattagccatgcttggtggcgtgcgcctgtagtcccagctactcgggaggctgaggcgggagaatcgtttgaacccgagaagcggaggttgcagtgaacagagatcgtgccactgcactctagcctgggcaacagagagacgatccgtttcaaaaaaaaaaattatatctaccttctcctcaggaactatgcaagcaagaagaaagcggagaaaaatatatatattttaagacacggtcttgctctatcacccaggctagagtacagtggcacaatcatggctcactgcaaccatgacctcctgggctccagcaatcatcctgcctcagcttctgagtagctagagccacaggcacacaccaccacacctggctaattattttatcttatttttgtagagacaaagtctctcttttgtagagaagggcccaggctggagtaaaatatttaaagtattgagatataaaaaccactaccttagaaatctgaaccatgtgaaattatcctttaaaaatgaaggtgaagtaaacactgtctcagacaaacaaaaaataggagaatttgttgccattggactggccttgccagaaatgttaaaagaaattctttagagagaagcaaaataataggtcagaaacgtggatctacttaaaggaagaaagaacatcagagaaggaacaagtgaaggtaaaacaaaaacttttcatattcttaattgttctaacagataacagtttgttcaaaataaaaatagcaatagtatatttgattatgtatgcttatatatattcacatgcttatgtacaagtgaaataaatgacagaaataatacaagggattagagggaggaactagtattattttgttattacaaggtactcaccctactgatgaagcagtatagtattatttgaaagtggatttgggttagttataaatgtctattctgaccactaagcaatgtaaaaaaataagtataactaatatgctaagaaaggagggaaaattgaatcatatgaaatgtttatttaaaaccacaaaaggcagataaaagagcagaagacaaaaataggtacaaagtataaaagcaacaacagaaaacagtaacaaatatggtagatataaatccagctataggccaggcgtggtggctcacgtctgtaatcccagcactttgggaggctgaggtgggcagatcacgaggtcaggagatcgagaccatcctggctaacatggtgaaacccccgtctctactaaaaatacaaaaaaaacaaaaaaaaattagctgggcatggtggcgagtgcctatagtcccagctactagggaggctgaggcaggagaatggcgtgaacccagaaggcggagcttgcagccagccaagaacgcgccactgcgctccagcctgggtgacagagcgagactctgtctcaaaaaaaaaaaaaaaaatccagctatatcaataatcactttaaaccacaatggtctgaatacaccaatttgatgacagagattgtcagactgatcaaacaataagacccaacaatatctgttgtctataagaaatcaaatataaacaaaaacactattttcatctgttttgctgccgtaataaaatagcacagattgggcagtttataaaggacagaaatttatgtctcacagttctgcaggctgggaagtccaagatcgaggtgctggcaggttccttgtctggtgagggccaggtgtcttgaatgctgaatcctccagagtggaggactgctggatcttcacatggcagaagggcaaaaaggataaactccctctgtgaagcccttatataagggcatctaatcccattcaggagggctccaccctcataacttaattacttcccgaagaccccacctttcaatagtgtcacattaatagtgccattaagtttcaacatgaattccatgggggatggatgggtgtttgtttttgtttcttagagacagggtccccctctgtcatccaggttagagtacagcggtgtaatcatagctcaccgcaagcctcgacctcctgggctcaaggaatcatcctgctttagcctcccgagtagctaggactacaggcatttgccagcactcctggctaagtttcaacatgaattttagaaggtacacattcaaattttagaagggatgcattctgcctctggcccccacaaagtcatgtccttcccatgtgcaaaatactcattccatcccaacagcccccaaagtcttaactcattccagcatcaactcaaaagtctaaggtccacagtctcatctaaatcacatatgagtgagactcagtgcatgattcatcctgaggcaaatttccctccagctatgagcccacgaaaccaaacaacttacatgcttccaaaatgtaatagtgggacaggtgtaggacagacgtttctttttcttttttgttttttttttttcgagacggagtttcactcttgttgcccaggctggagcgcaatggtatgatctcggctcaccacaacctcctcctcccgggttcaagtgattctcctgcctcagcctcctgagtagctgggattacaggcatgtaccactacgcccggctacttttgtatttttagtagagacagggtttctccatgttggtcaggctggtctcgaactcacgacctccggtgatctgcccgcctcagcctcccaaagtgctggattacaggcgtgagccactgtgcccagcccaggacttacatttctagtccaaactggagcaatcagaaagaaggagtaacaggtcccaagtaagtctaaaacccaaggcaaacaacgttaaatcctatgactggagaataatcttctttgactccatgtcctgccttccagacacacttcccacaagcgttgggcccccaagcccctgagcagccccactcccacagttttgctggaaccagcctacacagcagctcttatgggttggaatagggtacctgtggctttcccaaggctggcattgcaagtccatgcctcaacgggtctgaggtctcaggggtggtcctgcccccacaactccactaggtattgccttcgtgtggggatctctgtggcagccctgttcctgcagcaagtctttgcccgggccctgaggttgtctgaggcatcctttcaaatctagatggaggtagccatgcctccacagctcttgcactgtgcgtccctgcagagttagcactacatggacgctgccaaggtttatggcttgtgccttctggggcagcagccccagctgcacctagacccacatagcaaagattttaaatggccctgggcaggaaatcctgaggtctcacaggtgccctaggcactcccccaataacattctgcttctgaggccctaccactcaaagcctgtgatgggcacaacagccacaaagacctccaaaatgtctttgggtcattctcccattgtcttgatgaataccacctgacttccttctatccttattaatctccttaccaaacagtcacttggccacacctttggttttctctctaaacatgcttttttattctttacatgacgaggctgagaattttccaaatctctacattttgcttctcttttttattaagaaattccaccttaaaatcgtttctctgcttgcattttactataagcagttaagagaagccatgtagtaccccgagcactttgctgcttagctattccttccaccaaatatcctagttcatcactcttttttttttttaagttccgggatacatgtgcagaatgtgcaggtttgttatataggtatacatgtaccatggtggtttgctgcacctgtcaacccgtcgtcatctagattttaagccccgcatgcattagatatttgtcctaacgatctctgtcccctttcccccccaacccccgataggccccggtgtgtgttgttcccctccttgtgtccaactcccacttatgagtgagaacatgcagtgtttgtttttctgttcctgtgttagtttgctgagaatggtggcttctagctgcatccatgtccctgtaaaggacatgatctcattcctttttttttttagtttgttttgttttgaggcggagtctcactctgttgcccaggctggaatgcagtggtgccatcttggctcactgcaacctctacctcctgggttcaagtgactctcctgcctcagcctcccaagtagctgggattacaggctaatttttgtatttttagtagagacagggtttcaccatgttggccaggctggtctcaaacacctgacctcaggtgatccacccacctcggcctcccaaagtgctgggattacagacttgagccaccacacccagccaatctctctctttttttttttaatggctgcactagttcaccactcttaaattttgccttccactaaattctaggacatggacataacacggtcaagttctttgccactttgtaacaaagatggcctttcctccagtttggaaattgtttcccatttccatctgaggcctcatcagaatagtcttcactgtccatatttttaccagcattctggtcatgatcacttaggtaatcattaagagagaagctttccctatatagctcttcttttctgatcctttagtgtagtagaatcacccttaatactccattcacaccaatgtaagtttttccatcattcacttcaaaaccgttccagcctctatccattacccaatttcaaagctgcttccagctgggcgcggtggctcacgcctgtaattccagcactttgggaggccgaggcaggtggatcacgaggtgaagagtttgagactagcctgaccaacatggtgaaaccccatctctactaaaaatacaaaaattagccggtcgtggtggcgtgcgcctgtaatcccagttactaaggaggctgaggcaggagaatggcttgaacccaggaggtggaggttgcagtgagccaagatcacgccactgcactccagcctgggcgacagagcaagactgtctcaaaaaaaaaaaaaaaaaagccacttccactaagaccaaaacaatgcaattctccacaatctcttccagaagacagaagcagaggacatacttcctaacttattctataagtccagcattactctaataccaaaaccagacaaagacattatatgaaaactcagactaatatctctcatgaacacagatgcaaaaatccacaaaatattagcaaatcaagtccaataatgtataaaaagaattaggcaccatctgggatttatcccagatatgcaaggctgattcaacatttgaaaatcaattaatataacctgtcacattaacagtctaaaaaggaaaaatcacatgatcatatcaataaatgcagaaaaagcatacaacaaaaccccacacccattcattaaactctcatcaactaggaatagaggtaaacttcctcaatttgattaaaaaacaggtacaaaaaccctatagctaacatatttaatgtcaaacttactaaatcagagtgttatcattgcatggtggaaactcaggttgctatgcaggggtgaaggtatttcatcagaaagaaaaataactcagactccagaattgtttctaatcatccaacaatcatatattgttcactattctaggagttgtaacacttctcagtatgttcaggagaaatgacaggagtaactgtctcattgctaaataatttgtgcacagtggggagtacagtgtcttgaccattaattccacaaagctgctatgagcagaggcacgatggtcatgttgacatgaaccagggagtcttaaaagggtagatggttgggaaaaaagcgagggtatgacgacaggcataatcagagaactcaaaagtgatgtcaaagttaggaactttgaactgaggatctcaaatcacagtaacggataagattgctaaggtagtgactctccaagaggttcatagtaatactaagctgttatttgttcatgtttccctcgttctgtcatgaatgtacaatggagctttccagaggctacattatcacaccagactgaatgtagaagcacataagagaattctgctattaagccggacattaaagatagagtatttgcaaaaatgttaaataatgccactcttttcatgctttttgttttggaaattataggtattttcccataaaaatatggtattaatattaacaagtattggggttattatcgctaataataaaaaaattaaaataaatatttttaaatgtttccattttgatctgataaaatacattttaggccaggtgcagtagctcatgcctataatcccagaactttgggaggttgaggcaggaggattgctttagcccaggagttcaagaccagcctgggcaacatagtgagaccccgtcactaaaaaaaattttttttaattatttaggcatggtggtgcatacctgtagtcccagctaatcgggagactgaggagggaagatggcttgagcccaggagttcagggcaagccatgatcgtgccactacactccagcttgggcaagagagcaaggccctgtctcaaaaaataaaaataaattaaaatcttatattttagagcagtttttagatttacagaaaaattgcaaagatagtacaaagtgcccatatatcccagttttcccgattacaaacatctttcttacactacaaatgtatggtacagttgtcacaacagtggaccaatactaatatattattattaattaaagtccatactttgttcagaacgcctcagtttttccccagtgtcctcttccttttccaggatcctatccaagttataatattacatttacttgtcgtgtctccttaggcgcctcttggctgtgacagttgctcagactttccttgtttttcatgaccttgacagttttaaggagtactagtcaggtattttgtagaatgtccccctggtggaatttaccaggtgtttttttcttgattagaccggggtaatggggaggaggaccacagagggaaagtgttgttttatcgcatcatatcaagagtacatactatcaacctgacactggtatgttgaccttgatcacccagtgaggttgtatttgtcagctttctccactgtgaagttgcttttcccctccacactccctgtctgtacaatactcttggaaaaaggtcacgatgcatagcccacacttaagtagtagggagttgtatgtcacctccttcagggcagaatacccacatacattatttgggattctgtataggaaatttgtctcttctcctccatttatttattcattcaatcatttatttgtatcagcatggactcatgggtatttaattttatgctttgggttacaatcgaaaactgttttgttttgttgcccaaattgtccagctttggccactgggaacttttcagttggctcctgagtttatgttaatttttaatatggatagctattacccacataaacaaaagctctttggggtccttgataatttgtgagtgtaaagaggtcctgagaccaaaatgtttgagaaccaccgctctagggatcctctggctgacccgaatccccggtgtgtgtgcgcgcttcgtctgcaggtaggagttgtggtctggacagaagcaaagtaggccacactcgcctgcccttgggaacacccacttctccgtgccacgcccgctcctaaggttttcttcgggcagaaacgcggggatccccaagaagacgaagctcaggctgccatgcctttcccgcgaacgccacggcgcggcgcccggttcacagggcgagtcgcccacccgcgagtcggaaagcgcccggaatcttggctaaagctcagcgttctcctccggggctggggccctggccaggcctggcctgagtggtctcccctcactctgcggctcgctctcccgggctactccggcgcgcaggtgctgcgcccgcgggagagagcgatcctgcggccgtggcggacgccgggaggagccaccgggctctcctctcaggagcgcgtccccgtgccctccagctgcccgttcctgctgaaagcatccggacagctccccgggccgcggccctggggcccgccagagccctgccctgcaccccgctctcccctctctggcccggagggctgcgccgggcagatcctttcctctgcaagacagagacaagcagcgataaacagctaaagctggagacccggctaattgatacaataagttctctaattgcctcgaaaataaggtaatgatttggcagagggaatgctttgatcttatcaggcaagagagacctctccaaaggaaacctcagagaagggctggaggcctcggacttgggggtgtgaagcccaaggacagcctgctttccccgccctcccccgaccctgcgtgtccacggtccccagcctcaccctccggcttttcatggaaagacccttctcctgtgatgactggaggagagtacacacacataacacaggggttaggagaggaggagggggtgggttctgggtttttcaggaacaggaggacggctgaaatgactggtgcagttttagagaggctatagagaaggaaattgggggagaggggattgcggacagggattatggaaaacctgacttggctcaagtctgatgatgtttcttacacagtgagggctgctgatttgagcttttcaggcaggagggagtgacaaagggaggagaactttgagtgtcctgccttctccaagaatctgcacacacactcacacacacaccattgctctgcgctgtgggtgtccctgcctggcagaggccccagcacaaagaggattagagagatgagctaatctggtttgtatcccagacatggccccagaaagggaccttgtccaccctgatatgtaaggatgtgaaggagtgaggagtctttctttgggggcctgctggctaacagtaccagagaccccactccactggagtccctgggatactgcagtcctgacttcagggtcagatttaggaagcagaaagacggtcggtcccacagaaggaactagatctctaccctacttgtttcaccagtggggaaactgaggcctgaagtgggaaagtgatttacagagtcatgccaatagtgcatggctgagttgggggaaaaaaccctcaggttttctgactttttactggtccagtgctccctgcactgtgttgcaggagctgcaagggagaggtatgagacagagagagggcaagagaaagagagagacgaagacagaagcaaacatacacaccaaggaaaatagaggtgcgcacacacccacatgcacagagagacggagaaagccacagagagtcagaaacaacatggagagacagatggagagagtgaagaaagagcaagacaaacggtcatacagattcatacagagagatacacacggagagacagggagtgacacaatctgacagggagacaggcaagagacagggattcagaaagagaaggacagagacattcagacagggagggggaggcaggccaacttagacacatagagagacaaatgaagacagggagataaacacaagagacagatgcaaatagacagagaatgacagaaacaagagccagagagagacccagggagatggagactcagagaagagacatggggagagtatgagaacaagaggcagcgtgaactgaggaaggcagagtgggagggaggcaggccatgccctctgcagatatttgtccattggaaacaactctcacttccagatcattctagggcccagaacaggtggtagggagagaaagagggcttagtgcttagcctgtgtgatacaggcagactgggaaccctcccttggggagaggctggtcagttgaccacccaggatcccagcagcacacccactggcctcacacagaacctgggccacccgcccggaatggccgtcagcccgcccactgcctggctccagtctgattacagccaaagtgccaaaaggctccagacacccccattccctgcccccatcgtctcacctccccacgcctcctctcctccttccccttctcctttacatccctctcttcctttcttcctagtcctcaggggagcagtttgtgcccctgtttagccactagctgggaggaaaggggttctcctccatcaagccccctttcctggtttggagctggatgctccttccctccaaagcccttttggtctggcctctttgagacacgttccacgcctcgcctaagagctcataaataccaaggagaggccggccaggctgtgtacaaagcgtggatccccactcttttccccccttaacagctcctgggttcttcccaagcttcctttacttccccagacacctgcatggggtggcagggcaagaggtgaggcattagttacctgtgtgaacctggccctatttcaaataagacctgcctcggtttgcaaagaaatctcaggaaaggcgtctcagggccccttgtgcaagcagcaggctcaggaattccttgactcccatccaaacctccccccagccccttcttggcctttctctctgctcattaccatccacaccacctcccacccaccgggaaaaagagaaggtcatcgccaaaggggcccagggaaggggagccttctggaggatagagcagggtggggtaagagctgtttacccacaccccagctccccttagctcatctcccctcccatccaagggccagcaaaaattcaaaatcattcagccacgcatagctgagaacagagtgaaaagaaatcttaactctgtcccaccagagagcagagcataaggtgacatcaagggtgacagtggacccttcttctttgggcacccacttttgagaggacaggaggaggctctagtgccactatggggaagagggtggacctgactctgctggctgggtggaagctgtcctgctggaggccccaggtaatctggcagctttcaggggacctgggattcttcctcaggtctctactgatactgttcactatgtctgcagcatgcacccttgaacttcagcagagcctagtgtgccacccacagacggttttattatatttccatgaaaatgccttgggagtaatgccttttgctccttgttatttaggataccctggccagtgttgggcacacagcaggtgctcagtaagtgctgacttgactccatgcagggttctacagaccagaacttaactctgagatcagtgactcctccctctggctcccagaactgagagtgagagtgtggaataaaatgaagatgcaggtcaggagctagcttgagcctctggccttgaccctctgcctggcagccccacaacaagcctttgcgtgaggagctgagctctccagtagtgtctaggaccttgagactggaagtttattttgagatttgaagctccaaagaggcagatcccagaaaacctcttctctggctccatatttgttctctagttaagtggttgagtgcagctcttgcagtcagctggctcctgcagcctgggattcctcccggggaactggggactcagaggagaggggacaaagaagcagaaggagccaagcctcatcctaggttgtccactctgggggcagaggtgacttgtaaaccttagagagaagtctagtcccctcacccacttccttccctctcagagctgctgatgtttctggctgtacccccctcacccctcccttcagctcagaaacatgctttaaaattttttttatttctatttatttattttgagacagggtctcactctgttgcccaggctgggtgcagtggtgcattcatgcctcactgcagccttgacttcctgggcgtaaacaatcctgttgcctcagcctctcaagtagctgggaccacaggtgtgcatgaccacacctggctaatttaaaaaattttttgggtctcaccgtattgaccaggctagtctctaactcctgtgctcaagccatcctcccaactcggcctcccaatgtgctgggattacaggcgtaagccaccaagcctgggcctcaaaaacatgctttaatacttgagcatctgtgttgtgccaagacacagtcccacttgactgtaaagacagctcaggccaaagaaggggcctcagaagtgatttgggggcccatgtgggcgagtccactctaggttagggctgatgtgatcatcttcagccaactttccccctccctgcgctttccaccaaccccaggccctgtgtagaaataaacacagggccagagtcacacccaggtctaaacacacaggggagtctgggagaggctgctggagctccaagactgccctgtgtagggatggggctgggttgggaggaggtaaaagagtggtccaaggaaagaggcccagccaagaaggagcctgggctcattcctctcccacctgcccctctcaggaaaactaagcacagagtctgtgcctttctaaggaaatagccaggccaactggagcccacccgacaaaaagaaagggagagaaggggaagaaaataagttagcctgttggccacaaaggatatggtcccagtttctgtgccaggaagtcggccctgagaagtgtctgtattcagtcctctccaactcccatccaactccagcccagcccccactttccacccaagtggggagcactgcctcccattcatgacttggagcacctcagggactcatctgaattctcttcctccacgcactccgctccagctggatggccttctcgataaccctcgtacaccagcccactcctgcctttgggtccctgtacgggctctgccctcggcttaggatgctcttcaccaggaagctgcctggcttgattccttgcctccttcaaatctctgcttgcatgtcaccttaatgaggcctaccctgatcatcctagttgcaactgtaaccatccccttgactgtgctctctttaccactgcacttactactttctaacatactctgttttacttctgatgtttattgtttatggtctatcctcctgcaatagaaggcaaactccatgagggcgtagactgttcaccaatgggtccctagtgcctagcacagtcctggcatgtggtaggaaataagtatttgttgaattaatgaatgcactcatcaccttaccacagaaagtgggggtaaaggagtgtcactgtaggttggggacaggagggaagtgcttgcagccccttcccactctgcccgcccacagaagttggggctgcggagtgaggggcgctaggacccggaggcggtggggagagaggttaaaggttcctctgaaaccttctccactatctctgtctctgagatgtctgcagccagctgcaccccatctgcttacactcgggaggcacctctaacgccaccaccgccccccacccccaaccaaagactgacagtgaatttggagttgggggcatcggcagttactagtaagttgtttaccccaggactttaaaatcatatgaggaggcaggaaagacacctgcgaggtgggagaaactgaggctgaagaagcgactggagccagatcccaggtgaactctgaactctcgaagttaagcccaggattttaaaaagaattttacttctgacggagggccacagtgcccgcagggcccgtacctgctatcctgggaggtttgagggttggggtggtggggagaggagagtctctttcggcagactgcacctccccaccccttccctatttaccacgcccccaggcgctgtgcgggcggagggagggtgaaggagcagtggggaggaggcagggcgagaagacgaaggagggaaaaagctccagggcttccactctctcggcaggacccccaccctggcctctggtgcgggaaaacctcccagctgtttctgattctttcatactctcagccccgcccgagagggtggaggaccgaggcacagagggggagcggggagagactgagctccgctgagcccaggagtaaggggcggggagtccgcaggtgcccccttagcgtcggcagtcgattcccggtccgtaaagaaaagcacccgggccgggcaggccgggcaagcaggagccaggtctaaacgtgatgcattgggggtggggggtgcagtggctcagaagaagcaggggcgatgagctctagctgaaagcatcccctgctagaagccgactgcccacggcgctcctgtaggcagtgttgaaaaggtagttaagacctccaactcccggtggcagggactctacccatttcacagaagcgcaaggatggaggaaatgagtgcatcctccgtgctcagcgccggtgtcactgtaggttggggacaggagggaagtgcccgcatccccttcccgctccgccagcctggccgtcacccatagaagtggggctgctgagtgaagggcgctaggacccggtggcgcggtgtcggcagggactgggcgcttggggcgcaggagggagccgcggcgtcccgtcgcagcgtgcgggagcaggtgggggtgcagcgcggtggcgcgcgggagccccgaggggcggaggcggctgctacacctagggcgtcgcggagcgccccgggcttggcgcgggcggagccgccctaagggccgcgcgtgtccccggcctcggccccgccccgtcccgtccaatgagagcccgcggccgaaggggctgtccgcacactaggcccgcagctcccttcagcgccgcagaccccctgacaccgcacccggtcctcaggcagcgcgccccagaccccgggttcggcacgccgtcgtcggcttccggacatcgcaacttgcgcccctctcggggatcctcctcccgggctctggaccccaggtgatcctaggtccccagccgccggcgaacaccatggccccccaggggggtgaggtaggagcagcctgagtacccccagaaggtgccccgtccacgcccctccgggctgcgcggcgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtaagtgtggctctcaggctgggcgggtgaggcgcttggtaggagaggccggaggcgcctggagggactggctgctcacgggaccaggctgttgcttcgacgggttggagacgattcgggcaggactgtcactgaaatctgaagtcgcggggtggcgggagggtgaggcgccgcgtcttacacgactggtgagaaaggcgctgggcattcggagcaaggatgcccggtggtcgcggctccttaggcctccacgtgctgtaccccctctatttcagctcaagccccttagggcagaagctaccttccgagtttccctcagggtgagttcaaggaacgaataaccttccagggcccgcaatagcttcgccagggccccaatcgcctaaggtcgccctctgagaggtggagaaaggggcagctcgctagtctagcccacccataccacaggaaggctttggtgaggcagcagcacccagccgaggcttagaaatggaatcgaggcaaaatttaccccattaactcccacaattaaaacaaacaaaacgcatgggtttgcattatctaggcatttgtcttcagccaccgttttgaggatgtcacttaggaaactttgcctccctcccttcttcctattctttcccatctcccatttctcccctccaagagccagagggctgcggagtcccaagatactaagagaccccctccccagatttcttgcaggccctagactccagacacttcacaagagggcagatgaggcaaaaaggcattacagatccactggatgtctcgtgtctgttctttttagaatcctccctgccccctactccttggatggcactcatcaccttcccgtaggagaaggagctgctttcccttcttccccaccatggggagagggcaaagcagggagagttgaacctagaaaagactcagtctttcctcttcaccccacaatcaaactggcctcttggactaggctattgcccctctccaccaggcagtgcctcccgtcctttccttactccgttcttcttcccgtgcaagcccccctccccgaaatgtggtctcttctctccttgcaccctgtggcttttctcctcttgacttggaatcttggctgaagggtgaggggtagctggccgaggggcccgccagcttgggctgcagattcctatcatttcaagatgccgtctctccttatcccaacccccaccccctgttttcctgtttcagaaaaatctcttttgaattttttttttttaaatctctgcagtgttggggaaggcaaggagggggggttctggttgggggaacagagaggcctatatcttacatctggcttgaaacattcttttagaaagggaaaggggagaagggggatgaggagaaaaacctttcaaagttctgagtgagatcaaagctaccttttgccttcatgagcttggtctggctggggacttggcatcttcagggtctttgttgagacaacatgaagtaaccgctgcccatctttatctggctcagacagcagtttgctttttgggactcttgattgcttcttaccagtttgggatatagtcttggggaccaattggtgtttgggtgaggaagtgtcactctggtaatttcagcatcctggcagtggttcctaaagacccaaatgggggtcttcctagttcccattttgtactcttgactactccctctcccttttcctttctccctctactaccctcccctgatgtggttcatattaaagattctggaaaaattcctgggtgaaagagctagggagggagggagggagggaggtgacacagagtgacttagcagcccctgtgaaaaggaggaaggctgcaacagggccaggttgggaagtgggtacagaggttgtttcagcctccttgctccacacctgtcatagctacaggcccagatgcctgcctcagtgatcaccacttgtgggataaggtgaaaagctaccttctaagggcaggctaagcccccaagcctttctcttaggaaaaaaccagcaagattgatgttctgtacaacccgtggaagagaaatgcctgttgactctggtgtgtccatgttccactctggagcagaaggccatcattttcaccagttaatatttggatttttctcatagcttgagattcttccccttactctctaaccactgccctccctctatctatcctaaacagaccaagaaatagggagcttccggcatgtgctttcctgtttcattttgcattctgtagggggttggatgtagggaatcacaagaacaggattgtattcataggctcacaaagggagagaaacacaaagtggtatcatattgttagcactacttttaccaacagcagttgcttttaataagcccttactgagcttcaggcactatggccaaacaccttatgagcatgatctttgtcaatctgaaataatccagtgagatgggttctattatcatccttatttcacaaatgaaagtgagggatgctgtggcattaagagcagattcatggaggctaatagtgttatctctgtgttcaaagttctatatgtgctgggctgaatcatgtacactaggggctgtacacgaaaggaggaaagaaaaaaaaaaagcagatccctggcccgtttgtgtctttaacatacaaacataaaacatctgcagataggctggcaactgttgacaagtaaagctgtaatggaaatgggagttaatggctggctagagggagaagggagttggggataaatcagaacagttaggtgtttattcaacaaatagtgattgcatacctactatgtgccaggcactgttctcagtactggggatattgaattgaacaaaaccgacaaaaatccctgcctttgtggagtggtgcatccaaaccatgtgaggatcatggtgaaatgcagattctgttacggtaggccttgggtggggcctgaatgtctgcatttctaacgaatccccacatgatacagatactgctgttctggggaccacactttgagtagcaaggggctagagtagtgtatgcctcactttgtcaaatgaagggatgtgaattggccaaaagcaggtgaagagaagcattctggggcaggaagctgggaaggaagtgaagaacttccagaagggaaaaacaaagctagagtcagggcatctaacactctaccagaccgtgaggtgggagatgccttaaatatctttgtgtccctgacatctgagctcagtgcttggcacatggtagacattttgcaggcatgtgttgaactgagaggaagatgtggttagcctcaggctcagctttattggaggctccctacactaactacaaggggctgactactggagagcaagcaagcgccatgctctgtggagtcttgaagccattacttagtggagtaagggtggtaatagagacatttaattatcttcccatcttagatactgaacagatgttcccacactcagtgaggatgtaataaaaaggacctatgtgggctgcagcagaatggatttaagtcagaccacaagaaggacttgttgcccgagtttggcctgccccactccagactgtctcacgagggctgggttattggtctctcattcccatccaaccctcctcacccaagccccattaaaaaaaaacaaaaaaacacacccattgcctagagcagtacttgggctgaactagggaagctgaacggtggtgagacagggacaagctccaactccaacggtcttgattctccaaacaaagcaccacagcagtgggtgtaactctgggctgtgcgtcaggcagcctttccggcctggccctgtctggggtgtttattttgtttgttcctggaagctgttgccctgatggacagtgctggggatgctgattccatgggatttgttaggggagggccagccctctcaccccttccccgggacagatgggccccatcagccctgctgagttcccgaagaggcaagcatcagccctccttgtgtttgtttgagttggtgtcaccagtggtgatccagtctgtgggtgagggccggctgtgggaatgcaggggggtggtggggggggacacagagcccagggcagtctagcttttcccctccccacaccagctgccctcccttctcctcacccacttctaggcccattttggggccgttcccaaaccacaggctcattcatagctcaaaccaagtcttttctgtctgcagtaacaattgctctccatggccccacctgttcaaaacaggggagggagggcagccctttgatgcgttctggacaggagaataaaaagttcccagcaaatcaaggaaggtgctatggggttaaagggagagaaagagaatgacaagtggagctgggctgttgagctggaggaagtgggtgaatgggtcagatctcatttggtggcctcttggggaagaagggtgatatactcctgttttctctctgaaatattcttcctgaggcttgtggtgggatccagggttaaaactgagtgaagagaaaatattgccttgagaaacaataatgactctggcaacccacctattctttagtagcccatctcaattgaccttcttttaattgttcatattggacagactggagactgcagtgtggggagagtcatcctcttacttatcttggcctttggcttcccactgcagacagcccttgcaggtccatccaggttggggaagatggttttaaaaggttcattagttaagaaaggccctggggcctggaaataaagggtttgaggaggagagtagagggtggggtcttcctccccggacctcacgattgggaatgaggattttttttagctacacgggtctgactagagctgtaaacgttactcagattgctcactatgtctcttcccacgagcccctccctgtcaccacccccctgctgtcaaaccatatcttcgtggaccagccatgcgggacatccctcttaatgggagcataagagtgttgtctcagacccttattttgttagtttatgtttccatgaagctcttaatgtttattaaataaacagacaatgagtttgtgtgacatgcccacagcttctgtgtatgtgacacatgcctagcctgtgttctgggagtgtatgtcactttggcctttggctggggaactggtgatggtgggaggccactcaattactctctctgcaactgtataactattaatacttcttcagaactgtgggaaatggttctactcatcagctttatggaatgtgggttagggagaggggacagaatctcttcaaggtctggatgctaaacgtaccccttccttattccctcccaatgcagaaaaaggtctgggatgttctgacagggccatctctgccttgcaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtaagagcctcttccatcctgtgtcagctccttccctttctgtgctgggggtggtgagtgggaagagtaggcaagatctcccctctcctctcccacacactgtttcatcatcagagaaagaactgtgggcagagcccaggatataattgggaacagactcttagcatcttagatttgtagacaggggctcctctaaatcttagtgctctgggacaagaccaaggtaaagcattccctagaacctccatctttctccctcattttccttgtcctccccaatccccagcttgggaggctaccatgtactgtaaggctgaggtctatgataggccctctgttcttaacaccaccatcactatcgtcaccccaacactcccaacactacagtaatgggaacaaaagataaacagaaaggtgatatgtaaatatttggagagtcagtggcttggcctcagctcagcaaaaaagctaaatagagctagacagtaaactaggagaaagggaacaagatgggaatctggaggtgtcaggcatacaggggcgataattcatcagtctccaagagcagggagggagagcaagcaggcaagggagggtagcatggatctctaaacaggctgacccctgggctggggtctccattgtgggggaactgtccagcagagtgggcctgaaaaggcctggaatgtggactaaggcaggcttagctgagccagtgctggcactcagtgggaggggatgattcaccaggagacttttcaatggatggacacagggaatttggcaggaaacaagagtataggtcagctcaaaaggtcagatatacaaagaagtggatagagagtagtgagggctgaggggaagaggtcagatactctggggaatgctcttggaaatgaaaggcaccttgaataaagggggtgtaggggtgactctgggaaagaaaattagggaagaggtttcagagtcagaggttgtatgggctgaagaaggggacagacatgggcctctttcctgaagcacacctctacaattctctctctaggtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggtcagtactcatgtctgtgtaagtacactcatatttgctgggggtgaccagtgtgtgtgaccatggactaaataaatgtgaagatggaagagctgaaggcttctgggtcacttccaaaagccccaacatcctgggacaggagaactaaatgcaagggagcttaggaatgcctagggtcaatcaggtgcgtgaagagtcttcacataggtggaaagtaggaaaaggtggagaaaagaagtaactttttaagaaggaaaagaactgccttcataaagactgagaggataagaggttgttctagtcagttccctggtatttgaacatcttctatgtgcctagtactatgctggaaaatggcacaccactaaagtagaaggcatggtacctggcactctaaaacgtgaaaagtagaggatgtgcaagcacactgtcatcgtgaacagaatcctgtggctctacagttcagtgggctgtcatgaaaaggaaagcactgttggttcaggcagatttcctggaaaaagagtttcttgaacttgatcaggaagaatgggtgggatctgatgtgggagagaaccgagagctcaatcggccagccagggccaggtccagcctatctcagagcactcatccttttggacctagggatgactaaaatgtgtcctgaccagctacttctcccttaactgccttccccctcccccaggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggtgagtaaggaaggcaggcagggacatgcagtcccagttcttagtgcaggcacccctggttaatcatggtctgttcagtctcaggagttagggaagggggtgctgtgggaggaggcagtttcctctccacatgaacacctggtcatgagattgttgcagtccaccaggcccagtgctgcccaagtagagaggaggtcactcagctccttgaggcctgaggtcatgcatcgctcctttgtatcccagcatctgggatacagtaggcattattcagggtatgtttaacttagttacctgttttcagttttaagcaatgtgtgggctgcacagaaacataagatgcagccctaagcctttggctcttcgcaatctacttaaagaaatgagacataatgggtagacaaatgcaaagagagatggagaaatcaataaagtttatttgaaaatgtagggaaaaaaaagaaactagaatttaagctgctccttgaagtgtagggagtatctggatagcttgagagacgagtgggcaatttcttatcagagagtagtaggtgggaaagcacatgatctgtcccagggacagagaacagaccaatctgctgggtaaaggttctctctaagggagattaaagctagaaagatgtccttgaaaggctttatccagtgtgctgccattgaagattctgaaacagctgaaaaagaaacgaagaagagatccctaccaaaggcaggtaaagcagcaaatggttgtttttcagtctgttcgaggtatttgtggtgggattcttggaggtgctggaagttgatatggtttttccccaagggaatgaaagttaccatcctggctcacatttctggttcagataggttaaactaggaacatgcaatgcagcagaactcttctcctctggttattgctgtggggctcccaggctcttttctacaggctcagcgtcaggacttgggtgaagtggagccaaaaaacctcagctatcttcggtactgtttgttttcacccatcactgtcattcctggaagagtcaagtggcttggagtaaaactgggcacagaaaaagggtggggctctacccaattaatgaagaaagtagtctgtatactttgtagggtgctagaagaaaaaaacttggagcccttctgattttcctagtgatttcctgccactaagtatactttcctcccacttggtctaattcagagggtcactctctggatacctagaaataattccataacatctgaggtgtaaacctatactaccatactgaaaatacacctttagggaaggaactttggagttaggagggaggataagtcaaatgtgtgttcgtttttctcagaggcataaaattaggcctcctaaaacccaaagtgggccctggaattcaaagaatataagtcatcccagaaagaatatggagccaggaattccctccaaagcaatagagtccaattgaactttctgtgatgatagaaatgttttcctatctctgttgtccaatacagtagcaactagccacatgtgattactgagtacttggaatataactagtgtgactgaggagctaaattttttagtttaattttcattaatttagatgtaaaagaccatatgtgactagtggctgctaccctggacagcacagctccacagtgtagaaggggtttttggtgcccaagaggacttaagacccagcccttggagttaggagactaacatatacagtagacctagtcagtccacattccagaccagtggtctcctaacattctggatcctttactcctatcattaaaacaatttgagcatatatctccattatatgtatatttatttatacctgtgttccactatatgaatatgtatattataaaacgtaaatattttaaattgatgagataaaaaacatagaagttctagcattttcctcccgtatcccagtgacatttggagactaattctgtagaaatcagttaatctattctccgttttgaacctaggctagtcagtttcccatctctggattcttattaaccatggaaaagcttggagtagatgctctcatgggcccaactcatccaaaagtctattgattttatgatctgttggcaggatctcttttgctaaaatcagtcagaatgaggttctaagcattccctatgcatggggaaaacatgatccctatcctagagtttccactgtaaggggaagggataatgcttagggataatagcaataataataatgcaagggatattacttaggaattccttaggaatatgcctccagccagtcatggtaatcagttcacctcttcagatgaacagagattatatctaacaatctattattgtgcttattttcatatgagaaactaagttaatgtttcattttgactaaatcacacaactaagagtggtagaactgggatttgaatccagacaagatgatgtcagagcccatgcttcttcttttttttttttttttttttttttggagacagagtttcactgtcacccaggctagagtgcagtggtgcaatcttggctcactgcagcctcgacctcccagcctcgtgttactttcacctcagcctcctgagtatctaggactacaggctcatgcccatggcacctggctaattttttaagtttttgtagagacagggcttgctatgtttcccaggctggtcttgaattcctggactcaaggattccttctgccttggccttccaaaatgctgggatgataggcatgagtgagccactgtgcccagcccaaaaaagcgattctttttatcttccttctgagaatgtggttaagggtatccagggcagctgaagagataactttgttctcactccctctcttccccaacccaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccagacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgtagtaagtctggctaggccttgtgttgcctttttttttttttttttcttttcttttcttctcttcccatgcactattctggaggtttgccaggtttggggagacatggagtaaaagaaagataggcaactcatggatggtgggagagcaggtaagcaggtctgatctcaagggcccacatgaggcatcagtatatattaggcaggtagggatctctggctttggtaattctttatgagaggatcctagcctttgaagctgggagcaggagtcagtggctacagtgggaaggagtactgcaggttggggccaaagtgatacacagcttagaaggcagccttcctccacttactcaacaaatctttatttagtgactctccaagtcctagtgattattattattgttcactccacatttggcttaatgggtaatgctattacccattgcctaactaggtttgcagtagtggaatctccagagatagcaggcttagtaagctggaggtaggacatgaagtcccccaaaacttgatgtcctatttttatgtgagttggacagtggttatcttttgcctgttgatatcttaaagcagcagagtggtatagaaatttgcggttatgacagacccgggttaaaaatcacagctgtgccatttgctttgatattttgagcaaggtagctaaattttctgagcttctattttctcatctgtaaaatgaggatacgtacctgttcttttttttctttctttttatttcttttagagatagggtctcgctttgttgcccaggctggagtgcactggcatgatcatggctcactgcagcctcaaattcccaggctcaagcaatcctcccacctcagcctccccattagctgggactacagggccatgccatcatgcccagctaatttaaacatagttttcagagatggagctcactatgttgcccaggctggtcttgaattcttggtctcaagcaatcctcccactgcagccttccaaagtgctgggcgtacaagcgcaagccactgtgcccagctgtcagacgctgagttttaattatgcaccaaactccagcccgcagatcctcttcaccaaagcccctggctggtctagcccatcatgacttctctaggaacagtccttctttaggactataaagtattaacaaaagtctgtagattaaggagcctgcataaagaattctggatacaggcccctgtctttccaaagttcctctccaatatcccttggggtcctcatgtttttgaagcagcttcactctgcacaggcagcaggaggttgggggagccatagctctgggccacgggggcagatttatttggatgataggactaatatttgtgtaacctgctgagacctgtgtgggagagtttagggtggtttttcttttggtgaggggatttgctctggtttcacatccattaacacaaaacatgagctagtcagggcccttgtggtctgcggtaaggggatgcctgtggagaaatgggcctgagtgagtcaggccaagagaatgtcttccttcagaatggagtcaactggataactgatgagccaatggtgggattaaggagggggaaatgggaggggaagagaacagctgacatcttgaggaaagctttggggtagtggagaggtaagggggtcatggtcagtctgaactcaacaatagggctgaatgaatttaccaaaggaagctgccttatattatatgccaggctgctggggaaagcctcaggtcctggccagcccctgttctcacaagaacatgcaggttaccacataaataatggcatatgccttccataggacgtcaacctgacttaaatctacctataccctactctctattctttggtttttggttctcatccctgtggaaggaaatgggcctcttctggcatctcatgctactctgtgcttttccttgggctccaaattctagctcataaagatgcaagttttgcaatttc

SEQ ID NO: 12335 - DNA, 28780 bp, Human
  misc_feature (1)...(28780): n = A,T,C or G
ccaatcatggctcactgtagtctcgacctcccaggctcaggtaattcttcccacctcagccttctgagtagctgggactacaggcatgcgccaccaaacctggctaatttttaaattatttgtagaaacggagtttcgcccgttgcctgggctggtcttaaattcctgggctcaagcgttcctcctgcctcggcctcccaaagtgctgagattacaggcatgagttaccgtgcccagctagataactcgattttttaaatccaaaaaaaatttagaaattttatattgaaatttaggcattagaattctagagattaaagttagagcaggtgtttaagggactgaaaggggttgcatggcctttgggaaatgcaattaccggaaatgatactgtagtaatgcaatagtaatgcagtagtagtagtagctgcagcaacaactgttatctatgaatgtttgctatgtgccaggctctgtgctaagagagctttgcaagcattactactgcatgaagtaggcactattatggccattttactgatgaggaaattgaggtgaacagattaaataattttacccaactttacacagaaccattccagagcacgagccataaacacatctttcccgtcttggaaattaaattattaataaaaaacgtggtgcaaattggaaagaggacggttgtggtagattatcacaaagttaagtgggtaggtggttgctgggtcagggtgggagaacaaaggcagctgtaataaaaaaaaaaattaaaggcatataaagaaaaaggctggttgagaacaatttgcataaactgattttggccttagaccctattcacttctccctcaccagtcactttgcaactgtggagcatagtattctgagggtcccctgcacataacaacccctttcatagcatacaagataaaaagaagaatcaggctgcaaagagagaagcactgaaggaaagaacatctcaggttgaaagaagggcaagtccagggtgcatgtgaggaacaaatgcatggacacggtgaagtgccacttcttcatttctagttcaacacaattcaattaaaaattactgggaggaggctacgtcttgaattaaactcagcattccacatctttgaggtggcggaatgactgaggggagggggtctgtctagccacatccaaatcttcctgagacagagggagatccctcatttgttgcagtgtattttccttggtcgcatctgacacaggggttctgtgggttgaacagaaagggactttgctggaggggaggcactctgcatagaaggaaagtagggacatctggcagaagcaggcgctccgagaataaacagtcaaagcagctcgcaatagtcccaaaaagctacccctcaccgaacctggcgtgcctgtcgccgcttgccccgctcccagggctcattggctcccagtctcgacgtcagacccgtagcctctcacctattgggccagccaggaccggagtgcagaagcgagggcctggagacagccgagagccgccttcaaggagggctgggggcggggctagaggaggggctgggggcgggtttcccgatgaaggggcggccatggcagctgcgcagaggcaacgcaggctgctacggagcgcgcgcccggctttgaatgagcggggctgggagtgagcgggcggagcgcgagctcgaggaagagacaggcagcgcgcgtgagcgcgccttgtgtgcgcgcgcggcccgcggcagctcggagcctccgccgggcgggcggggagggggaggggcaggtgagtgtgtgcggttcgcgcgtgcctgggaggggctttcctctccctacccccatcccgaccccagccctagcctctggggcattgtctgcccttcgccgtcggccctccgcctagccgcgcacttcccgccctcccaccttcctttcgcccttccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatcccagttcacctggtatccagctccagcaacttagagcgtttcacgtcacgccgggcgccaggcgtcggcttgtataacctgaaaacgctcctgtttttctcatctgtgcagtgggtatgatttttttttcatcaacaaatttcacgtgggtaatctgaaatgaaaccacttaagttatgaaactctttccttttgagttattctggagaccttactccgccttcggaaccgccccagtggtgtcacatacttgagggcctgactctcggttgccagacatggcacagaatgttcgattttactaccagctctcacactccgcttctgtttccccttctcttacgggccgctgctcaaacctttatttatcaaatttaagtgagttcaggtaaattttattttgggagctttgtaatattttctaacccacttcagagagttatagtttgaggatattctggactgtactagatcatatggttttcaaattttggtatgaaaagattcgtaaatagagttttagaaatacagcacctgtttagtatgtaccgaacatagattttggctttgcttgttttgtgaattgtgatgtattgaggctacttgaaaggacctctagcagtttaccgagaatttcaacaagaaaagatataatacatttgatctatcagtttctaatgtagcattctttttttaattgtattttttttccgttaacatggcagagctctcattcttgatttcctagagttgtcatttcttcaaaaagccttaatgaggatacattgcctcatagttttgaatctcattctgatatacctcaaatttttgtctttgtaatttttaaggaaatttaatgttaagattagattatattaacattgttccgttctagaaagtgttttaaagcaactaaagtgtaaagtagcgtaagatacttatcaaattggtgatctagagggcatttcaaaaatcgcactgaggcaatgtgcacacaattaaaaggtttcttaagtaggatatgatgtagggagagccttgggctttcgggtcagtccctttaaatcctgggtaagtgaatctaagtctgtcaacctcatctattaaacgggagtagtgaaaaacctacctcttttggttgtccttaggattccagtgaggtgatcgaacattgtcttgagcgttcaagtgctcaaggaatgttagtttccttccattcaacaaatatttgagtacctactatgtgcccggctttgactgagacctataaataccagaatgagcaagactgatggacgtcctgcctccttagtttcttgcattcctcagggataagtttatgggcaagctcatgacaactgggagtgaacgcagagtttccccatgcggagttggtagtatttcccagcttccaaatccaaagtagcgactgaaacatagtaggtgctaatatatattcatttagatgaatagggacattaagtaaatacaggtctcaaaggatattcctgcctgccagtcagtgtgattgataaaatcaaagtgtggcttgatcgcattttccctattttagtgcaactggttggaaaatttatcttggaagtggtagtatcactgaattattaagaatgttccttgttcatgagatgttcttggcttttgaattaaatatacctaggtttgaatggagtcactggatgtgcttactctgtgtttaattcaatgaaacaaggacaatagtatctatgtcataagatggctttttgagttgtgtgttaacattttgatagtgcatggttcatagtagacagtcaatgagtatcagttctcctcttttattaatcacaaaaggaagttttctgcagaatgaggatattcttgattgctagggagagaattctattctgtaatcactaaaagacccagtttctattttttattgggaaaaaaaaaacaacctttaaattttacctccagttagcattgaagttattcaagttggcaaatatttataaaacaatgacactaacaatatttggaaaggtgatggctgtggttactagggcagtttatgaaatttattctcaacttttattcatgtatatcctaaaactgacagtcccaaatggtaaatatcatttttcttcacaacatactgatagagtatctccttgattctatttccttccctgccaagtaccacacgttctgtagtctcttttctggctcttttttcttataatttttcagaaaatttaggctaattttcatttgagaaagttttcttttgattgagagttttgttcttgacaaatcagctttaaatgaagtgattgttcaccatcataatttttcagatcattctactcataatgaagcaatcaaacttttttttcaagtcttactttgcaaatggtaactgaaggtaccaaatgaataaaatactctagagaagggttgtacagggcaaagtaaggtatagaaataaccataatacaaaataaaaaatgttgtttcttgggaagagtaaaatactagaattaagaagactttacagtactccagcaagaggtagtaaaggcttatgctagatagattacagtggaaataggaaagaatatgggcagtactgggaaattgaatagggtctttttggcaattaggtgtaaggagaaagaaaggaggagtcagcattgttgcatgatttgaacttgagtaaaccactggttgggatgtttttgacagaagtatttaaataactcgagtacaatttttaatattctggttctttttttttttttttttttttttttttttttaacagtcactgttcttttcatcctgtcaattagtaggccacttccaggttaggcattcagtaaatctttcagcttatatggagagacagcctccatatgtacaaaactacttgagtattgctaaggtaacattttagagccctgtctttgtaccttaatagcctacaagccccttctgaccctagaaatagaaaagactagtgtgcgttttgcctttccttagaagaaattggcaatgatgcctttacagagcaatcaagatcagatactatgagagttaagtatgtttttctggctttctgattttgttttgttcttattttttatgtgtttgtttggaactttcgtattgaggtatagcatacaaacagtacatacagtcaagtatgtggtgttactactcagattgagatattagatcttagctctctaatgcttcagtataccctatcagagatgaccatttttttttactatataatttttaacctattcaatgtaatattttattaggtaaaaagctgcttttttcaagactttaggagtcttgaatccccatgaaatgcatttttaaaaagcatgggctgggcatggtagctcacacctgtaatcccagcactttgggaggctgaggcaggcagatcacttgaggccaggagttcgagaccagcctagccaacatggcgaaaccccgtctctagtaaaaatacaaaaattagcgggtgtggtggcatgtgccagtagtctcagatttgggggtggctgaggcacgagaatagcttgaacccaggagacagaggttgcagtgagccaagattgtactgctacactccagcctgggtgacacagcaagactctatctcaattaaaaaaaaaaaaaaaaaaagtatgttatagtacagggatggtgtatttatccaggatgattttactccttatgtttctaaatgttattgcttatcttatgctcatgtaaggtaattaaaaaactaattaacatttcaattttaaaaaggtatatagctgtccctttaatgtggtcacatgataattattacttaagttaggttttatccgcttttaagtaagtatgtgtagaactgaagtccaaatatactgcttgtgcttttttattctgggaaaaaaaactatcaaattactgtatgttttttctttttgttttaagaagtcagcactctaaataattgtattaatcaagtgttgtgattgtttctaaaggtgttactaatggattgagaggccagtctgttttagttgtgattttgttattacctggttgtttcaccttgagcagaaccgttaacttcagtgtatcttagtttcctcatttagaaaatttaagaagttggatgacgtattctccagctgttccaatgacaggaatcatgattctgaatacatagtaattctcctcctttgacaaagagaaggcaaggaaaagctaagacatgagattccattatcagtaatgttattcctgtaagtgtgtgcacatatgcacacacatatgtatgtttgcctgtgtatttcttgtgacttgatttaacatgtggtctgttctacctctcaacagtggaaaaatgactatctctaatggattaacagatttttttccctctttcgtgtgtattttgaggctcttagtcgggacattgtcatagttacttaagttttcaactttaacttgtgccaaaactcatcttaagaaatttttaaaattaaatagtgattattagggtaaatatatgcagtacatatatagtatacaatatatgcaatacatatatagtataggtgactaagatgtataagaaaaatttggaaattaagaaccatgtttaaaaaggatacagaccgggcgtggtggcccacacctgtaatttcagcactttgggaggctgagggggtggatcacttgaggtcaagagctcgagattagcctggccaacatgctgaaaccctgtctgtactaaaaatacaaaaattaacctggtgtggtggcaggcacctgtggtcccagctactcaggaggctgagacaggagaattgcttgaacccgggaagcggaagttgcggtgagctgagattgcaccatggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaggctaccaaaataatgccagttttaccttttttttttttgaaacggagtctcactgtgttgcccaggctggagtgcagtcatgtgatctcagctcaccgcaacctccacctcccaggttcaagtgattgtcgtgcctcagcctcctgagtagctggaactacaggcatgtgccaccgcacctggctaatttttgtattattagtagacgcgggatttcaccatattggccaggctggtctcgaactcctgacctcgtgatctgcccgcctcagcctcccaaagcgctgggactacagacgtgagccaccgcgcccagcatagttttatcatttttagaatctttattcctatcattgctatggctgtagttttcaattcctatatcatctctttcataaagacatatatcttgttatttaatcatagggaggcagtatgagtgtgatatttaaggactgagacactacaaccagactctttgggttcaaattccagttctataacttatcagttctgtatctttggcagcttacttaaccccgctgtgccttagttttcttatctgaagtagagacaaaatagtacttgcttcaagtccttcccagggttgttgtgagcattgaatgagtattacatgttaatcactaagaagaatgctttttatgaaatataaagtaagctattacagtatattgaaatgctattgtgaaatcagatttctgtttttagagaagttctgaaataatgtttcttttcactaattgtcctagtttcctaatggaagttggctttctagaaagtaacaaataattgatacaagattatgatggtgttaatgagtttttaaaacagtattctaaccagaatatgaacactgttctaatttaagtgacataatattgttcaaaaatgtcttcgtgtagattgttttaacagctcttttgagctctaattgaaatgcaataaactgtatataattaaagtatacaatttgattagttttgatgaatatatatacactcacctatgaaaccaccacaactgaagccgtaagtatatccattacctccaaaagtttcgtcatgtctgtcagtgatccttccttcccacttctccctgcctcattacaaggcactgctgatattttctgtcactctatatttgtttataatttctcgagcaaccttgtccagtctgctgcctgtgggcctcatatagcccaggatggctttgactgcagcccaatgcaaattagtaaactttcttaaaacattatgagatttttttgcaatttttttaggcttatcagctctggttagtgttagtgtattttatgtgtggcccaagataattctttttccagtgtggcccagggaagccaaaagattggacacccctgttctagagcttaaaaaatactatatatggaatcatacagtgtatatttttttggtggtctgactcttttcattcagtataattattctgagatatagtcatgctattacttgtaacaatagttcattcctttttattgctgagtagtaagtagtctgttgtatttatatactacaatttgtttgtccactcacctgttgatatacatttgtgttgtttccagtttggagctattaaataaaaataaagctgcaattcaaatacaagtcttttatttatttatttatttcaattttttttttgagacggagtcctgctctgtcaccaggctgaagtgcagtagctcaatctcagctcactgcaacctccgcatcctgcattcaagctattctcctgcctcagccttcaaatacaagtctttatatggctatatacttttctttatcttgggtagattactaggagtagaatggctgggtcatatggtagatgtttgttaaactttgtaagaaactaccaaattgtttttcaaagtggttgtacattttactttcccaccaccaaagtgtgagcgtgccagttgttccaaatcctcaccagtacttgctatggtcattatgtttagtttgaatcatcccagtaggtatgtaataatttctcactgtggctttaatttgcatttttctaatgattaaagatgttgactatcatttaatctacttatttaccattgtatatgttctttttttttttttcgagatggagtctcactctgttgcccaggctggagtgcagtggcgtgatctcggcttacttcaagctctgcctttcaggttcacgccattctcctgcctcagcctcctgagtagctgggactacaggtgcccgcgaccatgcccggctaattttttgtatttttagtagagacagggtttcaccgtgttggccaggatggtcttgatctcctgacctcgtgatccgcccgcctcggcctcccaaagtgctgggattacaggtgtgagccaccacgcctggccttgtatatgttttttgatgaaatgtctagttagaccttttgctcgtttttaaattgagtttttaaaaattatttttgaattttgagaggttcttatatattctgggtttaagtcccttattagacatatgctttgcaaggatttttctctcagtctgtgatttgtcttttcattccattaatagtgtttttgaattgtagtttttaattttgataaaatccaatttactaatcttttattttatggattgtgcttttgttgtactacctaaaaatctttgcctaacccagggtcacaaagttgtgttgtttttttttcttgcaaattttgtagtttcagactacatttaggtctataatctatttttaattacttttaactggtgccagatatatatagaaggtttttgttttgattttttccatatggatatggatatccagtttaaccagcactttttttttcttaataactattcttttctctctgaattacctttgcatctttatcagatttcagtttttgtatatacgtgggtctattcctttactttccattgatctattcgtgtattttgattccaatactacacagttttgattactgaagctttataacaagtcttgaaaccagatagtgctagctgttttaccttgttctttttcaatgttgttttggctgttatatacgttctttgcatttccatatgaactttagaaattagcttgtcaagttttaaagaaaaaacctgcccagattttggttgagattgcctggaatctataactcattttgggaaatgttgatatcttaataaaaatattctgtctctgaaaaagtctttttaaattaataggccttttaactgtctcagcaatatttgatagttttcagtagtcaagtccttaattagatttgtcctcaagtatcatttttttatgcctatataaatttttttaacgtttcaatttcttattgattgttgttaacgtatagaaatacaattaatggtagatcccgttgaattttccacatagaatatcacacttttatttctgcctttccattctggatgccttttatttcttttctatttttttcttttttctttttttttttttttttgctggattgcattggccagaacttccactacgatgttgactaaaagtagaaaaagcagacatgcttgtgttgttcatgatcttagggagaaattatcaaatttttttaccattaagtctcatattactgtaggtttttcatagatgtttttgatcaggttgagaaagttcccttatactttgctgcaatttttttttttaacaggaatggatgttgagttttgtcaaaggctttttctgtctctattgagatgtttatatggttttttgtttttagtttgctaatatagtgaatgacatttgatttttaaatgttaaaccaatccaacatttccaaactaagcaccagtttttcacaatgtagtatccatttatatattgttggatttaatttactaatatttggctaaggagatttgtgtctagattcatagaatattaatagttttcttttctagtaatatctttggattagtatcagtgtaatactggcctcaaataatgagttggggaaatattccttcttcagttttttggcagtttgtatagaattggtattattccttcctaagtgttttgtagaatttaccagtgaagccatctgtgtctgggagatttttataactacaaatataatttctttaatagatatatagattttcaggttgttcttcttatgctttagtaatttgtgtctttcagggaagttgtccatttcatctcacttgtcaagtaaatacaggcacaaaggtgtttgtaatagttcttcagtatccttttaatatctgcagactctaacaatgttatctgtcttgtttatgatattggcaaaagtctgttattaaggacacgtgttttagattgttatgtactttttattaattgacccctttatcactgtgaaatgaccacttttatacctggtaatgttatttttcctataatctgtctaacattgaaatagtcacttcacctttcttttgattagtgctagcatagtatattttctcctatccttttacttttaacctatttgtgtctttttatttaaaatgcatttctcattggcaacatggagtggggcggtctttctttcttattcaatctaacaatctctgcttttcaattggaatgctatacaatttgcatttaatgagattattgatatggttagatttacgtctgtcatcttatttgtttttggcttgtcccatgtgttatttgttctcttttctttgtttcctgctgccttttcaattgagtagtttttatctccctgcttgtcttattggttatgaccagtccttgcccctcagaatatatgatttaatggacttactagaggtactcctaggtattggcatttctttaatagattcccagatttgtgaaccactggactaaatgagctccatggtaactttcaatttactagctatgtgactttggtcaagttatttgacctctcttaattcaatttcctcatctataaaatggatataaggaaatatattcatctgcaagttaaaaatatttaaagtattttaaatagtattatgttcatgtggttcaaactttaaaaggtacacagagatttaatatattctattttatacttttttattttttgaattgtagatttttgtattaatagatttaggtaaaattattttcaaaaactcagaatgaagggttttatccttacaaccattgaaaactcgaaaacctggtttttgacttgttaatatgatttaaattataattttaaaatttactgtgttatagtttctagagaaaggtaaaaaatatcttagatttttcttagtgcataataggtcttttcaggacaggagtatgacttttgaaatcaatttaatgcattttttgttttgtgcctcttccacaggttttgattcccaccatggccatcacccagtttcggttatttaaattttgtacctgcctagcaacagtattctcattcctaaagagattaatatgcaggtaaataagttttatgttcaaactaacctgtttatctcctcgctggttttggataccttcaaaacttcaaatttcgtggacaggacaggttatatttaagctgaatatcttgattgcagtatttattcattaattcctagtcatttttaaatactttttctctacttcagatctagaaaatagaggttcagttgttttgttcattcaaattcttacactttccactaaaataacatgcttaatactatttaggaatagacagaccaactttcattattataatcatcacagaactttgatgtattcgtttcattatgggaatgttttaaagtggttaggtgaaattcggaataggtatttctgtctatactacaatagtgttgtttttatatttaaaaaaaaatcctaagaaaaatcctaaaaaaaaaaaatttttttttctgtttgagtaacattctagaatatgcaggaagtcaagagcaggtaagtcatttgctttaggacatcatctgtagacttcagttccttctgttttgtcacacgatcatacccaagagctatgatgtctaaaatgtgtgctgaggcacctcagggctttacatgaaattcacagggatgccatagaatattttaaattttgcagtgaaacatagtgatagcatctgttgaatacctcaactcaaagtagttcacatttgcaacattaaatcctgcagtatttttttatgatggtgttctttaatgtttgagataagtttttgtttacttatatttttggtgacatctcattgcaaagccaggattttaggttgtaattaaaagcgagtactgcaccaaaattaatgtagaactgaaaacaagaatgatggtctccagtcttattctaaggcataagaagctgtgcagtgttcaacaggcacacaaatttcattaataagttcagtgattgtggttatttaagaataaaataaaaatattactttttctttaaatgtgtattttttacaatggctactaagcagttaggatatacttaagttttttgggtgtaactaccttattcagtggaattgttaggtgtttctgtggcctaagggtactgtgaaaaagttacttacatactaagaggagggtatagtaaaagaggaaatggacagcaatcagctctttttttaatatatatagacatgacttagaggttacacacaacaatttttgcactgcctgctttccagagcttagtcatatggccccctagctgcaaggaaggataggaactgcagtctctggctatatgaccatttgatagctgctaaattgaacttattgctaaaagtagagtggtctgggatttaaaaaaaaaaaaaatccagggtattgcaagagaacaagtgggtgaaatgatcatctctggatgatcactggggcagaagtgaagaaagaaatggaaaatttaggtggttgacttgaaatcacccaagaggataggatttgggaagtagaaaaaggagcaaactaagtgttcaaattaccagagaatgaggaagagaatggccagaaattcaccaggtaaagcaacattaaaaatgggtattaattgccagaaggcaggaagttaaaagaagcattgtgttaacagtggtgatgaaatgtagatgttttcttcttatacttctattttttaaaattttcattaaatatagattacttctaggataagaaattttcttgatgtaaaaatattaaggacattcctattggcactataaatttctgttgtaaatgtatacatatttagaattgattgtatgttcagttttaaagaaaactgaccatatgttaggataagcttctctttggtgtctgaaggaaccttagaccatgtattttaaaataccagacttggctaggcatggtagctcatgcctgtaatcccaatgctttgggaggccgagggggtaggatagcttgaggccaggagttcaagactagcctgggcaacacagcaggaccccatctctatggaaaggaaaaacacgcttgtatcataaatttcataaaggactatattacttttctattcaccctttaaacaaatatagctttgaatctgtaataaaaatagctgactttatcgttcttagttcttagttgatgctttttttttttatagattatttgaagtgaagtaaatgactaattatctctattacctgccattttttgtatgttgtgctatgtagcaggcacacactgtctagggtttttaaatatgtcacttaattaaatccaaacaaccctgcaaaagtgggtttgaatacctgcattttatagatgaggctgttgaggctgaaaagtaggtaattctaactagacataatagaagtaacattgaaaactgtggtttacacagattccacagcccatgttcttaacaactgagttatagtacgtcctgttgaatgtggtacttttcctactaatccttaaaagtaagttaccatttggttcaaactagtgatttttaaacttcttaatagttaatcttatcaagaaaccccatgtgtaaaacataaaagccaagccaccctgtttaaaacagcaaaggtggcccagaacttcacccacagaacccacagcactccaaggagcatgctctgaaaccgtcttgcatttttatttttgactttatattcctcttgagtttgtttataattctgagtcctaagccaaaaagcagttatgttgttctgtccaagatttaaaaaacattcacaggatgtctgatttatgacttttttttaccataaattagtgagtaactgttactaaaatcaataatcataaaattgagaaagatcttgttttataagccttcaattaccatacataatagtgcttttactttgcttgttttggtggttcttgaaataaattatttcatttttgtttcagatctggcagaggacggaaattaagtggagaccaaataactttgccaactacagttgattattcatcagttcctaagcaggtaggttttttttgtgtgttcttttgttttgttttgttttgaaagattgaataagtgtcctagaacaatattttaaaaactggattgcagatcattaatagaaattaatttttgttgtgttgttaaatttatctggtctgaaaattctatttggttctacattttatcttctgtttctttgttgacattttctattgtgttttcattggtttcaagtgtttgctattgtttgttggagcatttttataatagctattttaaagccttagagaattccaacatatcattttggtgttggtatctgttgattaacttgccttgcaaatttagatgtattgtttttatatgctgaataattctgggttgtttcatgaacattttgaatactatgttttgagacttcatcttatttaaatcctgtggagaagcttggtattttttatcagatgatcaatctggataggcttgggtgaaaatgtccagcccttctgtgagttgtagttttaatgtcagttcagttttcagagcatttgctttcgttttactttgttttttgttttttgatggacataatagaataaaatagaacagaatatatcagaatgtcttgtattttttgaacttttgatcaagttttgatctgtgatatgaaatgtatgttttcccgtgggttaaaaaagtttgaaaaccagtgttttagaaagcccatttttctaataaatcatcaatgatgtgttcattaagttgcccctttgtggctgataatgttgatcaattaaatttagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaagtatgttaagatttatgcttttggagattaaactactttttagattcctatagttaaaattaggtgatacaattcacatttattagaaagcctatttctttttttttttttaatactttaagttttagggtacatgtgcacaacatgcaggttagttacatatgtatacatgtgccatgttggtgtgctgcacccatcaactcgtcatttaacattaggtatgtccctaatgctatccctcccctctcccccaaccccacaacaggccccagtgtatgatgttccccttcctatgtccatgtgttctcattgttcagttcccacctatgagtgacaacatgcagtgtttggttttttgtccttgcgatagtttgctgagaatgatggtttccatcttcatccatgtccctatggaggacatgaactcatccttttttatggctgcatagtattctatggtgtatatgtgccacattttcttaatccagtctatcagcatatttctaattatcagttgtttgttttctgtcatgttaagtaagaattttatatgttcaaatgacctagacatagttctagtaagttgtaccccaagtcttttaaaattatatttatatatgtatcgaaatcctactatatgtcagattctagactccagtctctgccatggagactaaggtgaattggataagagttctaacaagtttgtacttcagtaatatctacaaactgataggtagagtttattgtttgtaaccattataaaactgatgcaggactctaagaacttaagagtaattgtgagtttgtgttagtcatccatacattatttaatcccttttgaattgaatatggaagatcatttagagatgcagggaattactggaaaaaacagaatgcttgagtattttcgtttttatttatcaaaatagtacatgtactttttttaaatcaaaaactgtagaagaacttataatgaaaagtgagacttctgacccatcactcttagccagttcttccaagaaacagccactcaataattttctgtttggatttcttcaagtgtttgtcatcgtatctatctatatggttatattgccatttcttgtttaccagtaacagacattgtccactgacattcatactatggtaaatgaagatttatttcttactaccattccctctcctttattccagtctacctcactaatcactctgctatatcagaaaaacacacttaaagttcactttcttattcaaacatagaaaatatttttatcatatatatatataaacacacacacatacacacttcataaaaattaggacattatttcacattttctaatacagttgttcctcaccttctttctctcagctgatttcagctatacatttatatttacattgtctaggttgataacatttacattctttgttgttgagttgtccaaatgtctcaatgctaaaacacattaaattgtgtatttttaaaggatcctttaagtgagtttcttaatagatgaataccttgcattgtggaagtatactgctgctctcagtaggaacctagtatattgctatagtgccttattaaattagttagaatggaaatgctttaaatgaggctaccaacatatcatataagtgtattttgatgctactggcctgaatgagttaatgtattcataggtatctcacatgctgagagagttgttaatactattggcaggatatgatacctgttgttatttaatacagtaactaaaagtgattgattatattttgaggtctggggaaagtaggatagaaagaaagaaaatgggcctgtattaatttttaaaagtgaaatacaatttttcttagtatgtaactgatttgtacaacaattccctgggaaattggtatttacagactttttttttagtttttacattataaattttaagaagaaatattttaagtaattagaaaatgttttggttgtctatttttatgtagtgatttgtaaaagatccctataattctttttcaattaatctttcagattgttattaagaagagagaaccattgaattttggcatcccagatgggagcacaggtttctctagtagattagcagctacacaagatctgccttttattcatcagtctgtaagtatgttaatggttctagggaagggttttgttgtatttctgttttctttaaagcagaggaataaaatctaaatgagtttaacatagtatttatatttttgtaactttgaaacaggtttagcagtttgatagaagttaatctggagttttaccaatcctaaccttttatgagattgtaaattaccttagatactaagatcaaggtctcattgtacacatgaaagatagagatacaatgttatttaaaaatataaacatcagagagattaccattaaaatgagagattaaccctaatggtagattattttaaagtgagttatgaattgttttcttcatagagtgtattttcattcaaagtatgacttaattttaaacggtttgacttaaatgaaactttttaaaggaaaaatttatgaaacaagtagacagctgaggttctcaaccttgggagcatatcagaatcagctttggaggttttttaaaagcacaaatgtccagacccctccctacctaagctttaagcatgctttgattgattgattatattatctgttgttgtgtaacaactccaaattcagtgacttaaaataattacaaatattaatgtaacacagtttctgtggattgggaatccaggtgactaaactgggtggttctaactcagaatttctcatgagtttgcagacaagtcattgggttggggctacaatcatctgaaggcttgattgtggtcgaaggattcatttcaaagacagctcacttctacacctgacaaattaatgctgtttgtttgcacaaagcctcagttccttgctgtgcacctctccaaggagctgcttgaatttctttatgatgtaactcctgattttcccagtaagttataagacggtgagagcacttgctcatgggtgagggtgacaccacaatgcctttttgtgatgtggttttataagtgatacactgtcacttccatgttatttcattagaagccactaaatccagcccacatgcaagcctccacctcttgaaggaaggaatgtcaaagaatttgtggacatatttttaaattacatctgtctgtcaatctatgtattttatttgtttgtttaaactgcacagttgcttctgaggtccctcttcccaggggacccatgtatatgtatgtttttaattcattgagtaaaaacactgtttttactaaagccaggccctgtggcattaaagggtctttgcctcagaaaaatgcattctagtaggggagacatgatattaaatgaatgatcacacacgtcaatataattacaaactttgataattcctatgcagttacacgatgctatgaacacataacaccataaatacttagctgaataacatagcattataatgttttttattttatatatctcaaaattaaattttattcataaatgtttgatccatattggtgaaatgctttaatcccacccactgaattagcaatatttgccacctaaatataattataatactatcatagctcattgtaaagttttaaatatacaactacttacagagttgagaaggggtaaatagggtagatggagaatgtctccactgctatttccacgtattttcctcccaagcagacagaataaaggggcattgcataggagaggatggtaacctattggactttgttttctataccaaaaatatcttaccattcattctacaaattagattcttcttttaaactacacattttattcttttctagaattcatcattcgtattgttgtgagagttcttttataccaaagataaatgtcatgttttatacttttttagtttgttaattggtttggatatttttgttgggcaggtgtatttagtttttatgtagacaaatctatcaatggtttcccccttttcctttttactaaggccatctctactaaaggatcagataccaccctttttaatggtctctatagttttactttttaaaaaaatctaaatattttatgtactctaacagtcaaatactttagtggaagaatagataatatgaatgggaaatttacaaataagaaatagacataacctaatttgaagaaaagcttgatcttattagtgctcaaagtaggcccagtgaggtgttacatgcctgtaatctcagcactttgggaggccaaggcgggcaggtcacttgagctcaggaattcgagaccagcctaggcaacatggcgaaatcccccctctacaaaaattaaaaagttagctgggtgtggtggtgcgtgcctgtagtcctcgctacttgggagggactggggtaagaggattgcttgaacccaagaggtcgaggctgccgtgagctgtgatcacaccactacactccagcctaggtgacagagtgagaccttgtctcaaacaaaacaaagtaaaataacaagatacaattttaaatcttgtcaaattagtaaagatagaaaagaaagccagccgagtgcagtggctcacacttgtaatcccagcaatttgggaaattgaggcaggaggatcacttgagttcaggagttcaagaccaacctgagcaacatagctagacctcatctctaaaaaaatgtaaaaaacaatcagccaggtgtggtggcatgtgcctatagtcccagctactagggcagccgaggtgggaggatcccttgagcccgggagtttgaagctgcagtgaaccatgatcacaccatgcactccagcctgggcaacaaagtgaaacgctgattcctaaaaaaaaaaagggagaagaaaaggcaggatttctacctactgcggtcaagaggataacttggtacttttcaaggctgtcatttgcactttgtttcagtagctttaaaaatcctcctttcagaaatgtatattaaataattagaaatattttaagaatttttaacagagtatggtattacatatattctcaggagaagaaaactcaaaacattctatttcatttttaggggtaagtatttaaaacaatatgatattaaataaatgtgttcacagattggtaccagttattttacacacagtcacttccacacctacctaaacagtccagcatgaccattttcattggttattgaaagaaaacagtgaacttttagaggtctggcttgggaaatagaggtagggaccagtagatgataccaggtaagaaagactgggaaaaggaagcatgacctagaagtatttcattaaagataaattttgcatgatttgtcatttttgcctaggattgagacagtaagtgccaataaaaaatctccagtaagttacatatgcttaaatgaagaatgactgtgctagtttttgaacttcagctcgcagttcttctcagcacagattagtccagtcaaggatttctaattcagtctgggatcagtcagtttcttgtcactctatccccagctccctcatcttactgaggagagaaagaaacaaaagacatgttctgttcttgttccttccaaaataaagtacagcaaagaagagaatttaagagagtatcccatgaaacataaagaagaaagctggccttgcctaggactgttgaacactgaaagtcatacatcagttctaggcaagccaaaagcaaaatcatctgtgccttgtataggacagggtaaggaagctgagaagacataggagaatgacaggttctgagttatgtgttaaaagatactctttttaacggctatgtggagaaaggatggcttttactctcttaattttgttttacttttcattgtagtctgaattaggtgacttagatacctggcaggaaaataccaatgcatgggaagaagaagaagatgcagcctggcaagcagaagaagttctgaggtatttgagtggcatttatattgcaacctgagtagaagaactagatttcttccctgctgtgtttcaagtcaagggagcctattttgccaaatattatatttttcttcatttgatccttagataataaggacttttttttttgtatttcagactgcagatactattttatatgattaaaacctcacagaaaccaagaattttaagctctataggaacaaaataactttattaatggcaaatggagtgttatatatacatgtatataaaaggttttatatatatgttttatatatatatatataaggttatatgcatatacataccatattacaagcttgatattcctctaggtcagaagttacaactttatttccatttcctcatgatctagcatagtgcccagtactgctcatttgagtgaaaataacttatgtgacactctacatttgtacatatatcttaaatgatgtccatgaaagccctatgtgttagatgaactacccattctgcaaaaaaatactattctggaagttttaaagttcatttttattggttgttcttttttgtgtgtgagcagcaaacatatttcttagtactgctacattaggtcaaagagtaaagagaaaatttatcttaagggagagctagtgactgattactgctttttaaaagtcagatatttaaatgcatctaaagaattcatacattttttaaattgtgtagtaagatacagcaatataaatttttttattttaaaattgagattgtttttaccataggaatagcagacaaattattctttatctgactcaacaaaaaaactgatttcatttttgtattttcctttcttggctttgtcaataaattacagttactgtgaacaaccagcagagggtgcagctaaataactgggaattttgtttgaagtttttgtttttttcctttgaaatatatcaagccctttttttttttttttttttgcaggttaggggacgtcacatttcaaaattcagtcagtaaaattgtgagagtttttaaaatttagttcttatttaatcagtatagcttatcttttataaagggaatattttttaaattgtgaactataacacttaggatattgcatggatcatcaaaaaagataaatcatctctttaaaattctgtgttattttaaaaaacaaataatagatacagatgtctgagtattttaagacattttggggattctagtaattattagtgccattaaccacaaagacaaaggaaggggtctgtcctttttaaatacagtaatctcactgtagagttcaagccatgagttcacaagtatcttaatattgtacaaaaaccttttctttttcattctagcctcttaacccctaagcaaaacaaatgaaaaaatgtacttaaaaacttaatgttttaccctttaaggacagcttgggagagtgagattgttaatccgtaatagacatgcttcatgccgcaagtacataggtagagccaaagagaaatggaggtgtcagtacattgttactgcccctgaatagacattgagcattttaaaagtgtatccacattccgtattgtctaactctgagcttttttcctgttgccactataaataatgccagtactgtgatcagtattgctaagaatgaagattctggtactttaataattcccagcatgaatctggataggtaaaatgtatttttgtctgcagctatctcgtaagttgtctcttttatactttagtttttgatacagattgggtatccctttccaaaatgcttgggaccagaagtgtttcagattttgaaatttttgagagtttagaatatttgtgttctgctgctagttcatcatcccaaatatgaaaatctaaaatctgaaatgctccaatgagaatttcctttgagcatcaggtaggccctcagaaagtttcagattttggagcatttcagatttcggatttttgtatttgggatgctcagcccttatattatttcagctagtaaccaggtcaaaacttcgttatcttacttgtttataacctagccagccctttataattttttctctacctcccttttttcttctggtttgacatttttagttcagattattagtttttattgaacatcagcagagtgatgaaaaacagattttttaaaactattcttcagaaattgatagcaaaagtcaaaatgttgccaaaaatagtttctttactttcttgaattttggtcatccataactctgcctactcctgtttatgactgagaactgtacatacatttcactcactgtagttaatattgagctcccccagacatagataatccactttggatttttctgcatataacctaatgttgcctattccatgcccaattgtgacctgtagcttccttcctcaacgttgcatacttgaatgattttctcacaccctaacccttcagatccaggaccaatgtatgtttactctgctctctcctgtttcatcatcccactcctacctccactccctacattaaccaatcagtaaagatagagagagtgagtctgggtcagtggagttacggaaagagtaaggaacaggtatgtatttcacaaagtatgattagtaaatacctaccactcttttttttttttttttaaacttaagttcagggggacatgtgcaggatgtgcaggtttgttacacaggtaaacatgtgtcaagggggtttgtcgtacagatatttcatcagccaggtattaaacctagtatccattagttatttttcctgatcctctccctccgtctaacctcagcctttccggtaggccccagtatgcattgttctcctctatgtgttcatgtgttctcatcatttagcgcccacttataagtgagaacatgcagtatttgattaaatacccaccactcttctctttggtagagttagtcacatgttaatcctgaaatttacttggtggaaggtgtatcttaagtttccattttctttttggagcgtgtgttctgttcagctgtgttcatcatgcactttaaaaactggctgtttgtaactactataataacaggagattatcaagctcaatatcaagcttttctgaatggtatccccagaaaaagatgtggttcaatggaagtattgttttacaaaatggagataatctaaataagaagtgtcagaagatgtgagttcttatccctgtacttaatcctatgacttcgggcaagtcacttagcctttatgcctcattttacttatttgtaaaatagagataatatttcttctatttcacaagtcacgttctaaggactaagagaaatcctgtttttgaaaatatttggaattttcaaattagtgagaaaattttaagactttcaacattttatttggtgataataaaaaggcactgctatttctttctagaatttatttgccattttacctgtttggtattttctaaaagtaaaagtatgtttcttttcagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataataatcttttatttatgatgttgattggctccaaaatagtcttaaggaaataaatactgggtctgtaggggaaaagtagacttcatagtttaaaatcccattaaccttttcaccgcagttgaaatgcatccagcctgattttcctatcattttggaatttttaaggatttttactttcttaagttactgcctagaatcaacattcggtgagattttgaaatgtcatagatactgtacaggccaaaccttactaatttattttacttaaagtgatattttatagaaaaatcataagttatacaatgagaaccctttaagcccttagcctaagctttcagactaaatgtgattatagaataagatgaaagttaactttggtacagagctttttatagccccaaattatatttccagttattatattcattagaatttctgctaataaactcccaacttaaatagaattgggctcaaagttttaataatgtattctcttccttctttgtatttatagttagttattatgggaatacaacatatcttctctaaatttggaattcataaaggataacttcctttagctcaattacttgtattgcttttccctagtagctgaaaagtatttaagtttggtttggtcatgattttcatgtgtttgaggtttttgttgttgttgtttggctttttggtttttgattatttaaaaataaagacattagcaattatagttagtatgattaggaagaaatagatttttcttgtggaaagaatagataacaattctggaatttattttatctctattgatgtgtaaactaaattcctgtattaacttgggtatattttggtcccaaaagtagtcactgagttaaatgcatatgacaaacaattcatggtagcatactgtctcttttagctactaaatttatggtttctattttttgttttcttgatttcaataaagaattgtcagttttagatgcttattagaaataataagaaatactggtaggcatagatagaattagtgaagttttaaccattagcaaaatcgtgcatttcatgtactgagataacaagtaatcaaagacatgggaaacttaccttgtgtttttttttgttttgttttgttttttatgtagtaatttcatggtttctagccatttcctcttcttaagctttacctagggatattctctacttggc

SEQ ID NO: 12336 - DNA, 19993 bp, Human
gggatgcagcgttcctgtaagaaaagaaaaggagagctacgatacgtggacagaggcttttgctccagtttccatagacactgccccgtttgctcatgctgttccctcttgttagaacatcttcatcccacgctcttacttctcgctgactcatcatgtttcacaatacacttggatttttctctcttccgggaaacctctgcccctccctgaagagggataaagtgaccctcctcatactcccagagtaccaggtgattctctatagcattatcattaaaaatcaggggctgcattctctccctctgtcccagtagtctgggaactaactcctcaggagcagggactcccctttctcatcctggtgtttcctattggcaatgcctgccactcagtagtaggcgcttgttgactgagactattgatcacaggcaggttcgaatgtctttgttccctcatctctacccctgttaagggattacggagtgtcctattcatttcgggcatatagaaaatgctgttaaagttcattgaattgaatgaaacaattaatcgttctgcaaaatctgagcagagaagtcatttggtttcaaaatacttggataaaaacattacggtggctcacgcctgtaattccaacactttgggaggccgaggcgggtggattacttgaaaccaggagctcgagaccctgactctactaaaaatacaaaaatgagccggtcgtggtggcgcgcgcctgtaaatctcagctactcaggaggctgaggcacgagaacagcttgaaccgggaggcggaggttgcagtgagccgatatcgccactgaactccagtcagggcgacagtgaaactctgtcagaaaaacaagaaacaaaaaaactgtgaggtactgagatcacaaactggtgctcaaaatatactgatttcctttctcgtctggactaaacgggggtagggaagggtgagaaggaggggatcggccctcccaacaagtctcatcttccccagatgctgcttggtgctcaggggctgcaagtactctgtccttgcacagagggttggggactccagctgtgcatgggggcacacattaggcccacagcttgtaatggaccagtagtaaagtaagggaggggaagcagactctctcttggaaaggaggctcctgagtccttcttggggcttcccccaccaactgtttcccaaaccagcatacagtaggcacttagtaaatactaaacctagtaaaggactgaatgatggtagaccgaacccccaaagcaaaagagaaagggtccaacagcgcctccttgcggtgctctgccccaagccacggggagaaacgttgcagcccgcgccgaacgccgggcagcacaaaggatccccgactgccggggagcggtgctcggagggcacaggtctacgccatcccccacgcagtttcggagatggagcgctgggcccatggagggaaggcggcaggctcggcggctccggcagcttgctggggcaggggctcaaggcggcagtccgatagtggaggccgctgagaactgtcacggagctgcgtctgtacagcgagcatcccttatttattcagggcgagtgtgtatttggggcggcgtgcagggggctgacaaagaccggagagctcccggtgcggccgccggcggagcgaagactggaacccgtatgagcgccccccagcgcccctgagcgctcgccgccggtgcacggcgcaccccgcgggaggcagggatcagcaaagccgtgcgccccgaggcccgcccccgtctccgcacaaagaccgtgagtcccgggtccgagccttccgcgcggggatcgggcggttgtccggcgggtcgtccttcgacggcctcctggcctcgccggagcgggtgcggggaggcccacgcagcgacggctggaggaggggtgggcggggctgccgggggtggggtccccggggcggggcggggcgcgctgtgtcgcgggtcggagctcggtcctgctggaggccacgggtgccacacactcggtcccgacatgatggcgagcatgcgagtggtgaaggtaaccgcgtataggatgacccctttctcttggctcccctcgcctcccgcattccctcctccctccatcccctccgcggctctccgagcacatttatttatttgtctgggcaccagggctggctgaatccctgtcctccccgccctctactcagaggaggactggcctgcaagagtggccagagctggggttttgggggtttggaggcctctgcttgagccgttcgcgtggtgaagatgagccggctcccccaaaactggtttcaatttcgcttttcctgcctgaaacttgtgataacaactgggtgcatctccagtgcaggaaaagtccttggcatcttggtgccaggcattctgctactgctggtggtgggttatgaacacagatgaccaggatgaagtccttgccttggaataagcccatagcccatcccataatttgatgcctgtattactagagtcctgagaaacacggaatgctgattagaatttgggacaaagttccctgagtattctctggaggaaaagatgcggaggtggacctggaaggcctcctggagtaggtggcttgcgttcgtgagttctacaagtgttgaatgcctacatgtgctggccctgttctaggaggggggggggggcgggcagagatgaacacaaatccggcccttgttgaattttgttcctatcagggacacaatttgaaataagatctggaaggatggggagggggcagtttcctccagaaggtgggaaaacccagggtgtttggagatggattagggaggaaggtgatcctggtgaagtgagtctggcaccccaagtctttcagaagtgccccttccagtctgcagggtggaggggcaggctctaggaagagggtgcctgctaccctcagcctctgagaagaaaatggcctcagactgggatgcccagagcaggcttggcctagatactaaatctggaggttggcagcaaaatgaggcagagggtctttccagccaagtggaagagagatgggagccagaatttattgcattggaaccattacatgccaaacggtttacatggttatttcatctaattcgcacagcagttctgtgagataagtaatatatacccgcattttacaaatgaggaaattgaggcacagaggaaataacttgcttgtccagagtctttcagtaaggagcaatgggactggaatatgaaaccaggtccacaggcctccagcctgcaggctctcttaatggcctttctactttcattttctgttcctctgagtcaggtgatttcctagtaggcagtaggaaagaactgtgtgttttaggttgggtttcaacttcctcaggctttgggaaagttctggcagaactcatcctaaacagataaagttcaagtgtctttatctttccaagacctggaaaatgtctattccagatcttctccggtcagccctgggctttgttcttgccaaagagtcacagatgatagagaaactcttacaagtgcagatgcttctagtttggggtaaagataaatgaagggccattgaccctgggtggaaggcaccagaagcagcttattggttgaacagaaatagaacataggctgagggataggaggggggcatgggatgtgtttatattatatgttgggggtgggggtaaggcagagaaagttcaaatggtccacagtgttaaaggacccctccccacttgtggactgggtttggagagcttcagtttctcaacctcatcactactgacattttgggtcacataactgttatgtatccattgtatgtttttagatttgaggttactacaaggtttgtaaataatatcttataacctgttattttaaactgatgacaagttaacactgattacataaacaaacaagcaaaatgaaaactaatgaaggccaggcgtggtgtcccactcctgtaatatcagcactttgggaggctgaggttcgcggactgcttgagcctaggagttcgagaccagcctgggtaacacagccaaaccccatctctacaaaaagtaccaaaattagccgggcatggtagcacactgctgtagtcctagctacttgggaggctgaggtagcaagatcacctgagcccaggaggttgaggctgcagtgagctgtgattgtgccactggactccaatctgggtgacagagtgagacattgtctcaaaaaaaaaaaaaaaaaaaaaaaaaaacaactaatacaaactgtatactttaacttcgtctttccgcttactaactttttgttgtttctatttctttccttctttctttctctctccctttctttccttccttccttccttaagatggagtttcactcttgttgcccaggctggagtgcaatggtgccatctcagctcaccgcaacctccgcctcccaggctcaagtgattctcctgcctcagcctcctgagtagctgggattacaggcaggcaccatcacgcctggctaattttgtatttttagtagagacggggtttctccatgttggtcaggctagtctcgaactcctgacctcaggtgatccacccacctcagcctcccaaagtgctgggattacatgagccactgtgcccggccatttctatttctttcttattgtactgtctacctcttgaaaaattgttgtagttattatatttaattggtcatcttttcctctttctacttaagatatgagtagtgtatataccataaatacagtgttatactaatctgtgtttttctttctttttttttttgagacggagtttcgctcttgttgcccaggctggagtgcaatggcacgatctcagctcactgcaacctccgcctcgtgggttcaagtgattctcttacctcagcctcccgagtagctggggttacaggcacccgccaccacgcccagctaatttttgtatttttagtagagatgtggtttcaccatgttagccaggctggtctcgaactcctgacctcaggtgatccaccggctttggcctcccacagtgctgggattacaggcgtgagccaccatgcccagcccagatgattttttattgctcattaaaatttttttaaatttctgattgaagaactcctttttagcatttcttgtaggacaggtctggtgtcgatggtatctctcagcttttgtttgtctgggaaagtctttatttctccttcatgtttgaaggatattttcactggatatactattctagggtaaaagattttttccctcagccgtatttcatttaaatatgtcatgccactctctcttggcctgtaagatttccactgaaaagtcgctgctggacatattggagctccattgtatgttatgtgtttattttctcttgctgctgttaggaccctttctttaatccctgacatctgggagattgattattaaatgccttgaggtagtcttctttgggttaagtctgcttggtgttctataaccttctcatgtttggatattgatatctttctctagatttgggaaattctctgctactatccgtttgaataaactttctagccctgtctctctccctacctcctatttaaggccagtaactcttagatttgcccttttgaggccattgtctagatcctgtaggcatacttcattctttgtttattctttttttttatttttgagacggagtctcgctctgttgcccaggatggagtgccgtggcacaatcttggctcactgcaagctctgcctcctgggttcataccattctcctgcctcaacctcctgagtagctgggactacaggcgcccaccaccacgcccggctaattttttttttttttttgtatttttagtagagatgaggtttcaccgtgttagccaggatggtctcgatctcctgatctcgtgatccacctgcctcggcctcccaaagtctttgtttattcttttattattttgcttcatctgactgtattttcaaataccctgtctttaaacactctagttcttctgcttgatcaattctgctgttaaaagactgatgcgtttcagtatgttaattgcatttttttctttctttcttttttttttttttgagacagagttccactcttgttgcccaggctggagtgcaatggcatgctctcggctcactgcaacctctgcctctccaattctcctgcctgagcctcccaagtagctgggattacaggcctgcaccaccatgcccagctaatttttgtatttttagtagaaacagggcctcaccacgttggccaggccggtcttgcactcctaacctcaggtgatctgactgcctcggcctcccaaagtgctgggattacaggcatgagccactgcacccggcctcaattgcatttttcgactccggaatttctgcttgattctttttaattatttcaatttatttgttaaatttgttgatgggattctgaattccttctctgtggaggaaatattgaatttctttgagtttcctcaaaacagctattttgatttctctgtctgaaaggtcacatatctctgtttctctggaattggccctgtgtgccttatttagttcgtttggtgaggctgtgttttcctggatcgtcttgaagcttgtggatgtttgttggtgtctgggcactaaggagttaggtatttattatagtctttgtagtctgggcttgtttgtactcatccttcttgggaaggctttcgaggtattggaaggggcttggctgttgtgatctaagttttggtcactgcagccatgtctacataagggggcactccaagcctagtaacactgtagttcttgcagacttttagaggttactacctttgtggttttggataacatcaggaagaattctctggattaccaggtagagactctcattttcttcccttactttctcccaaacaaatggagtcttactctccgtgctgagctccctggagctgggtgaggtgtgacacaagcatccccatggtcaccagaattgggactgcactgggtcaggcctgaagccagcacaagactgggttttgctcaaggcccgctgtaatcactacctggctatgccctacgttcgctcaaggccctagggctctgcaatcagcaggtggtgaagccagccaggcttgtgttcttccccttagggtggttagttcactgctgggccccagagaggtccacagttgctgtccatgggccagggcctggagtcggaaaccttagaaatctctctagtgctctgtgctactgcagctaagctggcactgaaaccacaggacacagtccttcccactcttccctcccttttccccagatataggagtctctccccttgtccaccaccaccacgggtctatgaggagtactgccagggtactactgctgatgttcgcctaaggcccaaaggcccttcagtcagcttgtggtgaatgtgaccaggcctgagactcaccctgcagggcagcggtctcccctcttgttcggccagataattctttgttaggatgtttatcagcatctctggcctctatccactctcccgatttatgacaacggaacaatgttcccagatattaccgaatgtccctggctgggtaaaatcgcccctggttgagaaccactggtttgtaccaattcattgttccagagaaatgtgacctgcccttgagtgtctttatcttccccaacaagaaaaggcctgtagtcccacaagatggactctaaaagaggggcagcattcctttgtcaaatacatttgagaagtactgcatgctgtgggcccacagcttggtcaatcaccatacacaatagcatattaaaggctgtgggaagttctccagtgaagaaacctctttagccgagatttaccaaatgtacttgaccttggaacccttttcctgtactacctattaaccttctgcaggacatactgtacttatgtttcccatctgggccctctgccctggtgcttctccccttctctgctttatggattcctgttcattctgcatggcccagctcacagagtgcaccctctgtgaaaccttccttctcccctctcatctccttccttaccgtatatccatacacattcacataatcacatccatgtttcgtccattactctattgaaattcttgaggactgggtcctgtctcagttaaatgtcagtagaagatgctcagtaatggctgttgggagaattcagaagggatattcaggtgtttgggccacagttttgggaagatgagtcactccttgcccccttgtttccccacttggtgtgtagagttcttctctgctatggtcttcgggagtcatttcccttctccagccctgatctggcagagtttgaagcggtggggtcatgtctttgctgcagatgctcagtcgatgcttacggaaggaagaaaggaagagaggaagggaattagaacctagtgactttctaggaagaaggctagagagcagaggttaagtaccctgctttcaggagaaaagcctcctaagagcacttactcccaagttttaatatctgggagaagtgatctatttttccctgcacctagtacctaggtgtaccagagttgtggtgaggccacagtcagaaaattcacttaaagcaccagcaccggctgggcgcggtagctcacgtctgtaatcccagcactttgggaggctgaggcgggcggatcacgaggtcaggagatcaagaccatcctggataacacggtgaaaccccgtctctactaaaaatacaaaaaattagcggggcgtggtggcgggcgtctgtagtcccagctactcgggaggctgaggcaggagaatggcgtgaacccaggaggcggagcttgcagggagccgagattgcgccactgcattccagcctgggcaacagagcgagactctgtctcaaaaaaaaaaaaaaagaaaaaagaaaaagcaccagcaccatgcctgatacatactaagtgctcagtaaatgtaggctctgactttaccggcttctgcccctaagatggccagttttgaacttggggcagcttgctgctggggcagggggagggggctgaaataaggaggactaggccaactgcccactcacttgtgtcccctgcaggagctggaggatcttcagaagaagcctcccccatacctgcggaacctgtccagcgatgatgccaatgtcctggtgtggcacgctctcctcctacccgtgagtatccatggggaccatggctttggattggggccaaattaggccagggacatgggcagggagggttaggactaggcaagaattttccctgcttgagatccttttactggaggttatcattgctggagggggcttctctctgaattgattgcttctgagatccagatacttctgaggttcaccttctgataaagatgccaaaggacttttgacttagtaggagaccccttccttaaaccggtagccaccaagcccaccacagaacttcaggagacaaacagcatcaaaaagaagaagaaataaagatttcttggacctttgtcaaggggtagggataaacttccaggctctcacagttggtagaatttgctcccgcaaacctaaattgtattttgtttttctgtagtcttatttcagaaaattgttacatatgaaaacacaaatagctcatttctactgttcttatttttctctgtttattatttggtattttcttgataaagtctctctgaaagcagtattccaaaatagttttcagagtgcaagatctctctttttttcatccgattattagtgactaaagatactttgagaaattaatctacacttttcattacttggaaataaaatttaagacattgaactttttgttagtcaaagctctttggaatatcaaaggaacaattcatcttatcatttaggacttggacttgtttttttttttgagacagagtcttactgtgtcacccaggctggagtgcagtgatgcgatgttcgtttcctgcaacctccactctggggttcaagcgattctcctgcctcagcctcctgagtagctgtgactacaggcacgtgccactatgcctggctaatttttgtgtttttagtggagacaggattttgctatgttggccaggctggtctcaaactcctggcctcaagtgatctgcccacctcggcctcctaaagtgctgggattacaggtggagccaccacacccggcaggatttactttttattgacaatgcagtggcctaggttgtgtcgtcttctctttaaactgacctatagtccagaaaagtagagaaaggcctgagtcaggtcaacatgggaacctctgtcaagtcccttgggttactgtgttgaaacgatccacttacctggcttagagtgaggacacctgttctaggcctcaggtgccgggagaagatgctcaaaggagctccagggactgattatatctccaaggagaccaactttgagatgatgaaagcaggggtgataggaaaacctaggaaaggtctcgtttggcagagtactatgaaatcagaggacctcaatagttggcaagaccaaggtggttaagtgcgccccaggaactggccacagaccttccagccatataggagtcctgaagaaacatgatacttgggaggaatcccagagctggaggaccaaagcttgatgtaagtcatcagctaagggggcctgaaggtgcctggtgaggccataaaggaggggatggttgactggcagaggaaggagaaccaggaaaggtcttttggaatagcacacaaattcctcctcaaaggctcagtctcagtttatgtgttcaccaaagtggccccacttgtcacatcttggtcatggaaggattcagctcgatgagtctttcgaagctaatagtaaaattctcattccttgagagtttcctgtggaccaagtgctgttttaagcacacgacatatgaggtcatattgaatcctctcaaccatccagtgaggaaggttgtcttcctcttaaaattgcagagatggaaaccaaggaggttaagtaactggtctggggtcactcagaataaggtggcaggagtggaattcagcggactccagggtcttctcttttaaccactccatgaaaaatgaatagttttcaaaattttttaaaaagtagcaggccgggcacggtggcttacacctgtaatcccagcactttgagaggctgaggtgggtggatcactggaggtcagaagtttgagaccagcctggccaacatggtgaaaccctgtctctagtaaaaatacaaaaattagctgggcatggttgtgggcacctataatcccagctactcaggaggctgaggcacgagaatcacttgaacccgggagttggaggttgtagtgagctgagattgggccatcgcactccagcctggatgacaagagcaaaactctgtctcaaaaaaacaaaacaaaataaagtagcaaaatcctttatttaacctagaacttagaaggtagtgggactttctcaactgactgtaagatacagcatggaatcctctggtccagcttctccattttacagacgaggaaactgatcctcagagaaagctcagtcatacagcaagcccgaggcagagctgggacaggtccccggagctctcagctccatgactctgctacctccttcctctgttaagtcctacgaagcccagaaagaagccccttcaggcaggacacactgatacccctgtcttagtccattagtgttgctgtaaaggaatacccgaggctgagtaatatataaagaaaagaggttaatttggctcaagcttctgcaggctgtacaagaagcatggcgctgggcatggtggctcacgtctataatcccatgtctttgggaggccgaggagggcggatcacctgaggtcagaagttcaagaccagcctgaccaacatggagaaaccctgtctctaccaaaaatacaaaattagctgggtgtggtggtgcatgcctataatcccaactagttgggaggctgaggcaggagaatcgcttgaacctaggaggcagaggttgcggtgagccgagatcacgccattgcactccagcctgggcagcaaagtgaaactccatctcaaaaaaaaaaaaaaaaagaagcatggcaccagcatctccttctgatgaggcctcaggaagcttccactcatggtggaaggcaaaggggagccacgtgtacagatcacatgcaagagaagaagtgaaagagagagagagcgagcaggtgccaggatcttctaaacaaccagctttttcagtaagtaatagagtaagaactctcttatgactgtgaggttggcacggagccattccacggagccattcgtgggaggtctgcccccaggacccatacgcctcctggtaggccccacctccaacattggggatcaaattcttttcttttctttccttttttttttttttggtgacagagtctcactctggagtgcagagcaagactcactgcaacctctgcctcctggattcaagcaattctcatgcctcagcctcctgagtagctgggactacaggcacacgctaccacgcccagctacctttttgtattttagtggaggcggggtttcatcatgttgcccaggctgatctcaaactcctgagcccaggcaatccatctgcctcagcctcccaaagtgctaggattacaggcgcgagccaccgccacgtaggtcttggggatcaaatttcaacctgagatttgaggagacaaaacatccaaccacagcaccctcccatcctgctctgaggcctcagctgttggccttctctgactgataggcacagccttttctccttactgagaccataaaaaatgagatattttctttatcttcctacttttttttactccatctctctttttttttttttttttttttttgagacggagttttgctcttgttgcccaggctggagtgcaagggtgtgatctctgctcaccacaacgtcagcctcccaggttcaacttctgcctctcggttcttgcctcagcctcccgtgtagcggatattacaggcatgcaccaccacacccggctaattttgcatttttaacagagacagggtttctccatgttggtcaggtttgtcttgaactcccgacctcaggggatctgcccactttggactcccaaagtgctgggattacaaacgtgagccatcgtgcccggcctagttagatcacatggctagtgagtgtcagagccgaatcacacccaggcagggtggctccaagtgctgggattacaaacgtgaggcaccgcacctgacctagttagatcacatggctagtgagtgtcagagttgaatcacacccaggcagggtggctccggagtctgtgtgacccccatactctgttgcacaggctaatgcatgtcaaacccttagcacaggacagcacagacaggtgctcagaaaagtgttcaggtggctcaaagtctagagggtcttctgctggctccttgcagctcccaacccctaggtcactccagcccctgagtttgtttgtttttaatcatagtaaaatacacataacaaaatttactatcttaaccatttttaagtatatagttcagtgtcattaaataggattaaataggattacagctgggcatggtggctcacgctcgtaatcccagtaatctggaggccagagcaaaaggattgctcaagtccaggagttcaagaccagccctggcacagtgagaccctatcaaaaaaatttttttaattagccagatatggtggtgggcccctgtagtaccagctactcaggaggctgaggtgggaggatcacttgagcccagaagtttgagattacagtgagcaatgataatgccagtgcactccagcctgggtgacagagcgagaccctgcttcagtaaacaaacaaacacacattgttgcacaaccatcaccaccgttcatctctagaactttttgtctacctgtactgaaactctgtaccccttcagtaactccccattcctttctttccccagcacctcatgaccacttttgtattttgtttctatgaatttgactattctgggtactgcacataagtggtatcttgcaaatctgtcctttttttgtctagcttatttcctgtagcatagtgtcttcaaggttcatccgtgttgtagcatatatcagaatttcattccttttaaggctaaataatactccattgtgtgtatatgccacgttttgttgattgatccattgatagacacttggtttgctttcaccttttggctgctagaaacattggtatacaaatacctgtttgctttcagttctttgggtgtctacccagaagtagaactgctggatcatatggtaattctgtgtctaatcttttgagaaatggccatactgttttccatcacagctgcaccattttattttcctaagctcctgagttcttaggatttcctcattttctccatttcctcacccccattctaatgttttaagaaaggatgttccatccttttcttccataatctcagaaagtcttgaaagctgagatggtccttagagctcatctagtccatctttatccacttttcaaatgaggaaactgaggcctagaggtgggaagtggctcacccgtggtcacacagcaaaagccaggatcagacttctctgcctcccaggccagtgccctttggtgatttcacattttcactaatccatgactcaattgtcaaatgaatgcaggtgctgtgtgtgtcctggctcatgattcctcctgggagtgaagcagaggatgcctaggaccctcggattggggcaggaagggaggaaaaccagactggagcttgaccccttttctctctgcacaggaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaaggtggggttgggctttgcttggaggagggactgatactgggtagagattactggagagggggttcacagcttattctgagcttgaaaagccccaaagagcggagataaaaattgtgagtcttggctgaacttactatgagatagaagggatgcttcctggacagactgacctcctcctgcctctcttcttatacctgtgcagttgtgacagaggaacgttgctgcggttcatgggagaggcagcttggctgcacagggaagggctcgggaaaagaaagcccgctgttccctctgtggactttgggcaagttttcgttcctttctgggactcggtgtcctaaatgacagtggagggaactggcctcataatgataatacctgtcacttgaccgagcactttcggcactgtgctaaaaacatcacctgccgacttcatttttatttccccaacaagcccgtgaggtagtgttgtttagtagacccggacatctgaggcatgtgagaggtgaagtggttgcctaaggtcatacagatgacaaacggcagcacttggctgactcgcaagccacatgtggctgttgcaactgaggaactcaattctttttcttttttaagacagagtctcgctctgtcgcctaggctggagtgcagtggcgcgatcttggctcactgcaacctccacctcccaggttcaagcgattctccggcctcagcttcttgaatagctggaattacaggcgtatgacaccacacccagctattttgtatttttaatagagaggggttttgccatgttagccaggctggtctcgaactcctgacctcaggcgatccgcctgcctccgcctcccagagtgctgggattacaggtgtgagtcactgcgcctggccagaactcaattcttaattgtacttaattttaatcctttttgttttttctactgagacacggtctgtctctattgcccaggcagttagttcagtggcgcaatcttggctcactgcaacctccacctcctgggctcaagccatcctcccacctcagcctcccgagtaactgggactacaggagcatgccactatacctggctaatttttgcatgctttgtagataccaggttttgccatattgcccaggctggtctcaaactcgtgagttcaagccatccacccatcttggcctcccaaagtggtgggattacaggcgtgagccaccgtgcccagcctgattttaattcatttaaatttagatgcctgcatgtggctaatggctaccatattgaacaacacagctctagagcctgtggctgaatcagtgtgcaatcctccacctggaccagctcaggagtttttaactcaggaaatgaaagtccttaggttggtgggagtgggagcagggagaggagtggtccttggatgagcttcagggggtctgggaactgtctgttttgcatgtggatgtgcacatctgtctcgggagatgggctgctgccttcactaggttcccaaaggcatctgtgaaagatgaagagccagggggcagtggtggttttcagtctttagccttagacctcttttgcccaaggaaaagtttatttggactaccaatataatggaggaaaacagagcagtttttgttgaaatggggataagacccagaaacctcacttatctcagtggcccctgtgatgaggagcttctctgaagccatggaatgtagttgtttgaaaaccactgatgtaatcagtcaaggccttgggtgtcaccagccaagaatgagcggggcgtttgatctggtcgtagagtaatcctaagcgatgtaacctttcccccaaggagtgagtgtggagtgtcaggacattgggaacgggcagccatgactcccttccctctgccctgatatcctgatctggcctgtctctccccagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccatttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaattctggagtgcagctgagtctttgatgaggggatggggtggtttcatcaggaccatagaggactagggatttaagcataaatttctgaccttgcttcccttgaatgttccctaaacatcataaggaatgttggccatggaaaaataggccatccttggacagaggagctttcagaaggtccacaggggtgacgtccccattttattttatttatttatttatttatttatttatttatttatttaagacagaatctcactccgtcgcccaggctagagtgcagcagtgcaatctcggctcactgcaacctccgcctcctgagttcaagcgattctcctgcctcagtctcttgagtaactgggattacagatgcccgccaccacgcctggctaatttttgtatttttagtaaagatggggtttcaccacattggccaggctggtctcgaactcctgacctcaggtgatccacccgcctcagcctcccaaagtgctgggattataggtgtgagccaccatgcccggccaacacccccattttaaagatgaggcaattgaggcacagagcacttcagtggattgctggggtccactctgccaatccacacccctgcaggtgagccagggttatggctggggtgtgttttgttttctgtatttttcatgagctgctttcatcagcacacatgccccaaatggctgataaagccagactggatagttagcaggaaattgtaatcagctcaggggtttgtatctcatgagcaatggaaaaacaaaaacaagccaaaacttcagccagggattaacttcagttaagggattaacttaacccagaagaagaactttctggttgcaattgttgtaagctcctggaatactgctggcttttcagagatagaatatggggtgatttgagtcaaggaagtcacccagatcccactagtttctagagaatcttctccagctcctgccctggagtcccctaacctgagaagaagtgtgaaaagaggggaagataaccagaagaagtgccaccagagtcaaaatgtaagttttttatttttggcgaccacttactgaacacttgagtggcaggactgggcaaagctttttgcccatttcattatctcgtttaactcttgcaacaccttcataaggttggaactctcattatcccctttcagactgtaaactggggcccagagaggttaactgtatgtgtcacacagctggttagtggtgggaaccaggccattgtcctttcccaaacaccttgcgcagttattgagacctcagcaggtgaggaatcccctatggccagagtttattatcccagagtgcagaggttcctgggccaagtatggagagagcactgaggggccagacaggattttacaaaagtacttttaatgcagttaaaaccaacgccacacacccttgcctaagcccctggctctggtgcctccatggagcagaagggaacccccgggccgtggctgctgagctgggcaccctgcccatctctgcccacagagccagtcacctcctcacttcttcttggtcttcaccagtcctttctgcacaaggctgcggtacagttcctggatgtatgtgtagacgcacttggagtcgggcacagccaaccgcaccatgtcatccacgtccagcagctgagcacagtcagccagtttcctaaggaatggggtggaatgaggagcagaaggtcaaaggtgaaggatatgggagccaaggggatgggtgcaggcagcccagcaatgacgaagcccataggatgggctgggatgttggggctgggagatcatctaagccaatcatcccattatatatctagatgagataactgagaccccaacagagttaagacaaacccaggccaggtgctgtggcttcctttaggtaggtcacaggatgtagacaggtaaccccaaagccaacaccagtgaataattcaataatgagttttaggccaggcaca

SEQ ID NO: 12337 - DNA, 111459 bp, Human
  misc_feature (1)...(111459): n = A,T,C or G
acacctaaagaattaagattgacatgaaaaagcatttataattgatagtatctttgagttcaaagctctgcatatctcattatcaagttcaaagtaatgctgtcattttttctcagtaacgatgctcttatctccaagatgacaaagctgacgggaacaagatcaggaagccgagtctgggggttgggagttgaaccctacatctcctgactcccagaccccttttctggtgcctctttgtcactcaagctgtcaaacacctttgcacgcagcagtgtcccttggctgggtgtggtggctcatgcctgtaatcccagcacttcgggaggtcaaggtgggaggatcgcttgagtccagaagtttgagacaagcatgggcaaacatggcaagatctcgtctctaaaaaagaatacaaaaattaaccgatgcatggtggcatgtacctatggtcccagctatttgggaggctgaagtgtgaggatcactcgagacactgcatgccagactgggcaatagagcgagaccctgtctcaaaaaaaaagtgtccctcgtgggtttggttgcatgagaatgcttggtgttcaattcttgaggttattagaagattgaactttgaaatcatcccgcaaccttgaaccaaaaggtgaaattgtccactttgatagatgacaacggaaggatcctttggttcaatggacagcttgtaaatataaaacagttgctggaaaattatattagagatgagctatctcctccattacaatgtttgcttttctttaatgcgattgagttccaacagaaaggcttgggaggggccacaagcaatgcttcaggagttactggaagagagatatggggagtgagagaggagatccatcgatgtggagcaggggccaggggaggccttctgcccaggaggcctgtgctgaggaccctggctgtgcccaagggaaactgaattcagagctcctcctgcatcataaatccaggacagctggcagctctccaaggaagactggcgctaaactccaagggcatcagccgccagattggccaacccctacaatgccctttgagagctgagccccaggtgtgttgaatcgggattccgttccaacctcatgaccacattcatttacaagccctgcattttgttaatttaaaaatgcactcaccaggagggaaggaggagaggctccattaaatataagacagctgaaaggctggaattcttctgacatgcatgtcttaggaaggagaaggcctgaccttgttctttttttttttgagacagggtctcactctgtcacccagactggagtgcagtggtgcaataataactcactgcagcctctacctactgggctcaagtgacgtgacctcccacctcagcctccccagtagctggaactacaggcacatgccaccatgcctgggtcgctatgttatcggggctggtctccaacttttgttctccagcgatcctcccacctcagcctctcaaagtattggaatacaggtgtgagccaccgagcctggccaggcctgacttctgaatgcattcgtttcttgatcttttaccccgagtgcacgtgcaagttgcacccctggccactgggttttgcagagtgtggcgttccagtgtccggggccccacgcccgtccgcaggctactggaatgctgagggcgaggaggcttcgctccacgcacaccggatcggcctgcacttcaggggccaggtctacagccttccccagcgcagacgccgccggcccggccggttcccgagggcggggctgcgcggcctcacgccccgcccaccgcgggcagaggcggggcatgggtcacgtgacggcacgccgaccagcgaggccccgcccggcgggaggaggcccggccgcgacccgggccgcgcgctgaggagccgcccggtcgcctgcgcgctccctccggcggcgtccccagcccgcggcccctctgctgccggcccccggctcgccggctgcgggagtggcctcaagatggatgaagacggcggcggcgagggtggtggcggtgagtgtcggaggtgtggtgggctcgccggcggcctggggtcgggggccgggggctgggggtcgagggcgcggcgctgggccggggttcgccggaggagacggggtcgggggcagcggcagcggcgtccgctggaggcctgaggcacgccgggccagggccgaggctgggtctccgggggccgagggagggggcgggccggggtcgccgttcggcgctggcgagggtctgggtaccaggccggggctgccgcgggctggggtcgccccggagtctcgggccggggtttgggtgtcgctcctctggggcgggggaccttgcggggcgaccttccccgcatcttgtcgccaagggcgttcatgccctccggagcccggcgtttcggacgccccctttcagctcaggtgggcggaagcggctgagccggtgggaaaccgggaggggaaagttttgcactggaggctcctcgagtgtacaggacgggagggcaggggaaacggttggaaagcgtgacagtctgcttggctttgggtcagaaacggtcgctggatttgctcgaacggggagggggccagctggagttcagttcagggtagacgttttaggaaacggcagacgcgacagattgagcaaaaaactccgtggagccgagggtgggagacacgagctgcacccagcacagaggcaagaccggagagccaggtgtgcccggagccaggtgtgctcccgagtgggtcgggtcgatgcgcgtcgtggcccaggtggtctgtgtctgacgttcggtttcctcttgctggaggaatcgtgtttgttggaaattatttagtggaatacaaatgactgctgggtcatgctgggaattagattttaaaaacagaggaacgtgcctctgtatggagtgggtgttcgctttggaaagcaaagggttaatgcccgtgtttttacaggaacagccgaagttgaggttctctagactttttttttttttcctgaagatctcctttgagctgacagagaaatcatcagaatcatcagaaccccatgtaataagggagcagtttagagaaatcttaattacaggctgccggtgcagctgcctgtaagaatcagcagtattgaatgcttcaggatgaagtggttcatcatcaaggtgccttccagaattcaagtgctgctcagagggagatgtttttttgctgaaagacgcgatgcagccaggatggtgggaagttggcacccgtcatggcatttggcgagttcagttcttatagttgaagctaggggtagcactgtggcaccgagtgggtgtgttgatgggagcgctgtggaacgaaggcgcccagttgcgaaccctcctacagtcaggctgtctggagccatgagatcctaaggaatgggttcccggtggatgtcgtgtttcctgcctgtcacaatttgggcatagctgttttcccttgttagaaaagaaagacaactgtaatatgcagacgttggacattagcgtcaaggcagctagctggcttggcagttttgtttgtaaggtgctttgggctctgtgagtaaagaaatgtagacttgaagattaaagcaggaataaagaggaaaagaggaggctttaatgtgctccagcaatttgcaggtcttgagtactataacaaaggatgatatgaagtatcaaaagtcttaaaattgtccttgggttgttagtatctcttctgggaatatatcacagggaagcaaccttgaaataaacccctcacgtataaagatgtgtattatgctgtttaaaatagcaaaaaattggaaacagcaacgccaacagcaggggcatggtgaggtaaattatgggaagtttattgaagtattttacaaccattaaaataagcagttttatacatcatggtttaaacaacataaacattggtgacattatggattattttattttctttttatattttccaggtttctggaataagtgtgtatttcagattggaaaaaaaccatcaaagacgtgaatgttttaagtgtatcatttaattcatctcactggaacattcaacaatgaagatttatttattgattgcccatcaaaatgctagccagcatgttaggtgctggaaaataacttttaacctttattgatttagtttatgactagctttctcccttgctttgtgacagacacttaaaaatatttttggcaatattaggatatttatttttgaaacaggtgaaaagcaaagttttgaaatatgagtgatattgtaattattgtataaactttatgtgcttacatttaactcttggctgttgtaagttttgaagttaacatacctctttacagttaataccgtttagatttttaaatgctttaaaattcatgtttaaaaaaataaagttgagctcttttaaagaaaaccgtttcagctgccagcagattataaagcataacattttttggtatatttttagagtgtagtacataatgttgaactgtatctgggggagtcagttaaagcttgtttaaaagatagggtaaataatctattcaaacagtagttatggtagaagccaaagataattgaaaaggtcttttttttgttaatggtcaggttaaaagacttgaaaaattgattcctacttgctatttttataagttaatttagctttttgtccactgtattgttctttcaatgcaagataaggagagagaggatggtggcatgaatggctggaaggcagttacaagaggagcgagtggggggcacaagattacaagaacacattgttccttacagtgtgtgcagagtgtagttaagtcgtttttaattcctatgggactttgttgcctttcagtttttcgagaacagttcttgagctaattggagggtagctggctagtttggctcattgggattgtcttcgtgtcctgtttgggcatttgtctgattgatggtcctgaatggaccatccctggcagatgaggtgaattaactataattggcattcttctctctgaccccttcactccctgatcaatgtaggtgtctgtgcttcaggtgaagagatgctgagccttgttcataataaaatacatgcaaattaagactagattgagctcccacctttcaccttcagacaggtgataacccccaagtatacaaagtctgtttcaagtttgaaatatttgaacggcaaggtcgtttcaaacatttacgggtaagagtgtaaagtagccacaggcagggtcagcccatgtcctgttggctcagatccgtttcttgccctttccctgcagggactcacccctgcaggcaacatttcccaggcccttggtcagctggcttccggctgggattggccactgggagccactggcaggaggaatggcaggaagaaggacaaaaacaggttatttcccttaggcctgcctcagggagtgtctctggcaggtaccttgtctccttttggctccagctcctgccccttggtcctagcctttgagtcttggaaatacctcctcccttttaccctctatttgagaagtggtaacagcagcttgctcttgataatctttgtattatcatttcctgtttggcttttcagtttttccatcacccctgtcactaattccttatattaaattccctctatatcagattcttaaagggatggtttctctggatgtctctgtttctctgggtggaccctgatagatacaggtgctttaggcagtagctttaaaaattacaggcgtgtaaatcctttgacccagcaatccagttctaggaatttaacctgcagatatatttgtacacgtgtgagataacataggtacaagattatttattgccttgagtgtccatcagcaagcaagagacttatcagataaatccatgcccagatggttaatgaggttgtaaagttgtagaaaggaacgaggaagctcttttcttagttgacatggagagatctccaaaatatcttaagttacaagagcaggccgggcgcggcggctctcacctataatcctagcactttgggaggccgaggcgggtggatcatttgaggtcaggaattcaagaccagcctgggcagcatggtgaaactccgtttctactaaaaaaatacaaaaattagccgggagtggtggtgcgtgcctgtaatctcagctacgcgggaggctgaggcaggagaatcgcttgagcctgggaggtgcaggttgcggtgagtgagattgcgccactgcattccagtctgggcaacagagtgagaccctgtctcaaaaaaacaaaacaaaattacaagagcaaagtgtaggaaagtgtgcattgcgtgctcccattcttgtgttttgaaagaggaggtaatggctgatgcatgcagattccctggaaggtgaaaggaggaaccaataacaatggttacctgattggggaagatgatgggaactgagtggatggggaatataggtgggaaggaaacttttcactatgcgcctttttattttttgaaattcaaaaaagtttgaataatctgtcttcactttttctaaaattggaaagcagtttcatagaaaaatagtatgatggtaagaaaatacccattttacaccttttttgagggaatttttatagattaaaaaatacagctgggcgcaatggctcacgcctgtaatcccagcactttgggaggccaaggcgggtagatcatgaggtcaggagttcgagaccagtctggccaatgtggtgaaaccccgtctctactaaaaatacaaaaattagccgggcatagtgatgcgcacctgtagtcccagctgctcgagaggctgaggcaggagaattgcttgaaccctggaggcagaggttgcaatgagccgagatagcgccactgcctggcgacagagtgagactcggtctcaaaacaaacaaacaaaatattctgggaagaccgcaacaaaaagataatgtgatatgcaatgtaaggttataaaatgttacctatttttcattctgtagtaagttaactactgtatttttgagagtttaaaaagtggatgcttttagattatgcttagagtatattcttttgtagtcatttactcaaatgttgatggtgtctctaccaaataccaggttctatgcatggcacaagagctattagtgcctgtgtcatgccgtttttgcattgctataaagaagtacctgagcctgggttatatataaaggaaagaggtttcatggactcatggttgtgcaggctgtagctgtacaggcatggtgccagcatctgctcggctcctggggaggcctcagggagctttttactcataatggaaggtgaagcaggatcaggcacatcacatggctagagcaggagcaagagggaagagatgccacgcccttaaacgaccagatctcaggagtcctcactcactattgcaagggcagcactgagccatgagggatctgcctccatgatcctgtcgcctcccctccaagtcctgcctccagcattggggattacagttcaacatgagatttgggcggggcatatatccaaactgtatcagtgcctaacagtggtgaatacggcagataaatttcccacgttcatggagctcatgtttagatggagagacagacaaaagaggtaaacagctatatataaaataatcatgtattatgctagatgtgttaaaggaaatcaacaagaggttgaggaagagaaagtgtgggatgggagaggtgtagggaaagcccgtggccagggaaggcctctgaggaaatgcccttcgaggtgcaatctataggggtagtggaccagacagaagggaaggcatggagctggcaagagctgagtattctagagaattaaaagcagctttgtgtggcttgaacagacagtgaagcgggagagatagactggggccatgtcaggctttcagtagctaaggaatgcagattttattctaagtacatgaagccgctgaaagatttttaaacggggaaatctcatttgatttacatttcaataattttagctaatatttacttgatgctgtatgtcctgtgtactttctgcgtcttaatttattgactcttcatcatattgctattttcagattggaaaatggaggcatagggaagctaagtaattggtctgaaatttcacagctagcaggtgatggagctgtgattggaacccaagccttccatttcagaatccgtattctcaaccactgccccctgctttttaaagaagcatattcttgactcctgagtggagagtggtttggaggagaagggaggacttgggagaagggaggtgttgcagtggttcaggtgagagttacggggcttggtgggttagggtggtagtgggaaatatggagggaaggatatatataaaacacatctgtataaaacatacagaaaagtacaaagaataatgaaaccagcactcttgttcccactactcagaattgacataatagctgtcaatgttctgttgcattttttaggtccgttttttaaaaaataaagcattactggtaagtctctccatctcagtatattgtggtgttcttccagttgctcaggccaaaattttggtgccatctttcacttcttttgccttaagccttctcatggttctcccattgtcatccttgttcacactgcagccagggcgattccctttgacacgcaggtcatgtcactcctctctgaaagtttgctctttcctcggtttattgagaatcctattctcagaccaccttaccatggccatggcccacacgctgtagtttaggggctgcaagttcttcttcttcttttttttttttttttttttgaaatggagtcttgctctgtcacctgggctggagtgcagtggagcgatctcggctcactgcaacatccgcttcctgggctcaagtgattctcctgcctcagcctcctgagtagctgggactacaggcgcgtgccaccatgcccggctaattttttgtaattttttttttttaatagatacgggtttcaccatattggccaggctggtcttgaactcctgacctcgtgatctgcctgccttggcctcccaaagtgctgggattacaggcatgagccaccacgcccagccaagcttttttttcataaaagggccggatagtaaacctcataggctttgtgggccacatatgatctctgtcacaagtctttttttttttcataaccttttcaatatgtaaaaaacattctgaccttggggactgcccttgactactactctagtcccctgctatctctttgacattgtctgttgctcctctcccgtttcctccctgactctgctctgtctcattggtctccttgccaagcacactcctgcctcagtgcctgtgcacttgctgcccctgtagtggtttcctcttagatacctgcatgtggtgtatccttgcttcattcaagtttgtgctcaaatgtttccttatcacagaagtcttccttgaccaacctatctaaaatcacattcattgttactgtcagctctatttttctcccttagcacatgtcacgccttacctattacatatttgtttcttttctcttacaatgtgagttctgtgaaagtaagaatattttctgcttttatccagttatatctccaagatctagaacagtgcttggtacatagtagcctttcagtaaatatttgttaataaatactgaataaagttgaagtcacttgtgtctagcaatccctggtccttttgctctttgctttcaatgtttcttagaggcagccattatgaattcgatatggggccctctggtgtatggtgtttttgttagttttttgagatggagtctcactctgtcacccaggctggagtgcagtggtgtgatcgcagctcactgcaatctccatctcctgggtgcaagcgattcttctgcctcagccttccgagtagctgggattacaggcaggcgccaccacacccagctaatttttgtaattttactagagacagtgtctcaccttgttggctaggctgctctcgaactcctgaccgcaaatgatccacccgctttggcctcccaaagtgcttggattgcaggcatgagccaccgtgcccagcctggtatatatttcatacttcaacagatgtgcgtgtgcctctgtaagcaatgtacaggtctcctttttgtttttttttcttttgagacggagttttgcccttgttgcccaggctggagtgcaatggagccatcttggctcactgcaacctccgcttcctggattcaagcgattcttctgcctcaccctcctgagtagctgggattacaggtgcccgccatcatgcccagctaatttttgcatttttagtagcgatggggtttcaccatgttggccaggctggtcttgaacttctgacctcagatgatctgccggcctcagcctcccaaagtgctgggattacaggtgtgagcaaccgcacccggccctaattggttttaaaaagattataaagccgagatcacactgtatgtaatcttctgcagcttgcattagagattatccttgtgattatatatagaccttgtttaatttaactgcgatcacgttttgtctatcttgtcctgtgttgaactttttttttttttttcctgaagttagtgtcctcactctgtttcccaggctggagtgcagtggtgtgatcttggctcattgaaacctctacctcccaggttcaagcgattcttctgccttaaccacttgagtggctgggattacaggcttgcaacaccatgccctggtaaatttttagtatttttagtagagacaggtttttgctacgttggccaggctggtcttgaactcctgacctcaagtgatccgcctgcctcggccttccaaattctgggattacaggtgtgagccaccgggcctagccctgtgttcaactttttaatgtcaatgttacactggtggtgttacaaacggtactgaggtgagctccctagtcttctctcccctcacaaatgtgagtttatctagagtatatttctagaattgcagttgtgagttataggcatgcttcagttttaatagataacagattgctttctcattaggggcttgtgagtagtgtgatttcccagcattctaatcagcacacagtgtttgccttacttttaaatatttacctatctcatgggtaagaaatgatgtattgctttaatttgtgttgctttatagtgacaaaatatatattttaaaagctgttatattaggttcaggggtacatgtgaaggtttctcgtaagtgagctcttgttatgggatggaatgtattttggagaatcagatggacatactgtcagcttggagaaggttagaggtatagaaactgtaggaatcaaatatgactttaggtttctggcttggtagtggtgttgcttaatgaacaggggaaaaaactattgtgagggttcatttttttttttggtcaaaaatgcctttactttgcctccacttaaacacaatttttttattagagtcgcgctctgttgcccaggctggagagcagtgacgccatcatagctcactgcagccttgaactcctgggctcaagcagtcctcctgcctcagcctcccgagtagctaggactacaggcatgtgccactgtgctaagcttgcctctgtttttgaaggatagtttcatcaggattatagttggaggctttcaagttaatttattgcagtttttaattttttgtaaagatgggaggtctcactatgttgctcaggctggtgttgaactactggcctcaagtgatccaaagtgttgggattacaggcatcagccattgagcctggccttcctacagtgttttgaaggggtagttttactgctttctggcttccactgattctgtggagaagtcagctgcatcagtcttattgtcactcttttccagttagtgtgttttttcttccctttaggctgcttttaagatgttctctttgggtttggttttcagctgttatgtggtgtgtccagatgtggttttcctcaagtgtatcctgcttgggattagttgttctttttcttctctttggcagtgctgtgacaaagcttgatcttaaattagatttacagaattcttgttcattatctcttcattgattgcttctgctgcatttcctgtctcatctccttccaggactgtaattacctgtgcattaaacatgccctctgtgtcgtgtcctgtatgtcttagattcttttctgtgtcctttatccctttgcctctccatcgttcactctgtatcttcttctgacttatattccattgtagtaatcctttcttcagctgtaattgctgttgaactcgtttattgagttcctaatttccattattgtcttttccagttttcttgattttttttaaagattccaattttctgctggcattttttatcttgtcaactgctttattgtatgaatcagagttattttaaagtctgtgtctgataactccgatatttggatgccttgtaagtgtgttctgttgtctgttttatccttggttttcagtcatgtgatcttgattctagatatgcctgttgagctttaattaaattctggacaatgtatgtgaaaaattatagagataattcaagaccctgcctgttggcttcatttgaggatttggcaggcagttaaagtaagggaatatcactttgcccttttttttttttttttttttttttttgagacagggtctcactctgtcgcctaagctgaagcacagtcaggctcaaatgatcctatgatcctcctacctcagcctcccaagtagctgggactacaggcacatgccaccatgcccagctaattattttttatttttgtagagccagggtcccactatgtttcccagactggtcttgaactcctggcctcaaatgatctgcctgcctcagcctccaaaggtgctgggattacaggcctgagccacctcacctggccggaatatcactttaaaattatgaggcatggtctattctggtttacccttcttctaggttatagcctttagtggttcccactgaaagcttgggttgcttcccagggcctcttctacttggcagcccctgaactctaatttttgtcccctcagtcccctaagactggtggctattctgctgaccttcttggattctcagtcacttgtttctgtttggtattttggcttcccagcttctgctgtgaattggcgaatccctcaaggagaaaaggggccccggtgattgggctcacttttctgcactccccttttccctctggaatcctggcctccagagtcctcactgcatgggtagctctctgatgccttcaaacagttgtttctaataatttgttcagttttttaagttgttcttggcagaaatgttggtctgcagtgagctagtcagctttactggaagcagactctcaggaattcaattttgctatttaaaatggacttgttagtgagatatcctggtggagatggtaggtaggcagttggctgtgtcagtctgctgctcagaagactaatttgggtaggagataaacattggggagattttaattcatgcgggtggaagagctcacataggaaagagagttgagagaggagaaaaatcctaggactgaggacagcacagcaaaggggactgggagggtaaccagtgaggcctaggaagccttgaagattgtgtggcattgcagaagagagaaggagtgatcgatcagctgtgttgaatgcacttagagacggcctaaaatggggatggggacatgtctactggacttggtgatgttaaagaaaaacaatttggggagaggcagggagctagctagactggagtgggctaaggagctagtgggggaaggtgtgtctttgctgaaggaaaggcacgtgccatgggccttaattggaaatgtggcatgttatgagaatagaggggaagcctgagtggctggagctcagtgagggaagggtatgtttgttttgcagtgaaatacttctcaaggaagttttcacaggagaccaataatcatttctatcaggcatgttagaataataatgctgtttgcattttcacactcttagtataagtaactttgggagaggtagatatagttttaagaaattattggcagatcctttaaaaagcgggtttgtcagcttgtaatatgagactgttgaaacttttgaaatgaaatgaaattttaaaagtaggttttgtcaaagtaccctaaaagctgcttaagatatataaaatattggctgggcgcggtggcacacgcctgtaatcccagcactttgggaggccgaggagggtggatcacctgaggttgggagttccacaccagcctgaccacatggagaaaccctgtttctactaaaaatacaaaattagcctggtgtggtggtgcatgcctgcaatcccagctacttaggaggctgaggcaggagaatcacttgaacctgggaggcggaggttgtggtgagccgagatcacgccattgctctccagcctgggcaacaagagcgaaaatccgtcttaaaaaaaaaaaaaaatatatatatatatatatattatatatatatatatatatatatatatattatatatatataatatatatatatataatatatatatatattatatatatgtatgtaaaatattttgagtttgtggggaaaatagtaaatcatttaaatgagagtagaaaatacatgactctccatcctgtttttgaagttaacccaacataaactttttatagttaatgtcaggtacccaattaacatagaatagacatgagattctgtagtgctttataatttggctggagccaatacagcaagcatttatttcggataaatatcttttcactattatgtaaatattggaagagactcgcctgagtcaatttcagttggccaagaagatattttgatttactttcctcgagtaaatttactctttgagctgacttggtttttagtaagtcaccaggaacactgttcaaataggagagaataaaagttcctgctttaaactctcaacagggctattgttaattactgtagtcttcttttgaaaaacttatgtctgtaattaataaaatcagcaatttgctgtaaaacaaagcatttggatgatgatcagaaagtatttcccaatatctaggtaattagtgatttttttcccccaagttttcatccagatgtttggcaatgtgcagacacaggcttactgcaactttataattcactttcatgagaacatataatattctccgtttattttggacatcagagtttcctttttctctggacagatacgtatgaaacacatgctctttgagtggagtttgtggtcctctgagaattctctgaaggaggaaatgggttgacctatttggttgctatgaagtaaaaacaatcttgttttcattttttagtgaacatctgggttgcatttattatttcacattctggagattctgtaaaaccacaatttgataatatgagggttcatcaaagcggtaattattgagctatttttatagttgattcaagaattagggtggctgatagactttaaacaatattttttcgtttctataaaatgtaacttaaataacaactcttgatttgaaaccataaaatgggatgtagatatttgggggacagaagaaggattgaacaaccagtttatttctctgttgcctgttgccttgtagcttgtcgtcattgttacagccatatttgactctgtgtagaagacattgttgatgccctattgcaaatccacccttctttgcttccttgcccacagaaccatgaattgtttacatatttacccatcagggaagaggactttatcaccacaaagggctatatcttaaatagtcttagcaggtgggataatccctctttccttatccataagtggaggagaggtgaaagtgtcacccaagtctggccagtatgcagggcagtttgcagggggatgtctgcaagaagtttcttccttcacaaataaatatatgaggagttgcgtttcttttcttttcttttttttttttgagactgtgtcttgctctgtctcctatgccagagtgcagtggcatgatcatggctctttgcggtctcaacctccttggctccagtgatccccccacctcagcctctcaagtagctaggccctcaccaccacgctgcgctaatttaaaagtattttttggaaaaaaaagaaaaagcaaaccaaagaaacaaaaaatattttttgtagagacaagatcttgctacgttgctcaggctggtcctaaactcctggcctcaagtgatcctcccaggagtgagccaccgtgcccagccctgttgcatttcttatgctagactttgttggacctggatgagtagccagcttgcattcacaatggctcttaattaagcctgtccatttccaagcccacaccctgaggatgaccagcgggattctagatggtgctgttgctgaatttcacccacccaggaacctccctacctccacacttcctgtcatgtgggacagtaaatacccctcttgtttaaatgattgaacagcagtgtactgtaacttggagctcaaggcatctggtgtgatactggctgtagcagcaggtaggtttcattctgtcattcattcagtaaggatctcctcgccatagagtgcgaagagaaaaacaccttttctctgccataaatattcattaaccatataaatattactttaagaacttggctaggttatattttctttttgagactaacactttctccccttttaataaaacaaaatacgttttcgtattcttagaaatacattgtttcatttggcaaatctttatgtgtattttaacgtgtacatttagaagtatgcagtaatcaaaggtggcattggcaatttaatattctgttagaagacaggacttccttttagttctttacagagaggaaataaaataatcaagaatgtccttttccaagtttcagtaattagattaaaatttttttgagttgagaaaggatcagacaaatgaattcagttttgtttgtgttagagtatgggaaaattgaagaattttagtgtcttttgaatgtttggcctgttcacatgatgaggctgtatttcccaggcgtgggaagatgagtgattgtagactttgattcagtatatgaccacacttctgagagcatgacacatttcgagaataaatgatgcctttcattgccttatgtaaaaaaaaatcttcacgttggataagtcttcttctaaaatgttgcgttttctcgggaatcacagggtgtctgttatggactatgttcctgaaatttagttcaaagtagtggttaaactgtatactagtcagatggttactaggatgtttcagttttcacaaaagaaagtcaaatgccttctttccttcctttttgtggtcagactggtcttgaagtctgctagctcttgctcgccacacgttgtcccgccagcttcactcttgatgacagctctcagagggagcagagtccacatggatgtggtgtgtcctgccctcccttggctcccccagtagttgctctgcctgacaagtgcccagtaatttggctggacatgcagaacatgactttttaatttttttcatctggaaagaacataagctatttcccctgggttctgctgctgttagtacttggacatttgttttaggatttaagtctctattaccttcccactgcttccaccgctccccactttttccttctcaggagaggagtctgggggcttctctctttgcatgtcttcctgtcaagtattacctattatgattctggtgaagagcggactgtcttgcatctaaaggtaatgaagaccatctacttcagaagtcttgttaagttctgcgctaaaacatttatctcccatttctgttatacctgtaaaggggagcaaagaatttgtgtcttcagagagaagtccactatcctagtcctttcagcccccttgaggtttggtgcaggcctgcctgggagttccacaaatgggagtgtgctctagggccccctgcctgaaccagtggccagtgactccctttggagagaatatcccggcagaagttctcgagtctcaggacttgctgtaggcggttttatcttggtttcagccatcaagaaatgtagttgattggatcagtgactgggaatttcaagaacagattttacaggagtgctgtttccttagagttgtaaagttattgacagggccatttcaactttggttaaacagattaaaggttggccgggcgcaatggctcatgcctgtaatcccagcactttgggaggccgaggtgggtggatcacgaggtcaggagatcgagaccatcctggctaacacagtgaaaccctgtctctactaaaaatacaaaaaattagctgggcgtagtggcgggcgcctgtagtcccagctactcaggaggctgaggcaggagaatcgcgttaacctggaaggcggagcttgtagtgagcagagatcgcgccactgcacttcagcctgggtgacagagggagattccatctcaaaaaaaaaaaaaaaaaaaaaaacagattaaaggtcaaacttgggtagtcacactaacctgagcgtctcccccacatagggagtctgtaagtccttaatttcataagagacttgaagtagaagctgttttctcctgatgtccccaacatatccctccctccctatcttgatgaggtgctggacccccaggactactgcagtgctgtggtgggggcctttctggtcctcagcccagcttcttcacggccgactctgttgggatgcatcatgctggagataactatgtagccattccttcctaaatagtcttagtcctgtgggattggagaggccctcttttcccttggggtctctaggaattaggatttcagaacttttccctgtttgctatatcaggtcagccattgaggatatttcgggtaattccccttgttcaaggcagaatattgtcatctataatgttaatggttctgagaatttgtattcatactttctgtatgcttacataagtttgtttaaacatttgagcctgattggtgttgacaaatatttggtattgacatatttttaagtaaatatctgcagctctgtcatttctagccttgtgattttgtgtaagttacttaatctccctaagctgttaaaaaaccgaagtgaaattatttatatgaagaatttatcaaaaatctcgacgattgtaatagtaggcattcaaaactgttagtcatcagtgtgttaagcctctggcctgcctgtctttacatactgagtagagtgagttggaagaattgttttatttgggctgaggaataactgatgattggcaatatgattattatatcttttcttcccaactttgtattttgaaaatgttcaaatctacagaaaagttgaaggaatggtacgatgaatcctatatgtctttcacctaaattcaccagctgctaacatttggccacatttgcttgtctgtctttgtattacaatttgtgtgtgtgtgactgaacccatttgaaagcaagatacaaacatgggcaggtgcgatggctcacgcctataatcccagcactttgggaggccaaggtgcgcagattgtttgaggtcaggagttcgagaccagcctggccaacatggtgaaagcctgtctctactaaaaatacaaaaaattagccgagcattgtggtatgcgcctgtaatcccagcttcttgggaggctgaggcatgagaatagcttgagcctgggaggcggaggttgcagtgagctgagatcacgccactgcactccagcctagacgacagaacgagactccgtctcaaaaagttacaaacatcataacgcttttcaaagaaatactttagcactcgtcttctaaggacattctcctacataactacagccgttatcattcttaagataactaacagtcattccataatattgttccaaaatagtacacattctgctttccccagttgttaccaaaatgtttttatagctttcttttttttttaaacctatctaggctctaattaagatttacaccttctatttagttatcttttatcagtcttatttttgttgttgtttgtttgtttttgaggtggagtcttgctctgtggccagggctggagtgcagtggtgcgatctctcagctcacttcaacctccgtctcccgggttcacgtgattctcctgcctcaccctcctgagtagttgggattataggtgcctgccactgcacctggcctcctttctttattttttattttatttatttatttttatttttgagacagagtctcactctgtcacccaggctggagtgcagtggcatgatcttggctcactgcaaccgctgcctcccgggttcaagtgattctcctgcctcaccctcccgagtagttgggattacaggtgcctgccactgcacctggcctcttttgtttatttatttatttttatttttgagacagcatctcactctgtcacccaggctggagtgcagtctcatgatctcggctcactgcaacttccgcctcccgggttcaagtgattctcctgcctcaacctccccagtagctgggactacaggtgcctactaccacgcccggctaatttttgtatttttagtagagatagggtttcatcaaattggccaggctggtctcaaactcctgaccttgtgatctgcccgccttggcctcccaaagtgttgggattacaggcgtgagccaccgtgcccggctgtttttaattttaaaatgtgttttggtggctgggtgcgatggatcaggctggtaatttcagcactttgagaggccgaggcaggcggatcacttgaggccaggagttcaagaccagcctggccaacatggtgaaaccctatctctactaaaaatacaaaaaaattaactgggcatggtgctgcatacctgaaatctcaagctgaggcacgagaattgcttgaacccaggaggcagaggttgcagtgagccaaggttctgccagtgcactccagcctgggtgaacacagtatgactctgtctcaaaaaaaaaaaaaaaaattgttttcgtgacacctttttgaagagtccaggcttattgtctaatatcattatttgcatcctatagactagattgcatgtgtaagcagaattgataagtgcttcagtttctttaattttttaattgtaaatatgttaaaaatcattttgattcaaggtaaaagtgacattcatttttcttgttctttggtaagtgtggattaagttggtaaccagaaggagttacggagtggttcagatgtcagtggaatgtgtgtgtgggtaaatttggaacaagcatccacagtggtttctcagactcacacccatccggaggtagttatctggcttaacatagtgaggattttattttaatatttggccatggttttataaagaaatgaacttaacaattggaaaatttagtaagacaaactatatttacataattttcaagagatacttttgctgtcagatccttggatgaagactaaaccttaaatctctcaggaatgcatctttttcttcttccctccctcaacactttcctattgatttaaaaaaagagctttaactgcagctgagactaatacaggatccagctgtagcttttttgttgttgttcatgtatccggtgatgggcacagcaaactcattgtatgaaaagccaataaaggaaagggcagggtgggaaaaaaaatgacactcctctaaaagtattcaagaaatagcaacagggtctcggagtctccctttcagatgactgatttaaattccattctaaagtattaattttgttcgtgactagtctagaaggcattttaattttcccttttaattatgtacacgccacgtaaccagagagtatatgtgaggctgacacattattttccttggaggcagaaaatagtaaagcatgagaacccagagaactaaacgctcctcttgtaaaatagggcaaagattcttcaaaatactgttcatgttcatgctggtatagagatagcaaggatctgtgaaagaaagccagtttctcttaaatttgttcagtagtactcaaatttatgcatttaccatacagcaaataaattcagaatcagtagttcaatcaaactacattccacatttgcctatctgtttcagtgtaatttctataaaagatttgcatcttctgctctgtcttaacaggaccaggtccatatcaccatcctgtagctgaaaatgaattatgttttaaagtggtttttatgatcaatgtaatgatcataagactagtgattttcacatacttatctcaagcattttgtttttcttttttcacattaagggggtcagatttctcatatttcttgtaattgtagccagacgtcctgtttggggactattaaataccaatggtgcctgtgaagaactcatgcgattctgtggtaaccatctgagttattctttgtagatttgattttatggacaggcctctttgaagtcctgtactctatttttagaagctcttttttacgtttccgtggttcagggcatcagtcataaacatatttattattcagcacaaaaatgttgttcagtgtcttaaggctgtttaaactttacggaaataataaaccagtggcacttcagtggatgtaatatatgagcactactgaacaaatttaagggcggagaattttgcggtccttcacagattgctgctctgtctgcgccgccatgaacggtattttgaagaatcctttcctattttacactgagagggttccgtctccatgcttctcacacgttttgattttctgcctcccactgaaagaaacgcttttgtagcccttcaagaaacttcctacatgtctcccctccttctctcctgcctcattattactcctttaaagaaaaaaaaaaaaaagaatagtctgatagctttcttttcagatttattttattttatttattttttttgagacggtgtttcgctcttgttgcccaggctggagtgcaatggcgtgatctcggctcactgcaacctccgccacctggattcacgcgattctcctgcttcaacttctgaagtagctgagactacaggcgcccgccaccacgtccagctaatttttctatttttagtggagatggggttttaccatgttggccaggctggtcttgaactcctgacctcagtccacccgccttggcctcccaaagtgctgggattacaggcgtgagccactgagcccggctcttctcagatttatgtatgattggtttgctgctctgtgttgtagcagagaccctgtgctctgaagtaatttctgatccagtgaaatattacaggagcgagggactgtgcaccttcagtgtatttggtaataaagcacctattctctttttagaaatcactataatccacatgccattatagtcatccttttaaattacacaattgaatggcttttagtatattcataaagttgtgcgaccatcagcactatctaattttagaacatttttatcacttcaaaaagaacctgggccccattagctgtcatcccctcctctgcaacccctggcagtcattcattgactttttgtttccatggacatgtcacgtaaatggaatcatagaatatgtggtcttctgtgtttggcatttttcactcagcaggttcatccatgttgtggcatgagtcattttcccaggttcatccgtgttgcagctcgattcagtgtcagtgtctgtgcttctcctgtgggtggaactgagacttggattggttttagtgttgggagtggtcagagaggttttgctcacctctgtcacatggttgaatctgtggctgtgtgctatcttgaaggtttttaggtttgcttgtgttttcttcctattgaaaaggttgaagtttattttaacccgtattatttgaaggaccacatcaaatccttgctattgaaatcctttagttgataatcttatgaacagttgcatctggagtagaatcatgttgtctgtagaaagtttttactctctctgaagaccaatagtgggttcaagaaacagaattccccaagggagccatactgaaatctgttaacagaagcgtgaagagtctacttctcggggattccagtgtgatcccagtggtggacataggacaacaaatttccatcccctgttcaccccaaaatctcgacaaatgacagggaagagactgggatggggggcaagtggggagaagttggtcaaagcgtacagtcttgcatttgtaagatgaataaattctggagacctcatgtacagccctgtgactacagttagagataacgtattgtatgcttgaaatttgcagagtgattttaagtattctcactacacaagcacaaggtaactatgtgaggcgagaggtatgttaatcttcctgactgtggtcatcatttcacagtgtctccttaatcaagacatcgagatgtacaccttgaatatatccaatttttagttgtcaattgtatctcaacgtaggtggggaaaaaagagcctgggaagggaccttttgcaaaggatagagtgtaacacacttttggaaggaaactacaaatgggaaacctataagcagataaaacagaaggagggtttagagtaagcaggagcagcttctgggcagcccctcacggggctgtgctcagactagttagtgtttggattttgggttctgttggtgatcgtggaaattgtgctgcaaataaggagaattcaaaggccctccgaagccactgtgctgggagggttttctacactcttctctgtcctttcctgttcctcttgttttgaggagtctacagcattttacccataagcaaattttctttacagagattggattccttgcctggggagaattggaactcaatgggtgtgtaccaacaccccaagtaaagctttttaacatttttgtttgtttgttttgtttatgcggcttctccagtaaagggccctatctttttcatccccaagagaagccctccagtggacaagctgtgctcacaaacacagaacatagtgaaccttcccatttgaaagggaaatcgagtgagaaaagttacctacacgcaacaccaaaggaagacatagctagcttcatcgcatttttaaatgtgtacaaacagcaaggacctccagatggatgaaaaaacccaacagcgtgaaagagaaaatttaaaataaaatttctatagaaacagagaaagctgacatcaaaagaattcagaagatagaacactgaaaaatggtcattggcaacttccaggaagatgtgacttgggcactaggctttgtctcacttcttacctcccctcccttgaatcaccagatccccatggaagtgattgagaaaaagagagatgaaaagctgaatcagaatagatagtgggatcagggtgaagaaataccagggcctgactcatcactctgtttccttagaactcagtgcagggttgtgaggaacatatggagatgtggtgttggctgtgctaatttgggagagcagagagcgagggaggcctgatgaccctgagtggccacgggcagccggggtgggcttgtgcagcagcgatattgatgagcagctgaactgggaggccagaggacacacgcggcttcaacacgctcaaaactgctagagcttctcctgggcgccacagtcctccttcctggtgcattgggtggcatcccacccatctggagtggaagccaggtctagacagggagagttagatgcagaaactagaaaacaaaagcaacacgataggctcagagaaggaggctcccagagctgacgttcccttgaagatggaccacatctctgaataggcagtgcagtttatatatgcatcctccagcctataaacttagagttagaaaacagcaacaataaaaacccaccaacgtttagcagcattctgaggaggaggtccagctattcttttttttttttttggctgggggggggttgggggaggatgggtctaaatactattgttcagaaataaagaataaagcaacatgtttccaaaagaaaataggagggggatataatttttgaggcagaggaatagtataatttagaaaatagtaattatagaaatgagaagtaaatttcagattgaatctactttgtgctgttcttaataaacttcaagaaacacaaataagtggttgaaagatgagataaagcaacaggccaagctgaaaactagggcagagagagttataaaatgaggctgggcactaagcttatgcctgtattcccagcgctttgggaggctgagatggggggatcactggagcccaggagtttaagaccaggagttcgagaccagcctgggaaccatggtaagccctccgtctctacaaaaaacaagaaaaatttggccaggtgtggtggtacacgctgcacctgtggtcccagctactcagaggctaaggtgggaggatcgcttgagcccagaagttgtcaagactgcagtgagctgtgattgtagcactgcactccagcctgggcgacagaccctgtctcaaaaataaataaataaaaattataaagtgaaatgaaagagctgaaagaaactgtaatgacagtaaaagcatttgcagaattttaaactcccttacgattcatgaagagcaaaagtttacaatgtagaaagttaaattattgctgtgatctgaataaatgttgttcgtaaagaagataccaaaacaaatagaacagaaacaataatcagattcaatgggaaaaagtatctttgagctgaaaaaaaacgagctgtttctgtatattcaaagagctcattctgccttagataaaattagtgggaagagcaagaaagagcaagagagtaccctgcaaacagccagtcagaacctggggagagggttacttacaacgaaatcgggatggttttagacttttctataacattgccagaaaatagtgtcgtggagctgaggctaagttttaagggaaaaaaggttgtaactaagaattaaatagtcacactaattgttgttaatttgtgaaggcagcagaaagatgttctctgaagatacagaagttggagctagcacactgccttcagtgggagctcaccctgcctttggacttaggagttatgtgagccagtacctttccttactgtttaaggccatcagcttttttctactacctgtacctgaaatttttctgtatgccttctgtaaatttttcttaaacaaaacttgttcatggatatattctaaccaactaaaagattgtttgaataactcaagaatgcggaacttgtggtgttaaaaaaaatactgacattgaattgaaatcatgtaaacataaatttaagtctaaattataaacttgattacagatgttacaaatgaaaagtcaaatattgtaaatactgaaagagaagatatgtaatggaaagagaaaaatcccagttattcagtaacaatgccaacaataataaatctgggtcagattcactagtagaaactgagaagtaggtgggggtggggcagggactgttaggagaaagtaaaagcccagcctttattttttactgttttatttttgtttttgataattagaaaaatacaggtagtggtatggttttaaaaaaaaattaaagataatcactagaaaattcaaagtaggatgttcacattccacgtcacacatctacatgtgtgaggatatatgcattcctcgctggaggagggaaaacaaaagataaatttgatcacaggataaggtcatgtcacgcaaaaattctatggtatttggttttgtaaattggcttttaaaacttacttagaattttggtctggcatggtagctcgtggctataatcccacggttttgggagttgaggcgggaggaacacttgaggcaggagttcgccaccagcctggggagcaaagtgagacccctgtctcttttaaaaaaaaaaaaaaaattatccaggtgttgtggcatgctactcaggaggctgaggcaggacgattacttgagctcaagagtttgaggccgcagtgagctgtgatcatgtctctgcgttccagtctgggtgacagagcaagactgtctcaaaaaagttaaaaaaaaaaattaaaaattatttagaggataattacctattttgccctgtgttttagaaaatctttaagaagcaagtaccttttttggggagagggttaatgggagataatccattttgtgaaatgtatttgtttagaaatttagatcatttgtgattcctccccaaactcggtctcaaaaaaaataaaaaagagtttcactcttgctgcccaggctgtagcgcagtggcacgatctcggctcattgcaaccttgacctcctaagttcaggtgattctcctgcctcagcttcctgagtagctgggattacaggcgtgcactaccatggctggctacttttgtacttttagtagagacggggtttcaccatgttggtcaggctggtctccaagtcctgatctcaggtgatccgcctgcctcggcctcccgaagtgctggaattacaggcgtgagctgccatgcccggcccccaaactcttttgaggtaattctggacaaacctttgtgaaggtcttggaggtagaaacgcttgggtggtggctggagatgagtgaaagtagggaagaagcctgctcccgctggacacattctctctagggtgcaccttctcccagggtcacgaaggctgggatgaaaaagaaagtagagagcagtgtgagcttccccatcagagtatcagcagtcagtggaggaggagccagaatttgtggggcctgaaactctctaattctgagggccctctttcagaaaaagaatacaaatttaggtatcaaaatgaaaatttagaatgaaaaagaagtcactagttgtacattttgaaaagctaaaactacaaacaactcaaaacctagaaccatataacacagttctttctttggcacacaaccttacactttccccctgcatttttggttacctattctaatctcttcacgtagcaattttgtaacattttatgtaaaaagactagaaggccgggcgcggtggctcatgcctgtaatcccagcactttggaaggccggggcgggtggatcatgaggtcaggagattgagaccatcctgcctgacacgggaaaccatgtctctactaaaaatacaaaaaaaaaaaaaaaaaaaaaaaaaaaaaaaaaaaaatttagccgggcgtggtggcgggtgactgtagtcccagctactcgggaggctgaggcaggagaatggcgtgaacccgggaggcagaggttgcagtgagccgagattgcaccaccgcactccagcctgggtgacagagcaagaatctgtctcaaaaaaataaaataaaagactagactaaagataatccagtctttcctccaggatgactgaaaacatttaagaaactttctttcaaggttttgaccattaaagttttaagtttccattttaaaacaataatttagcctaggaaatgtagtgagaccccatctttacaaaaaaattaaaagctgggtgtgatggtgtatactggtagtcccagctactcaggaggctgaggcaggaggatcgcttgagtccaggtggttgaggctgcagtgagccatgattgtgccactgctctccagcatgggtgacgaagaccctgtctcaaacaaaacaaaaataatttttcggacattttgaagcatcttctggtctttttcctttcagtttgtttttggattctactagggtacttcagaatacacagaataaagcattctaaaagcaattagtctgtaattaatgcacatgcaaaagcagttgaaataaattcattaaaaattgccacgaagttgagttacgtcattcaatcctgactctagatgaataggtttaggagttttgtcatctgaaaacctgtttttttccccccaggctgttttgttgctttggtaacattcttttctgccatttcttctgtgaagtctgaaagtgtccgactttgacaggacaaaatgcatcagatacataagatgcaattctgtatgttgggctgcatagaacatgcaacttcaacacaggcttacttactattttagtaccagtacaggtttaaaacctgtaaatacaggaattctaataaattcttcaaaatgtcaaaaaatgatgtatttataacttactttgaacagtcaagtatattcctaacaggagagaatttccattttgatgagacaacaatgacaatgaaatctttttaaaaattcacttctctggtgattggaaagttttctcctagattatctctgactccatacgattcaaacctcatttcttctccattatcctcacactcctggtgttagttactttaagacatagtcatattaaaataccacctctgaccctacagttttcatcaattcattgggtaagttgatatagggccggaaggaatattctaggaagtcatttgtccatttggaatggctggctgtaatttaattatacgcagaagaagctgaaagccacctaagtaaattccactaaacccaaaccaaatgtatttccaactgaacctccccttatggattcccaaaatacccatccccttaagatgccacctgccagaagaagtgtggtgaagtggaaaaaactcttaaccaacagagctttctggaggttcaagtgtgcttaacttcaccatgttattacattgcttccccacccccatcctgccccatcccacccatgctttgacccaaagcatgtgctcggttagctttgttgtcactgaccgctgctgggggtcaggtggtagagccagacctggccagtcacaggtgtcggctgccttttcacagacctgctcctctatgcacagagacacaggcccagcccgctgggctcttctcatcttaccaagggcagtttgcgctcttatgcctggaggtgagaagccctaatttttgcactcaatgtctattaacttttcaggccagacttagggcagagagttgctggcttgacaagttttggggaagaaataccatttttagagcacctgcaattaatcatgagactaggtgtgcatctattgaccacagtcaccttgggaggcacaagttttacctcctagagaactgaaggggcatgtcccaggacacccatggcaagctgtgaaacttgcattgtggaacccaggtctccctcacctggttctttttttgttcccaggcctctgtgcagcctcacgattggtgacccttggtccattctggggtcccagcacagggactgcctagagggtggcagtggggtctgggaggagtatgggaggcactgggtaggatggtgttgaatgtagtatgacagggaattcctgtgactcagagcatctggctccaatcttgagctcatccccctttaggccttcacttgttgaaaatgtaaatgatcctggacctacatagagtcccttaagaaggcccctcttcacgcctgtaatcccagcacttttggaggccgaggcgggcggatcacaagatcaggagtttgagaccagcctggccaatatggtgaaaccccatctctactaaaaacacaaaaattagccgggtgtggtgacgagtgcctgtagtcccagctactcaggaggctgagggaggagaatcgcttgaacctgggaggcggaggttgcagtgagccaagatcgtgccactgcactccagcctgggcaacagagtgagactccgtcttaaaaaaaaaaaaaaaaaatgccaggcgcggtggctcatgtctgtaatcccagcactttgggaggccgaggcgggtggatcatgacgtcaggagatggagaccatcctggccaacgcggtgaaaccccatctctactaaaaatacaaaaaattaggtgggcgtagtggtgggcgcctgtagtcccagctactcgggaggctgagacaggagaatggtgtgaacctgggaggtggagcttgcagtgagccgagattgtaccactgcactccagcctgggtgacagagcgagactccatctcaaaaaacaaacaaagaaaaaacccctctgccctgttcccttcctttgtgtaaaggtgtgtttattgtgttacagtggtatatgcaagcatgaatgagactattctgtcccctgtcctacctcttagaaataattattagtttcttctttatgcatttaatgtttatttatgcaattataataaaaatgtaaattcttatcactgcctcctgttacacctcacctttttcatgtaatatctggagatcatttcgctacacagagccttttcgcaccttatttttttaaaactgatagctgtcataattgagcttttcctgtactctaggccttgttctagccctttctttccctccccactgcaaccccaccactttttttaaacagctctatagtattccattgtgctaatggatcggtttatttatccagtaccttattgatgggcacttggattgtttctaatctttcgctattatgttgtagagaatgtgaatatgccgttttttacacatttatctgagagagaaattttcagaagtgggattcttatgctaaaaggaaaatgtgtttaaaatgttgttagatgttatcagacttccctccacactcactgttttttacacccatcaacaatgtgtgagattgcctggttccccacagttttgtcaacaggtagtctgtcaaactttcggatttttgccagtctgatgggtcagaaatggtatttccgtttagtttgcatttgctcttctctggttatatgcccatttatctgttgggttgttagtctttttcaaattctcgaaggtctttgcatagtaggggattagttcccatggattgcaaatgttatcttccacttcaccatttctcttttgactccttgggtttacttgggttttggttttgtttttgtcgtgcagaagatcatgtgtgtgtttaatgcaaccaaatgtatttctttttttttttgagatgagtctcactctgtcgcccaggctggagtgcagtggcacaatctcggctcactgcaacctccgcctcccaggttcaagcgattctccagcctcagcctcctgagtcactgggattacaggcacatgccaccatgcccaactaatttttgctttttttttttttcagcagagacggggtttcaccatgttggtcaggctagtcttgaacttctgacctcgtgatccacccgccttggccttccaaagtgctgggattacaggcgcgagctactgcgcctggcctcctttttttcttttttcacacctaaattatgagtcacacttagaatggaaggccattctaagattataaaagaatttgccgatgttatctgttttcttcctgtacttctgtgttcatgttctacatttaaatctttgaattgtttggagtttattctgatgtgtggcgtgaggtatagatacagcttcaactttctttccccaaaaggctgcattgtcccaacaccagttattaaaaagttcatctttaccttgccacttttatcatatattaaagtaccatctgagtctttctggatttactattctgttccattctgtctattcagatgccagcatgacatggttttacttattgagaccatggtattttagtatcagttagggttaatctcctcccctccccacctcatttttctttattttcagagttttcctggttattcttgcttgcttgtttttccttgtgatctttagaatctgctcatcaacagaaaagaaacagcttctgatctcattctttttttttttttttttttttgagatggagtctcccaggctggagtacaatggcacgatctcagctcactgcaacctccacatcccaggctgaagcaattctgcctcagccttctgagtagctgggagtacaggtgcctgccaccacacctggctcatttttgtgtttttagtagagacgaggtttcactgtgttggccaggctggtctcgaactcctgacctcacgcgatccacctgccttggcctcccaaagtgctgggattataggcgtgagccactgcacccagcctctaatttcattctgattgcattaaatatataaattaacttagaaaatgtatctttatgatgttgcagtttctgattacgttaaatttatgaattagaaagtatatccttatgacattgcagttttctttccaagaacatgatatgccttatttgttcaagtctgttaccattcaagtgtgttagttttccttctacttacatatgttttatgcatttattattaaatttatttggatatttggtattttattgctatcataaatgaagtattcttttctactttagtgtctaactagttatttgaatttatgaaagctattgatttctctatattaattttatatctcatttgcttagcaaattatcttactgtttttagaaacgtttttcatttgcttctcttggatttttccacttacacagtcatttctttagcaagtgatggttttatctcctcttttctaatttttcttctgattttagtctcttgtccaattgcattggccaatgcattctgttttgaaaatgttcacttggaccctccatatggagatgtaggtttggagcttaggagagatagtagggctagacatcaactttggaagtcattgtcttaaagatggtggttgaaactctgggaacttatatgttggctaaaggggagaggtcagagctggggatggagacggggcagtggtgggcagagactaggaaggaagggctgcgtcttctcttctctttctctcttccatttccctcttctctcctctcccctcccctctcaacaaatataaaggttgtcttgatgaagtataaaggttgccctgttgcccaggctggagtaaagtggtgcgatcatagcctcactgcagcctccaactcctggctcaagtgatcctcccacctcagcctcctgagtagttgggactacaggcatgtaccaccatgcttggctaatttttgtattttttgtagagatggggttttgccatgttggccaggctggtcttgagctcctggcctcaagcaatcagcacgtcttggtctcccaaagtgctggaattacaggtgctaaccagtgtgcttggcttttttttattattattattatttttaacctggagttctgatttccaatcttttccccttttaaatagactttatttttggagcagatttaggttcacagcaagaatgagcagaaaataaagagctcccatatactccctgcccccacgtgcacacagccttccccggctgtcgacacccttcaccacagtggtccatttgttacagtcgatgaacctacattgacatgtcattgtcacttggagttttcattaggattcacttttggttatggtacattctataggtttgggcaaatgtttaatgatgtaatgatgagtacccaccgttatagtatcatccagaacagtttcactgaagggctttctttttacatttacttttgcttactcaatatgcctgcctgtttgtataggttattgacattatctgtaatgtatttactaagcatacagcttagtgtactttactaagcatagtactttcattagtctttattgaacttcatcttgtttgttagccatcatttctttaatctttcaatacttatttctctgtccttttgttctttttagaggaggagtaaatcatttcctttagtagaaattgtttaaacctgtagggaggaattgtgcttcaaggttgtttcttttgattataaatgaatgaattaaatgtatactaagattcacaattaaaaaaatattgaagtgaatttaaaaagcaatgcaaaagctcacatctaactcttaaaatagtagtagttcattcttattctggttggagtaagttctgtggtcattttcctggatttcaataataacctctaaggagacttgatgaagtatacagattgtctaggatatttaaaatgcattttcttctataaattagaatgttacaatgagtggggaccctggtatctttacctatagctgactctatactcattgcgtaacatctcagccaaactgatttgcaggccagattctagcattatagggtgatacttgcacacgtgttcctcagccttgggtttgccactcctgctatccttggaagttggctgacttttgagacttacaggaagagagtaaacatacatttacaagtagtagtcaagtttctgtgtattgcttggacatatacgtggaaccttctaattggcaataatacttttggaaataaacattgcatgtgtggtttttttttgttgttattttttagatagagtcttgctctgtcgcccaggctggagtgcagtggcgcgatctgggctcactgcaaccttctgccccccgggttcaagtgattttcctgcctcagcctcctgagtagctgggataacaggcgcgtgccaccatgcctggctaatttttgtatttttcgtagagacggggtttcaccatgttggtcagactggtctcaaactcctgacctggagatccgcccgcctcggcctcccaaagtgctgggattacaggtgtgagccaccacaccgggctgcatgtgtttttaatagaaatcagatgggatgggaaaaggtgggtgcttccttctttgtaactaatttcgtcagtgtagtagatttattttctcagccttttatcagtgggatgtgagctgtcctctgaaaactaacatagctcagactgttccccaggcaactgtgttccctgcggcagtgttgttgcacttgtacctccagtgcctatcagaccaacagttctagtctaaaagtggattgagaagacagtttgtgtagaactcgctctgggagagctgaagcaacgcctgccgaggcgggagctgctctggttctaagtgctgtctcctttgatcaggaattctttgagctgcttctccagcaagtactcctctgctttgacatgagccttctgtgagccgttgtgaaaagaaatgcatttcaccaaaactcggaagctgatctaggcctactgaccatgagagtctttgtagaacattaattgggaaatttgtaaattttgaaaatctctttgaaacactacttcatatgtaacaggtacactgtcagaaaaatggagacttggccgggcgcagtggctcacgcctgtaatcgcagcactttgggagactgaggcgggtggatcacttgaggtcaggagttcaagaccagcctagccaacatggtgaaactttgtctctactaaaaatacaaaaaattagctgggtgtggtggcatgcgcctgtaatcccagttactcaggaggctgaggcaggaggagaattgcttgaacccagaaggtggaggtttcagtgagctgagatcatgccactatactccagcctgggcgacagagcgagaatttgcctaaaaaacaaaaacaacaacaataaaaaagaggggtggtggacttaatcataagaaatagttatttgcaggccaggcgcagtggcttatacctgtaattccagtgcttttggaggccaagttgggaggattccttgagcccaggagttcaagaccagcctgggcaacatagcaagaccctgtctgtacaaaaagtaaaaaaaaaaaaaaaaaagtcaggcgtagtgtgcgcctgtagtcccagctactcaggaggctgaggtgggaggattgtttgagcccagaaggtcaaagctgcagtgaagcaagattgtgccactgtactccagcctgggcaacaaagcaagactctgtctcacaaaaaaaataaggggggggttattttctgttaatatatcctatatattaacatttctaaaacccttgtctgtgtctgcatgatacagtttaagattccgcagctgtcttcatcctttcggatgtaatcctagagtagttaagtatcaggtagtcaggtttgctgaagctcttaattgttggaggggatatgcatgtgtgacttcgtgaattggctaggctggtttcatttttaagcaatagccaatcctaggtgaagaaatgtgaatataaacatttcaaaataatttctttacagcaatagattggagctactgccctgtactgattcaacttactcgtcgttttgttttgttttgtttttatagcgggagacttttcttcttttggtagtatagagttgtgggaagagaatagaaaactccacatttgagtggggtttctgtctctaatggctttataatttgcttgatttccaagactagaaaaaattgtaaatgagcagcaagatactaccagctgttgtattgctttactcacatgtgacatgttgtattttttatttcagtgtagtatctaacgactcccgtgtataagaaagaacccgtggtaggtttctgagaagtacggagttaggcaggacctaggggccgctcttagggagcttcgtgaggatgctgtggaaataactggctgagatgtggtgcatgatctagcaagcactaagcagtttttttttttttttttttgagatagagtctccctctgtctcccaggttggagtgcagtggtgcaatcttggctgactgcaccctcagccaggttcaagcgattctcttgcctcagcctcctgagtagctaggattacaggcatgtgccaccacacccagataatttttgtatttttagtagagacatcggtttcaccactttggccaggctgttcttgaactcgtgacctcaaatgatgtgctcgccttggcatcccagagtgctgagattacaggcgtgagccactacgcctggcccactaagcagttcttactgcgtggatcagggcaggtgctgggaaaggtggtcatcgagccttaaaggataagtgacaggcattctgtgaggaggaaatatacatgcgcatggcaaaggagcatgatgctcttggggagtgagtggtgggtgtgagtaaggttttggtgggatatgaaattgggaacatcatttaggaccagatgcaaggcactgaagtgagggatcagaggctctcattttcttgctgagtagctggggaagaaccattgataactgaatgaccttctttaccaacttgggccacgtctcatattcttattattattttcaacaaattactcaagctctcttattaccaattagcaggaagtccagtgtctccttcagggtgacttttcttgaccaagaattgtcctgtagaactccaagggttgatcttgttcaaaggggttagccctgccacgcggtgggagagctggagggccctagagctacagctctcccagtttgcactcgtgcacccagttcttactcactaagtacagctgctcaacaggtcaccgggtccccaggggcttccagtcacaggtgtgggatgtcccgagaccagccctcttcatgagcatccaggccttggtgttgagcctgagtcaccctcccatggtgacttcctctatggggcttttgatgttcttgcctgcagcaaacctcagttggggacatcagtaaatcgtgttccttttgaacttctattgggaaggaatgagggcctctccttttcctccaataggctctgtggctcagatgcagaattagccagtgagttttcaattcttgggaaggcagtccttggtcagaacccagaagatacttctcttctttttccagggcagtgggtgcctccttcactgatctttggataactaagagagggccactccagaactctcccttgttaacagggatctccagtggcctctaacacatgggaaggtccccctcacaagactcctgctgcacttgataaaggttactggatagttgatcagttctgcgatttagaaagataatgatatgatgttgtaatggattgaatattaatgtactccaaaactcctgttaaaatcctcgccctgaggtgatggtactaggaggtgggcctgatggtactaggaggtggttctttgtaggtgattagctcatgaatgagatccttgtacaagaggcctcagacagctgccttgccccttccaccaagtgaggacacagagaaaaggcagctgtgcaagaaccagagagcagccctcaccacacactgaatccgccggcacctggatcttggactccccaccctccagaacttgtaagaaattgattcctgtttacaagccacccagtctttcgcattttgttatagcagcccaaactgaccaagacagttagaaagatgggactggtggtaaggccctgaaacagggtagacgctgggactgagatgaagagacacatttactgaattttttttttttttttttttgagatggagtctcgctctgtcacccaggctggagtgcagtggcgcgatctcggctcactgcaacctctgcctcctgggttcaagcgattctcctgcctcagcctctcgagtagctgggactacaggtgcccaccaccacgcccagctaattttttgtagttttaatagaaatggggtttcattgtgttagccaggatggtctcgatctcctcacctcgtgatctgccctcctcggcctcccaaagtcatttactgttttaaacaaaacaaaaactagttacaaaggtagaattggcaggatttggtgacctcttagatatgggtcaaagctaaagcttgtctaacttgatagtaaagacttgaaggcgtggagtaggagaaacagtgtgtagaggataaggtaattaattcctttttggacacactgatatatctgcagtcctattggagatgtctagctggcattgagtatactggtgtgctgaaaacctaggtgatcactaaagttgagaaagcaacttcagagaacatttagaatgaggaaggtagacaactggaatgcagcctggggagctgtagtatttaaggagcttgggaagaaagaggaatcctgtgataccaggaggctgagagagaatggactgtagaagtaagagagtagaagtggtagagtggtttcaactgagccaaggggcagagggctgcagggaggtaggaggtgggggtcaggagtaccaaataccatggctaagaggctggcacccgaagtggatgtaaactcagggctcctagttgcaaatcacaaaaaatgactctggctaatttaagtgtataaggaaatcattggaagggtgtgggggaagttacagaacctacaggaagtacagagagccacgcccagaaaactgaccgtagacgagggaagcgggacagtcagaaccacagccgcagccgagaccacacagtctggctgaggttgcccagtggctgctgctgcagccaccactgctacagtcctggctgttgctggcactggcaaaatgatttccaaattgtctgtttcttgtcacactctttttggtctgagccctgggcagaagttcgggcttctgcgattggccaggttcacaacaggaggctgcagggagaaccaggacctggctcttttgcttctgtgatggcaagtggtccatcattacaggccatgtggtccacctgtcacgatagccttagaaggagcaggggaatagcagttgggagaagaataaatggagaataggaagtgggagtgccgggtagagcatctccaaggccagcagtcagactcagagcttgcttaatctaagagtgtgtcccggggtgcttcttgtagttgcaactcttaaggcctccttgaatctggctgtggtactcccaagattggagaaccaattagcctgctggtttgtttcaataaccagaattgtgcatatgtctggaatgagtttaagggtggttatgcttatcaaggattggggattggcaatgggtctagtggaagggtaaaaggtaagacagccattcaaaaaaaggtgcatcttggtgctgaactgggagggaagcaaagtcttgagggtgcagagagatcaggaaaagaggcaagtttaaaactcagatgcaaacgggggcaagaaagcagaacaggtaaattgttgcaggttatggccagagaataatttctctggagatcaggctcgttggagagcctgttccgacagtgaagattcaggtggtgttagcagggtgccttgtggcccgggtcccgatgcctttaaaccattatttgagctcctgccctttggtttgatcatgtgctcacatgacaattttccaattataaatgggatccccacttgggggataataatcatgttaatatctaggattctcttacctgtgataagtttttatttgtttctatgaattgatcaatcagcattgagagaatgcagtaaactatatggccaaagactcatatttgtttggtagctgttatttcttattgttaatttatacatgggcacactggtttgatacatacatttctccagtgtgctgaatgtgtgtgtgtacctgagaggtggatctgttcctggcacgtaaagcagtcctggagatgagcactgctgggtgaggctgcctgggagacaccccggcctcaccaccctgcaaagactgagacgctgtcttgacatcatctgagctgtgagcaggctctgccctcctgcagggctctttggagtcttcgtgctcactctgtttcctttgcccaggaggctcttctcccagtccccactcttggtctggccaactcctcttcctcctccaagtcccttttctcttttctctcgtagagtttatcagtgttttgaaataatacatttgagtgttaagtgctgcgttccctactaactaaacagaaagcgtgaggagggcagaagccctctgcccgtccccactcatgcatcatccgactgcagacagttgtctggagagagcaggcaggcagtagtgtttgatgaagtctaaggcgtgggttagtacaggtgagaggggaaaggcctgggtaactcagggagccgagtggctggggtgactgtggggaaagtgaaggcacagtaggaagtctgtgagaacagctctgtgtggagccacaaaatcactgatttcaagatgaaagtggccttattgacttttttcctgagattgtgtaagtacaggctcttaaaaaaattatagaaaattacaaagaagaaaataaacattacctataatcctaccgttatcaaccttttggtttgtataacttttttcaaaatacgggattttatgtacttagagtgttgtacccattttttttcatttactatgttgtagacttgttttcatgtagtaaaggtttaccttgtcattacatggctgcattggatccttctcatgtagtaaaggtttacattgtcattatgtggctgcattggatccgtggcatgaaacttgctgtgtctagtattgtggacgcttaggtctcttacatttttttcaccgtgtaaaccccactgtgatgattattcttcctgttgtaatttcagtcccctaagacacagaattttaagtctggtggctaatagagtaagcagaatgataattaggattccaggtttttatttttgactagttttgtttctttgggatttgcattagttattctatacagcttaagttcccttttccctgcggtagaacgggaataggtatcttaactgtaggtgcctgagactctgctttatggagatatactccttgtaagtttccagctgaggcaccaatgttaatagtggttaatataatcagaacaataatagcaacaataataacggccacatgcatcactttccattcggactgagtttgtttggtggtctcacaaccatccttgagttgagatgggtttttttattttatgtttatttttatttatttttgacatgtagtctcactctgtcgcccaggctggagtgcagtggcataatctctggcttattgcaacctccacctcccaggatcaagcgattctcctacctcagcctcctgagtagctgggattacaggtgtgcaccaccacacccggctgactttgtatttttagtggagacaggttttcaccatgttggctaggctggtctcgaactccagacctcaagctatcactcaccttacctttccaaagtgttgggattacgggcatgagccacccagcccagcctgagatagataattccatttttttttttttttcttttgagacagggtctctttctgttgcccaggctggagtgcagtggtgtgatctcagctcatggcaaactccgcctcccgggttcaagtgtctctcttgcctcagcttcctctgtagctgggatgacaggcacctcccaccatgcccggctaatttttttttttttttttttcagtagagacggggtttcactatgttggccaggctggtcttgagctcctgacctcaggtgatccacccaccttggcctcccaaagtgctgggattacaggcgtgaaccactgcgcccagccctgagatatgttctatgagccctactcgaccgctgggaaaactgaggcttaagcagattagataacttgcacaggcttgtaagggtgcagttgggcggtggaccactgttgcttgttcctggagtctgccgcagcaagcacgctttcttcattctgtgtgtctcataggaaaatgagcacacctgatatcagtgaagtataatttctttataagtttaaagagactgtttttaaactagaaacaaatgttttgtcattatttagacatatgtaaaattaggtgttaattgtttttctttggctatagaggagtagcagatgaagagaagcaagtaaggagaggctggcattctggccaactttgataacgacatagttcctctttaggtcctctacactttatttggctaattcaggttttacttctgttccactgttttattctgttgctagacagctgttaaacatctgttccctctgctcagagggggtgtggttatcttcatatgtctacacagtggctttctgtatcctgttcgtatgtgccctaggagccttcagaataaaggggctcggacagcgattgcacagtgtcttatgttttccttgtcactgcatcctcaataactcactaattaccaataaaaatgtctaacaaaattagatatttttcccaccagaggaataaaggaaaagaagataagattaagtggaaggaagaaatctatttaaaaaggggcggatttttacattcttaaaaacacagccgtgttcttgagtgtgagggaatccttttgtggatctggtctgtgggaggggttgatagaaagtgtgggaggaccctgctcagagcgggaggcagcccggatttccagaagcgaaatgttaaagttgagcatggtttggatgcagataagaagttcttttgcttcctctacttgtgttaaaactgttcattttttatttttaaggtcatctggggggagtttctttgcttccagcctggatctctcagtgtggcctgacccctgaatcctaccctcccacacaacttgagaacttgattcttttctcacaaagacttctttccaacccctcccctccccctagaagactccatatttggagctgagtattttgaacagggccctggccagagggcatgttacatatgttgttctgtcccatgtacatggaaaagcataagctttaaagcaaatgtatataaaaaatggaaaaggtccctctaagccagggacacatgattttctgttatgaatgtgctgtacttatatgatcattctctttaacttgcctctttgaaactggaaaaaaggtgagcagaaatggctggaggtaatgaaagggaatagagaatcaaggaaataatttctttgaccattcttttgtgagccttgggttagcagagttaaatacttaaataagaacataaaataagggaaagcttcacatttccacattcattattaaatactttttaaataggagaatgagtcagagtgaaccctagcaattatctcgttgttgttgaaatctagcccacctaccacattttcataattaaacacaggcctgaggcaaacatcaggttctcattctccagaaagtgagcacttgtataccctggttcagccgaggtccagtaaggttacttgttcacattcactgtggaattctctgcttgggaaaccatcatgttcaggaacattctcaataaagtttatgagatatcgtattggcctggaacatgcacagagaatttgacaacccgtttgggtggaggaatacaaacttcgtaattattgaaaacatagttgttgtaaatgcttccctttggtttgcttacttgggccccaaccagaggttttccagccttggcaaagctgcctaaagccttttgtgtagagtaagggccctgatagtggcatcctcgttttgattctgtctgtagtgggaacgcttccaagtctgatgcttgttgtaggtttctgccagaggtccttcacttaggttaagacatcttctattcttagtttaatgattttttttaaatcaggaagggctgttgaattttatcaaatgctatttttccatctattgagatgaacatatgtttttcattatgagcctttcagtactatttgacttttttttttaaaccatttgcacttattatatccactgacttgaggcttaaaattccttcaaaatgctaactttacaaccatcttctgcatgtgtttttctttgaatataatttttccatcaatctgttcctatctgctttctttttttgtagtgatttcagcatctctgggctgttggtgattttttattctttaaaaagcctcttctatcatttcatgggtttgtcaagagagcgggcacaccatgtgccagccctttccactttttttttttttttttttagacagagtcttgctctgttgcccaggctggagtgcagtggcgcgatctcagctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcgtcatcatggcccgttcttgatggtcactgtctcttcagagctgttgggtacacttcccaggacggggcggcctggcagaggcgctcctcacttcccagacggggcggcctggcacaggcgctcctcagttcccagtatggggcggccgggccgaggcgctcctcacctcccagatggggcggccgggcagaggcgccccccacctcccagacggggcggccgggcagaggcgctcctcgcctcccagacgaagggcagccaggcagaggcgcttctcacatgccagaccgcatctgcatttaagaggagaagtgaagcatccttattcatttttatttgcttcaaataatgaaggaaaaaattacctgtcagtaaaggctgccagcaagtgtttagttcactttacatttattaattattgattgattgactattatgagcaggccaactggagtgttgtttgaaactgccttttaaaatgttcttttgtcatattagctgttttgtcaaataagagttaaccgtcacctgaaaatgtggaacactttataataatgtataatggttatataaaattggttcagttttttttttgcttttttgggttttgtttttttttttttgaaacggagtctcactctgttgcccaggctggagtgcagtggcgcgatctcagctcaccgcaacctctgcctccctggttcatgccattctcccacctcagcctcccgagtagctgggactacaggtgcccgccaccacgcccggctaatgtttttatatttttagtagagacggggtttcactgtattaaccaggatggtctccatctcctgaacttgtgatccacccatcttggcctccccgagtgctgggattacaggcacccagccaaaattgattcagttttaagactcagcagttgagagtaacatttgcctgggattcttctctgtatgttaaaatgttaatgactcctctcttcagcaggtgtcatcactgtgacagggatatgggggggaacacgaggcacttgccttgagaacagagacagagttaggcattatcgacaggtgctcatttggtatcacattttaaaatgactaagccctaatcttccttccgtgatgtcccttgacatctctgcctttggaagtctggctgctttttcattagcaccttgatcacatctcactcagaggctgtgaagggcaccctggcaggagggaccaaagctctttgccacatactctgctctgtcctgctgcttttccctggaatggctgccaggacctgtatgactggaggtcagatgtgtaagtccttctgtctggtcacgagggtataggaaacatctggtttttccttaccttatgcaatataaagactgttttttagttttttttgtttttgtttttttgacagcgtcttgctctgttacccatgctggagtgcagtggcaccatcatagctcactgcagcctcggattctaggcttcaaatgatcctcccacttcagccttcccagtagctgggaccacagacacgcctcactatgtctggctaatttcctttttattttttgtagagctgtcctcccacctcactctccctgagtattgaggttacaggcgtgagccaccatgcctggcctaattttttttttaacttcattttgaactaatttgtagattcacagaaagttgcaaagataacagtacataaaggttccacttgcccttcactcatttcctcacactggttacatcttatgtaactgcaatacagtatcaaaatcaggaagctgacattggtatgaggtgtttgtatagttttgtgtcatcacccatgcgtagattgatgtagccaccgctgcaatcaagatacagaactgttccatcaccacaaagttatcaggctccctcctactaccccagttgtcttctcctcaaccaccctaaaccccaaacaatgactaatccattttccacctctgagatgttatcattttgaaatgtcacatacatcaaattatataatatgtaaccttttcagactggggttgtttctgggtttttaaaaattcagcttaatgcccttacaatccaaccaggctgttgtgtgtatcaatagttcattcacttttattgctagataatattccatggtatggatatatatcacagtttatttctccatccacctattgtagaactttggttgtttccagtcttaggatattacgagtaaagttgctgtgaacattcatgttcaggtttttgtgtgggcatacattttaatttctctggaataaataaatttctcaggtgatattgctggatcacatggtaagtgtatgtttagttttttttttggagaaggggtctcactctgtcgcctaggctggagtgcagtggcgcgatctcgacttacttcaacctttgcctcccgtgttcaagcaattctcctgccactgcctcccaattggctgggactacaggtgcccgccaccacgcctggctaattttttgtattttagtagagatggggtttcaccgtgttgcccaggctggtctcgaactcctgagctcaggcattccacctgcctcggcctcccaaagtgctgggattacaggtgtgagccaccgcgcccggctgtgtatgtttagttttataagaaaatgccaaattgttttccggagggctataacattttatgttcccaccagcaatgtatgaaagatccagattgtccacatctttgccagcctttggtttttttttttttttttttttgagacaggatgtttcgagactttctcccagtctgtagcttctcttcatccttttaatgctttgcagagcaaaagtttttaattttgatgtccaatttattatttttttcttttatggattctcagtcacgtttgtggattctcagtcattactaagccttcgctctcaaagatttttctcatgttttcttttaaagttttatagttttacatttaaacttatggtctactttgagttaattttgtataaaatatgaggtttaggtcaagtttcattcttttgcctatgaatagccaattgctgcagcaatatttattgaaaagaatatctgttctgcattggaccgcttttacacctttgtcaaaaatcacttggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaatacaaaaattagctgggtgtggtggtgcatgcctgtagtcccagtcacctggctctgagtgtgggctcttctgagttctctcttctgttccattcatctgtgtgtctatccctctgccaacaccacagtcttgaataatatagttatgtaagccttgaaattgaggagaataattcctccaatttgtctttttttcaaaattgttccagctattctgattcctttgacttgccattataaatttgagaatggtctttgctatctcttaaaaaaaaacttactggaaatttgataggaatgagtctttttcattccaagctagtggagtttctactttttgaacatcctcaaaaaccttgtgggtctcctctgtatttcacagggatttcacaggggacaagagggccctccatagatcttacctgtgcggttctgtttctattcctggcttttgctgagagggttgaggggattcatgagtgacaggcttaaatctcttcaaagagctttctgtgtgaatggatactctcaccttttaattcttccagcatactagcaaaacattggccagccacacccttgtctttccttagagcactttttcctgccagtgaatctcctaattttattgtcttttgcaatccatgcaggctcagaatttcccaaattaagccctggttcctttttgcataatagtttctcttaatttctctcttctgcattttactataagcgcaagaagaaaccaggttgcacctttaacactctgcttggaaaatgcctcaattaaatatccaagttcatcacttacacgttctgcttttcacacagttgtaggagataattcagctatgttttctgctagtatataatagtttccaaaaagaggtggctcatttctttgagtcctaccagcagtacatttaatgtccatttttctaccaacggtgtgcttatgaagatgtaggtattctctaagatgatacagactttctgtactctgctcctcacttctcctgagtcctcagtggcagtttttttttttttttttttttttgagacggagtctctccccgttgccagcctggagtacagtggcacagtgtcggctcactgcaacctccgcctcccgggttcaagcgattctcctgcctcagcctcccaagtagctgggactacaggtgtgcgccaccacgcccagctaatttctgtatttttagtagagatggagtttcgccatgttggccaggatggtctcgatctcctgacctcgtgacctgcccgcctcggcctcccaaagtgctaggattacagacatgagccaccgtgcctggcaagtggcacagtttttaacatccacatttctgtgatctgtttaaggcaatctaggctttctgtatcgtcatcttcaaaattattccagcctctgtcccttacaatttgaaagctggttccacatttttaggtatttgttatagctgcaccctagttctgtatttgtttcccgaggctgttgtaataagttaccacacattttgtgccttaaaatagcacacatttattcttgtactgttctagaagtaagaagtctgaaatcagcttcactgggccaaaatgaaggtgtccaatgggccgtgctccatctggaggagagaatgcattttcttccctttcccagcatctagagctgcatttccttgtccatgacccctctctccatcttcaaacccagcagcctggcatcctgcttcagtcatcacgttgccttcttctgtgtcacatctcctgtgctttcttcttatatggacattttttattgcatttagatcccctggataatccaggataatcatctccattgaagatgctttttcttttctttttgagatagggtctggctctgttgcccaggctggagtgtggtgtgatctcggctcactgcaacctcccacctccccggctcaagtctcccacctcagcctcctgaatagctggaactacaggtgcacaccaccatacctggctaatttttgtatttttcatagagatgaggttttgtcatgttgcccaggctggacttgaactccagagctcaagtgatctgcccacctcggccttccaaagtgttgggattacaggcatgagccaccatgcctcgctctccatctattttttttttaatctaaaattcttaattctatttgcagagttccttttgtcatgtaagttaacattcacaagttctagagattaggacctggatatctttgggggtcaatgattcagcctactacaattttctgtggggtcttgaaaaacatgaatattatgctgttggtgggagtgttctataatctttctgagactttgttggttgatggtggtggtgagttcttctctatacttgctgattctttggttcattaattattaacaagagagaaaggcattgaattctctgactataattgttgatatctctcagctctgttgttgctggaatcacatattttgcagctttgtttggtgcatatacatttagaattgctatgtctttttgatggatcattatatagtatctgtctctggtagttttctttgctctgaagtttactgtagctgttttattaatatagccacacctgctttctttttattaatgtttgcatgatatctttttcatccttttacttcagccaatatattcgaatataaaatacgtgtatttgaagtgagttttttgtagacagcatctaggtgggtcatgtataatttttaaattctactctgccaatcttttaatatttaacatttatatttagaccttttacatttaagatgattattggccaggagcagtggttcatgcccgtaatcttggcactttgggaggccgaggctggtgggatcacctgaggttaggagttcgagaccagcctggccaacatggtgaaaccctgtctctactaaaaatagaaaaattagctgggtgtggtggcacacgcctgtaatcccagctacttgggaggctgaggcaggacaatcacttgaacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcgttttcctttatttaagaatgtctcaatttccctttcattcccaaaggataacttcaccagatatagaattcagggttgacagttctttcttcacttgaagaatgttttgctacttcctctggccattgtggttttgatgagaagcccattgtcatttgaattatctttctcctctataggtaaggtgttattttccctggttggtttcaaacatttttctctttcagaagaatgtgtatcatgtgtcttggcataggtctctgggtttatcctgtttcaagtttgtttagcctcttgaattcataggcttatgttttttgccaagtttgagaagaagttttcacctattaaaaaatgtttttctagcccaccctttttgtccttatttgtctttttttttttttttttttgagatggagacttgctctgtcgcccaggctggagtgcggtggcgcgatctcggctcactgcaagctccgcctcctgggttcacgccattctcctgcctcagcctcccgactagctgggactacaggtgcccaccaccacacccggctaattttttgtatttttagtagagatggggtttcactgtgttagccaggatggtcttgatctcctgacctcgtgatccgcccgcctcggcatcccaaagttctgggattacaggcgtgagccaccgcacctggcctgtcctcatttgtctttagggaaattatctgtacgttttgggactatcaagtgcccctgaaccgtggagcatcttctgctcttgggtcactagagcagggggaataatcaggaagaactttctggtgttactcagctgcgattttccttgtcaactctcatgtgctccatgttgtggagtggcgttttaaaatccaaccagtactctttcagaacacttgaagtaacagaattctcagaggaagagagggcatcctatcccattttcttcacacacaaataactctgtagttttgtgtaaggtgggttctgtttaaatttttgtctttttaaaaatttaccaaaataaccttactcttttttttcaagccaatcaaaatcaagataagaaaatactattgtctctatactaagagtatgactaggcagctctttgcctgtggttgcgaggagccacagcctttcacagagcgaatattcgctttggcatcagtttttatcatagttggtactttgatattaccgtgggaaatcttgtcaatcgcatgtgtcctttaggttagatgagaaggaaacaacacatcttacaggctctacttgtctcttgaactagcaagttatttttgcttattaaaaattttgttttgtatggtttggtgagagtatgctcagtttgttttgttctgaggtcattcctaggccaggtggaatgtggccctcttaggtaccagctctcatagtggggaactccagggctgaaaatgacacttctctttggaaaaagcaccagtttgtatggttttgaagagccagatgctgtaggttatttaggaatacttagtaatatttgaagagaaaataaaagtagtaatttttaaagcattccttatacacaaaattaagggaaaatgccattaaaatcatttagaaatctgtagagttctctaatagtcaaggcttttaaaatttatttcttatgttttgaattttcaaaatacttttcaacattttagtatgaaaaatttcaagtacacaaaaacgttgaaaggctatacagtggcttaggtgtaaaccccccacctaggctccacgattaacctttcactgtgtgtgctttatcacatggccgtttatccgtctctcatcgatccatccatccatcttactttttagacatttcagagctggaggtgtcagtgtactttaacttttggacctgtttttctcttatttgtgtggtccaagatgggccctataaaaactttgaatcaaaatatgtcttctgagaagctctagttcctcttacaaggtcaggggagtctgtgacactgctttccctgcactccatgagccttcctaaaaggatgctgagaataactcctgtgctctgatgcgttatgtggctgagaagcactgaaacttcatggagccaagttctcctggtgggcagagagaacatccagacagaatgggctgtcttctgggctgggcccctgtgatgggttcctgccttgctggcttccaaggaacagtgttaatcttctgcttgggtgtaatcttgaattaactgaggaatctaggaaagtgcatgagattgtgtcttcagacacccgaagagagcaccaaagctgtgagatagtcacacttaggaactgtgcttccctagaccattggttctcaaggcccctgggggttgaaggccaaggagattaaatttttcaaattgggtaattaaagacaacggcaaaacaaaaccaaacaaacaaacaaacaaaaaaccatggggacactttactgggattgagattgtattgcaaagaatggaatcagagccgtcgttgttgtagataggcaccaacgttattaaagccctcttgactttaagattgacacaaaattgtggaaatcttcctaaaatggtgttggaggttcctcctttccccaaactcttttctataccatgcaacaacggatagtgctgggatatattttcaggaattcacgaagaccgtgaaaatgaatgaaatagctcttttaattgcaaagagctaataaacatacatctcatctctggagcaccttttgtgaaaagcctgtgttctgagtagtctgataattcagcagatatctctgagttcccactatgtgctagtcacggttcttggtgctgggaatttaataatgaaccagacaaggaagaaccctgtccttgggagttgacattcttataggaggagacataaactaaacaataagtcagcgggatgctactaatagtattaatacatggcacttctaggtgcagtagttactgttatccctattaaagatgagatgactgtgtggaaaattggaaaccttgtgcactgttggtgggaacgtaaaatggtgcagctgctgtagaaaacagtgtggagattcctccaaaaattagaaatcgcactgccccagtgcccttcacaatgggcaagagctgaagccatcagagtgttcatggccagatgaatggataagcaaaatgtggtctctccatacaatggaatattactcagccttacaaaggaaggaaggctggtccgaaggtagtgagttatatcgattgttcagttacaggtctaactccttattctactctttcctcccttctcactactgcatttgactaatctttaaaaaaaaattgaaaatgtttttaaaaaaggaaactctgtcacatgccacaacatgggtgaaccttgagaactttttttttatatttatgccaggtgaaataagccagtcacaagacacatactgtgtgattctacttatgtgaggtacctgagtagttgaattcatagagacaaagtagaatggtgggtgcctggggatggggaaagggagaattggggagttagtatttaatgggtacagagttttacaagatgaaaaagttctagagatggatagtgatgatggttgcaaaacagtgtgaatatacttaacagtactgaactggacacgtaagaaaaaatggatgccaggcctggtggcacatgcgtgtagccattacttgggaggcaaaggcagaatgactgcatgagccctggagttcaagactgctgagtcattattgaccaccatactccagtgtgggaaacatcgggagaccttgcttcaaaaaaaatggttgaaattgaactcatggagatagagagtagaaggatggttaccagaggctgggaagggtaaaggggagataaggatggttaatgggcacaaaaaattagttagaaagaatgaataagaccctagtattttttatttatttatttatttatttttgagacagcgtctcactctgtcgcccaggctggagtgcagtggcacaatctcagctcactgcaaccttcacctcctgggttcaagtgattgttgtgcctcagcctcctgagtagctgggatgacaagtgcaagccaccacacctgactaatttttgtatttttagtagagacattttggccaggcttgtctcaaactctgggccacagtggtccacccgcctcagcctcccaaagtgctaggattacaggcatgagccaccgtgcccagccaagacctaatatttgatagcacaacagggtaactatagtcaataataatttaattgtacatttaaaaataaaagaatatatttaggccaggcaccgtggcttactcctgtaatcccagcactttgggatttgaactcctgagctcagatgatccttctgcctcaatctcctaagagtctaggactataggtgtgcaccactgtgcccagctgtgttatgcgttttaccacaattaaaaattttaaagtttttgaaatgagaaaagcaaagcacaggtgtccggtcttgcacagctaatgaagtggtagagccaggagtcaggctccgcagtgtggctccacaaaacgtgcattcagccatcattctgttctgcttccaaaacactctgggtaaaaagtgctatgaaagaaatacaacagccatgtctgatagaaagcgattgtgcagggagctgagagtctgtcctttagacagggtgatcagggagggcctgctttgagcaagggagctggagggagctggagccagccaggtgctcaggagagtggttcacaggaggggatggtgccccagtggcagatggggtcggatcagggagggcactataggctcaggtgaggaactcggattttgttctgaacccagcgggaagtcatatgtgttttaagcagggaagagacatgatttgatttatattttcatgagtactgccaaaacttcacttggaaaggaaattgagaaaaaattccggaatatcgatttctccattttgtgatcaaatatcaaatagaatacttcaggttttacaaaagattaatcctcaccctgctttttggtgctgtttgaagcattttaagtgtaacaactcttatcagtgaaggcaatatgcccaactgttttcttggaagacacttagttaaagatgctgaggaggaaaaaatactgctttcctaagcctggcaccactactcaagatgatgtgtgaagttgtgtcagaatccatcagagttaatgaaatggtttggaaaaaaatgactgacaagcactgggggtttcttttggggacaccagcagcatgaactctgtcttagatttcacgcatttttagccaaagttccacctatggatataggaaattagttataaaaatgtttttatcttcccaacttaagttctcaaggccaaagattttgaaaaaacttcaatgaaaaggataaatctaatcttaaattttaggtgacgtctccttgacatggtagttgaaaactcatttgaaatttgataaggaatcttctttcatattctgtcgcatcttcaagaggacttgttgggagtttgggttgattaaattgtcagagatgactttcacaaagttgtcttagagaattatttggtagctttggatgtcattatccctactttaaaaatgttattaatagactttagtttttagaactaatttagatttacataaaaatcgagctgacagtatagagttcccatctgctcaccgcctcccagcacatagtttttctgttattaacatcttacattagtgtggtgcatttcttacaatggataaaccaatattgataccttgttactaactgaagtttatggtttacaatagcatttccttttggggtccttggggtcctgacaggtgcataatgacatggatccaccattaccgtatcatacagaagagtttcaccaaccaggagtcccctgtgctcagctattcatccctgtccgtgtccccctgaacccctggcaaccactgatccttctgttgtctcagtagcattgccttttccagaatgccatctagttgaaattgtacaatatgtagccttttcatattggcttctttcacttagccatatacagttaaagttcctttatgtcttttcaaggcttgagagctgatctcttactatcactgaataatatttcattgtctggatgcatcatagtttatcgagtcacctattgagggacatcttggttgcttcagtttttggcaattataaataaagctgctataaatatttatggcagattttcatgtggacatagtttccaactcagttgggtaaattccaaggagggcagttgctggatcgtattgtaaggctgttgagcttggagagaaactgccaaactgtcttccaaagtgtcctcaaatggtttttagtcacgtgcatttgtgaagctgctcccccgcaccgccaacgacagcttctggctgtgaaagaaactttattcaggtttgatctcagaagttgtttattttactctgtttttcagttagctagggtagaaagtctcaatgtctattactagtttttcatgactgaggtcaacatattcatcgttcaagatcttacaatattttttgttttgatttgttttgagatgcagtatttaatttgaaatttctagtaatattcaagaagagagtttgattagcttgagatagtagtagtatcccatttacaaatgaggaaactgaggcatagagcggttaggtaaaagacgctgtgcctaaaggcgcagagctagtaagtggcagagagaacatttgagacaagtccagctgcaagattgactgtgtcacattgcctctctatctgttgcattcatgatttaaggacttatctattcagtgctgtattttagcagtgcttctcaaatttccctgttcaacaaagtcatttgggaagcttgttaaaattcagagccctgggcttcatacccagaggttctgatttggtaggtttgggatagggtctaggaactctattttagacaattacctccaagtgtttctgatggagaagatctttagaccatgttataaaaaactgctacagaaaatgaactctaggccaggcgtggtgacccacacctgtaatcccaacaccttgggaggctgaggagggaggatcgcttcagaccagcctgggcagcatagcaagaccccatctctacaaaaataaaaaatagttggatatgatagcaggctcctgtagtcccagatacttgggaggctgaggcagggtgattgcctgagtcccaggagttggaggctgtggtgaactatgattgggccattgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacatgctgttgttgttgagcattttagttctgttcttactctatgagatgttgttatcttacacagtcaggttttttaagatttacttatggaaaccagtgctcatcattttctcttgatgctcacacctcctgtactggatcccttctcttgattgaacttatttaagaatttctgttagtgataatggtgcaccagtggccaactccagtttgtgtctgaaaatgtcacctttcacctaatccaaagaaggctgggtaaggaaccagtgtcctggaacagtgaagatcaccacatggagattgaggagaaatgacaagaaagaaggttccaaggaggtggcgagaatcggacccttggagcctctgcggctttcctgcctgcccctgcagctcagtgcagcatcctggctagctgcggcatgccactcacctggccctttccgttgttgctaacacgtgactgccctgttacccacctggatgtcatagtttgaatgctgctttatcacccactgaggtcacccgactgtcgagtggtgaggagaggcagagcgcagcccctggcagctcagagcctgcccttttgttctgcgtgtcatcatactgcttcagtagtctccagaaactcatgctcatttaacagttgagccaggcaaggtggctcatacctacaatcccagcactttgggaggccgaagtagaggattacttgagcccaggagtttgagactagcctggacaacaacatagtgagaccctgtctctacaaaaacaatttgaaagttagctgggcatggtggtacgtgcctgtggtcccagctattcaggaggctgaggcgggaggatcacctgagtttgggacgctgaggctgcagtgagctgtgattgtgccattgcagtccagactgagtgacagagcaagatcctttctcaaaataaccagtttaaattgctggatataacagtgttatgagataggtgttatttctgtgtgtgttaaaccacggctccatgtagagtttccatgtagtggattaactgggactagtgctcaaagcccatgctttgccagtgttctgtttcctgcagaatcggccagtctctgaactgaccaaaaatctaaaaagctccatatcacaacaaaaattagtattgattagtaataaaggtaaacttaagggtaagagaatcaatttcaattaggactaggtagccagaaatacacagttgtgagttaaatgaccaaatttttgttcagggtacgtattatcacatttgacttacagtgactaaaacatagtgagggttctggccacagttcataactgtgaaactccatctttctccaggagaagtcataggactgcgagtgaactccgtggaagatctcatatgtttgcatatacatgtatataaaatgtgtcagggtgtcactatttatagcagtaaactagaaagctgcagcttcttggtagattggaatctgttagataactagattaataatataacttgaaagttagaaagtactgaatcaacttggagataccacttgcttattttttaatatgagtatctgtgacaatctcccatttttccttgattctgagatacaaattatacattttaaactgcctgaaattaagcatacatcttacaattgatgggctcttagattttattaaagatggtaaataagggaatgattctgaatttcttaatattattgcacactttgttagtggttggtttaggatttatatatacacctttcatttctcagtctaccatcaaatgatgttaaccatttcacatgtgggataagcagcttataacgtgtgctttcctttctccctcccaacctttgttctgttttatatttgttattaacccaatacatgtcgtattatttctgctttgaacactaacagtaaatcttttaaagaggtatctgtcatgaagggaaagtattcactcacatagttatcatttacaagactttcattgttttgcatcggtaacaaatttttatctggtatcttttctttccccctgcatgaaggactgctttaacatttcttgtagtgcagatgtgctagtggcaaattagtttaagtttttatatctgaaaatgtctttgtttcatctttatttttgaaagagattttgcagggtgtagaattttgttattttgtttgcttgtttttttattgtttattttttagagataggttcttgctatgttgcccaggccagcctcaactcttgggctccagatcctcctgctacagactccccagtggctgggactacaggcacataaccactgtgcctggctgtttttctacccccatcatttcaggcaacaggataaatccagtccctgttactccattgtggctggaagcagaaggtccacacttaagtactttaaattcctacaaacctgaacctaaaatatagacctcaacaactgtgagtctctgtgattttgcagatctaagtttgtggaaggctagtgcctgagaaaggcaaggattttggctgaatgatgtgaatttgctcctgattcttatgtaaagcttcactggcagcacccttttactaaaatggaggatttcctgccttctttccacattgttttttccttgtggaaacatttatatttgctatcaagaattagagtaagaatgttgaaaccgtatgtgctgcacagactcattctcttttagagcctgatgcattgttagaaataaaccagtgtgtccaacctcctccatcagacgagaactgagtctgaaggaccctttcctagcgtgtctggaatgtcaggattttatagggaagctcgtggtgggtgcattcaaccagctttagagatttcatgccagaccagtgatttccagttaacctgcccttttttttttttttagcagctttattgaggttggaggggaagttttcattgtatgcctttttatatgtttgtgtatgtgtaaccatatccatatattactttatccattcaaaaataaaccgctagatttcttgggaggaaaaaaccacttgacctttgtttcttcttacctaacagagtccaagtaacaaaacatacatgatgtcaataagtgaatccaagccttagataactttgattgaaggctggtttgttgctgtggaaaagatctggataattaaggacaccttctctgaacattgcttatcttcccatttttagtatggcggtcacatgtgtgaaattgtctgtgtatcagcagattctgtgactgcaaagttattttggatgcagagggatactgatagaacgtcactaaacagctggtctaacagctaggtgttggtatttgctatacaatctgggtgtccaaagacacaataggacagcaaggtacttagaagctccgcagagactggttcagaaatactttatcacatactcctatgccttttatttattccttttcatgtgtcaaggataattctgttacttcctagtaatgctttccccaaatatcctgagtgatattgctacagatgttactagccacttaatacctgaaagttttttttttccttttttttttttttttcttaagagtgtctcactctgttactcaggttggagtgcagtagcacagtcatagctcgctgcatcctcaaactcaagggctcaagcgatccccccacttcagcctcttgagtacccgggactgtgggcatgcgtgacatgtctggctaatttcttttctgttttttgtagagacagagtttctttgtgttgcccaggctagtctcaaactcctggcctcaagcaatcttctggctttggcttcccaaagtactgggattacaggcttgagccattacacctggccaaatacgtgaaacttaaatttttttttaacatgaaaaattcaaactcttagactgtaaaatggataatggatcaaatagatttaataattgttataattttgctcaattcttttttttccctctttgaggcagagttccactcttgttgcccaggctggagggcaatggcatgatcttggctcactgcaatctccccctcttgggttcaagcatttctcctgcttcaccctcccaggtagctgggatttcaggcacccaccattacatctggctaatttttgtatttttagtagagacgggatttcatcatattggccaggctggtctggagctgctgaccttaggtgatccgcccacttcggccttccaaagtgctgagattacaggtgtgagccactgtgctcagcctcaattctttttttgctaaagtatttcgaagtatagacataatagcattatatccctatatactatgacatgaatctctagaaaataaagacatttctctacacagccaccatgtctttgtcccactgtacaaaattttcttttagacgtggaaattctgattgcagtactggtaaagtaaacggctagtgcttattcaactccttagggccttaagggggtaggaaaagataggtattactgaaagataaaaatcaaggaaatcctttgattccgattaaaaggtattttaggatctttagagttaaatcattctggtgtttagattcactttgtacgtcttcactctgtgttaacaaccaaccctgctcatctttagggtaggaggagagaaactgtagatagactttcttaaaaaggaaacagaaatgtatgccgatgcttgaattaaagctctccccttgcaggctcttatttttctatatctgcacaggagagctcagcagaagaaaattcttttcgtaaatgttgttgacagacttgatttgaatcttcaggtacatttactttttagtaacaggatagtgtcagtcagctggttactattagatatactttttgccatattgaaataagatgcggctgggcgcggtggctcacgcctgtaatcccagcactttgagaggctgaggtgggtggatcacctgaggtcaggagtttgagaccagcctggccaacacggtgaaaccccgtctctactaaaaacatagaaaattagctgggcatggtggtgcgtgcctataatcccagctacttgtgaggctggggcaggagaatcacttgaatgtgggaggtgaaggttgcagtgagctgagattgtgccattgcactccagcctgggcaacaaaaatgaaattccgtctcaaaaaaaaaaaaaaaaaaaggaaaaaagaaaaaagatgctccctcagatgcgtaagagtaatagttttgaagatttgagaactgcctgcttgcttctttattttatttgatctctctgggcattcgatgttggttttctgcctgttgaaattctttattggctttcattctttcctacttctcacgttatctcttgatctcgatttctttgtgtttcttctccttcaacgctaagtgtggtgcgcattcattccactcgtgctctttagccgatcacagtaaaatgtcaggtggagctaggctgagccaaggagaatagagcatagactttatgggcttctcagaaggaagacttctcactcttgagagagacataggactaaggaagcatgtagtttcagttgctgggggaagcctagagcgagaaagagacagactttaggatgaaactgacacattggaaggcaggatgaacagactgggttaccgatgacatcgttgagctaccagaccacccaatagcatgttgcatgactttggatctccttgagcttattctacgtggactttgatgagcaccttggaggtgtatattcatgtcattcatcaaatttgggacatttcagccattatttcttcaaatattttttctttttctcctgggaaagaatcattagactttccctggctttggtttcctcatttataaaacgaggataataatggctgctcttagttatttggggggtttaatggagatgacctgttagttgatcagtaaattgtagttccttcctcattcattgcttgacatagaggattgcttaagaaaacagcagtgtgaatacaaaaaattagccgggcgtgatggcaggcacctgtaatcccagctacttgggaggctgaggcaggagaattgcttgaacctgggaggtggaggttgcagtgagcccagatcgtgccattgtactccagcctgggtgagagagtgagacgccgtctcaaaaaaataaaaaagaaaaagaaaaccacagtgtggaatttatcgacacttagatctaatacaggaagcaggaaattaaaaattttatgttaattgtattatttgtatctttgtgaagcatattttatttttttctgtttgagacaaaagtttactaagaaagacctgaagaaaatagtgtctttttgcaaaatttttttgctttgccatgtttactttatcataagctgaacattgtgttcttaatttatatcgtaatgaaaacatttaactgattagggatcacagtacctacagtacccttgaaaatattaataaatttgttctctttttttaggcataaccattgccatccaaaagttattttctgtgatgaacagctttttggtttcagatgaccattggcttatttaggaagaagatatggcctactttttctcttttcatttgtctctttcttttttctttttttaaaattatttatttatttattttttgagatggagttttgctcttgtggctcaggctggagtgcaatgacgcgatctcggctcactgcaacttccacctcctgggttcaagtgattctcccgcctcagcctcccgagtagctgggactataggcgcccgccacggcacccagctaatttttgtatttttagtagagatgcggtttcaccatgttagccaggatgctctcgatctcttgacgtcatgatccgcctgccttggcctcccaaagtgctgggattacaggcgtgagccacgtgcccggcctatttacttttttaatctacacaatgggcttctttgatgttattggtacatatcttctgttgcagtgcacagaaatttttctgatatacctgggagtaaaattgctgggtcatagcagatgcacttctttgatattaatagacaaattgttttccaaagttctctcgatgacaggtcacagtctggtgagattgaaatgcatgtgttgttttcaaggtttttttgttttttgtttttgtttatttttaaagagatgggagtctcgctctgtcacccaggctgggatgcagtggctggtcactgcaacctggaacccctgagctcaagcgatcctcccacctcagcctcctgagtacctgggactacggatgcgtgccatcacgcctggctttttccccaaggttttatattttatcagttgtacacgtattaaagagtcaactgtaatgtttgtaatgggggcaagcattgccttgccttgtcactttcttgtccccaaggtgtaaccacttttatccctttttgcttttttgtgtctgtttcggtatctgttttgcatgtcagaggcttacctccagtttgggaaggaagaagtaaaaagtgtattagaagctctgagtgcagcagaaggccgtgttgactgtttctctgtagggtgatgtgggtgtactggttgttggtgtctgcccctcagatcattatctttagagctgaagcctgtgggatgcttcagagaagacgcttgtcccagcctctgtccagggtggtgggagaggagtaaatggcccgtggcctgcagtcggggagcccagtggagaaggcggcttggtgatgagtatgtttgcttttatctctcacccctgtttttagtagggtgcccttgccctcaaacgtgttagaagtgccctagtctctctgttttgttctctaaagataaataagcagtcttccgtggcgtgggagagaagaggcaggcatccagtggcatttcaaagagcctttcaaccagttctccttattttagttgaccctccttcacagccccctccagagttacgtagtgaagccagagcctaagccttgtggggattctctcacgtaaattaggttacttggtctacgccactgtgggcttcaaagtttgcttttccatgtggattaaatcagctgtggctagtccagtttggcttcaagctcataaaaatgtggcggttctttctgtttccattctctttgttgtgacaggttttgagttttttaaattgctaattatgattactacagttttagtggatgtctcctttttttttttttttttgagacgggagtcttgctctgtcgcccaggctagagtgcagtggcacgatcttggctcagtgcaacctaatggaggtctcttgttgggattttaatttgtatttccttgactattaagagagttgacatccttttatcagcccattcatattaattttttggtcttgtgcctatgcaagtcatttgcccaatttccttttttcttttgagacggactctcgctctgtcacccaggctagagtgcagtggtgggatctcggctcactgcaacctttgctttcctgtttcaagcgattctcctgcctcagcctccccagtaactgggattacaggcgcccaccactacacccagctaattttttgtatttttagtagagacggggtttcactatgttggccagactggtccagaactcctgacctcaggtgatccacctgtctctgcctcccaaagtgctgggcttacaggcatgagccactgtgtctggccccatttgcccattttctaagcacggagttgttatgtcttttaaaaattgacttgtgggccaggtgtggtggctcaggcctgtaatctcagcattttgggaggccaagacgggtggatcacttgaggtcaggagttcaagaccagcctggccaacatggtgaaaccccgtctctactaaaaatacaaaaaattagccgagcgtggtggtgcacgcctataatcccagctactcgggaggctgaggcaggagaatcacttgaactcaggaggtggaggttgcagtgagctgagatcgtgccaccgcactccagcctggcgacagagcgagactctgtctcaaaaaaaaaaaaaaaaaaaaattgacttgtggctgggcacagtggctcacatctgtaatccctgtgctttaggaggccaaggtaggagttttgcttcaggccaggtgttcaaggccagcctgggcaacatagcaagaccctgtctttaaatttaaaaaaaaaaaaattagccagacatggtggcgcatgtctgtaatcctagctacttgggaggctgaggtgggaggattgcttgagcccaggagttcaaggctacagtgagccattgcagcatttcactgcagtgagatcctggccagcagagtgagatcctgtctctacaaaaaacaataatataatttgtaggagttacatattttgaatccgaattctttggcagtttctggctcagctcttcttcactctgtggtgtggaacttttggagaataaagtttttatttattaatttttttttgagacacagattctgtgttgcccagactggagtgcagtggcacagtcagcctcacagtcatgatcatagctcactgcagcctcaaactcctgggctgaagtgatcctcccacctcaggctcccaaagtgactgggcccacaggcatgcaccaccatgcctggctatttttcattttctttagttcagatgggggtcccactgtattgcccaggctggtctcgaactcctggcctcaagtgatcctcccaccttggcctcccaaagtgcttggatacaggcatgagccaccttgcctggcctagtttcttaactttgatataattaaatgtattaatattttcctttgtgatttatattttgtctatcttgtttaagaagtccttccctggctgagtgcagtgaacccaggagacggaggatgcagtgagacaagattgtgccactgcactccagccagggtgacagagtcagattctgtctcaaaaaaaaaaaaaaaaaaaaaagtccttccctaccctgaaattataaaaaaaattctcctgtatttacttctaaaaattgtgtagcgtttccccttcacatttatacttttaatccacttgtaattgattgaaaatatgtgtgattgataacatacaatctgcttttattttttccatataaataactgttttcacacatatttattgaagagtccagtctgtttttgagctgagtgtcagctctgctgtgaatcatattttcgtcggcctgtggtcttttcctgggcgctgtctatgttgatttatttatttatttattttaatttttgtagagaaaggatctcaccatcttgctcaggctggtcttgaactcctgggctcaagcgatcctcctgcctcagtgtcccaaagtgctgggattagagacgtgagccaccgtgcctgaatttagccttctttcatagtcatcattttatttgtgagactcatccatattgatagacttagctcattctttttaattttttttttttcccgaaacagaatctccctctgttgcccaggctggagtgcagtgatgtgattttgcctcactgcagcctccgcctcctgggttcaagcagttctcctgcctcagcctcccgagtagctgagattacaggcatgcgtcaccacacccagctgatttttgtatttttaatagagatggggtttcaccgtgttggccaggctggtctcaaactcctgacctcaagtgatccacccacctcagcctcctaaagtgctgggattacaggcatgagccaccgtgcctggcctgaaaaaatatttttgttggatgggattctattttatgaatgtaccgcaatttattcgtgttcttactgatgaatatttaggctgttttctggttataaagagcgctcctatgagtgtctcagatacagtctcaatgggagcatttctttaggataaatacctgcgtatggaattgctgggtggcagcatgtacccacctcaaccttgctggatgttgccaatgtgttctccaaagtagttaattatttttttcttctttcagtgcctgaagacctctcattagaagagagagaagaacttctagacattcgtcgaagaaaaaaggaacttattgatgacattgaggtaaaaaaaaaaaaaaaaaaccaaaaatccaaaactctgttttttgcttttgagtaaaatagtaaaagagtagcctcacaaaaatgtaaaaaaaaaaaaaaacccaaaaacaaaaaataacaaaaaaaaaagatgtttagtgtgtgcatataagaactacacaaagagacagagtgaaaagttatcaagttgggaaagcaaagactccacacaggcagtgagaccccgggtagaaatcaagacatcgtagaactgaggtcagcagtagccagctcgcaaacccagggccacaggcagcgtatcatctaaagcagcagcaagccacgagcgcattgctctgtcaaattgtgcactgagaccctctttcgttaactaatatgtttttttgtttgtttttttctttttgcttttttgagacagagtctcgctctgttgcccaggctggagtgcagtggcacaatctgggctcactgcatcctttgcctcctgggttcacgccattctcctgcctcagtctcctgagtatctgagattacaggcacccaccaccacacccagctaattttttgtatttttagtagagacagggtttcactgtgttaggcagattggtcttgatctcctgacctcgtgatccgctcacctcagcctcccaaagtgctgggatcacagacgtgagccactgcgcccagccaccaatatgttaatgttctagcacctagaacattgcctgttccatttttggctctcagatgccctttgagtgaatatgtgggcatgtattgggttccagctgtgtaccaagtgcctaccaggtggtaggagtaggatgacacattaggccgggcacagcggctcacacctgttatcccagcactttgggaggccaaggcaggaggatctcttgagcccaggagttcaagaccagcctgggcaacatggtcaaaccccatctctacaaaaaatgcacgccaccatgcccagctaagttttgtacctgtagtcccagatactcgggaggctgaggtgggaggatcacctgagcccaagaagctgaggctacagtgaactgtgattgtgccagtgtactgcggactgggcaacagagcaagaccctgtctaaaaaaaagaaaaagtaaagacaaataaaaacacaggcacacaaacatgggctcttccacacttgtgtactttactcagaggatggggtagagggcggtcccacaggagaagcatgtgaataaagccaccgtctcggcgtgggagagcctgtgattgttacagaagtgattcagagggccggccctggctccttccgtttggggcttccttgggaaagtcaatcagacatggaggtcttctttgagaagctttctagtcattgtcattgccaaaataaatgtggcttcacaggccacggcaaggacaggccttgtcccagacaatagctcctttctaggagtttgcgttttaagtccgagtgtcttggcatataatagggtcctgaataaaaatgtctttgtatttgaaaggtaattcatggaaatttttcttctaaggttacccttcattcttgggaaaatcagataacccagaattggtctctggttgaagaataaggatgtatattatttggaccttagtaatcagcctgctggataaatgtggaatcgtaatctagctctaactacttcattttatcagtgagcacactgaggcccagggaagttggaggcttccagaggtcagtctcattagtaggggtcacatcaagggaaagggggtctgtccccttggatgcatttggcttctctgagtgccctgagtcagttctgttcacccccgggctctgtccatggtgcttcatctcattcaaggtgatacaagtgatcctgagaccactgacctaaacacacctgagcttcagcctgagaccaccgatctaaacacacccgagcctcagcttctccctgggaacacaggcagtgttgaaggaggaggcaggtgacaactgtttgcatggcagggctgaatagtgcagttaagcgaactgaggactcatggctttccttttgctgggctttttttttttgtttttttgttttttttaaaaaaagagaccaagtcttgctctgtcacccagactggagtacagtggtgtgatcatggctcactgcagcctcaaactcgtgggttcatgcagtcctccctcctcagcctctctagtagctaggactacaggcatgtaccaccacactcagctaatttttctgtttttcttttttgtagcaatgaggccttgctacattgcccaggctgttctcaaactcctgatctcaagcgatccctctgcttcaacctcccaaaatgctgggattacaggcatgagccactgctcctggcttggttttatcttttcacagctgtgatattccccccccagtgtgcttgcctgattttatatacaaataccctaggatctgcagagtggacccctctgaacctggtatctgatgaaaagtgagcaaagaattttgtgttctcctaagttgtggtggctttgactatgaagctctagctgtattgataatagtattggtttttccatccctgtgatgctccggtgagaccgcagggaagcttgtcacaagagaactaaaatttctgagtctcaggggaggaaggttaagacccactccccacctcgaaattcttcttttttgacagaggctgaaatatgaaattgcagaggtgatgacagagatcgacaatctaacttccgtagaggagaggtaacaatttgtggctacacctttaagctatttactcttttctttctacctccatcctgtagtcaaacttgcagaaagtggggtgagagtggttgggatgtggggagcctgtggagttgttaattcctctcctctccccctactctgcgtggaggggtccaggggtgtttccctggatgttacctcccattgcctcctctgtaagtcatcatctgcctttataggttcaggcataagcacaggcacttcagggttgacccgcacagaaattacctgcctgcgtcataaggaactgtgctttattaaaatcactggtttgcatcattagctttttctgaagtgtctcaagttatcaaatgtgaacagcaatggtggctgcaccacccctgccgccactgcggagactgggggcccctccgtgagggcctgtgcttcgcttccttgagcccgttgttgcgggggaaagtacactggagggccgtgactgggctgcattgtgaaaacagcatgagtgatttttaaattatttcacaccaatagcaaaacgactcagaggaacaaacagatagccatgggaagaaagaaattcaacatggatcccaaaaaggtaagagaatgctctcccttttctggcctgcaggagatggactaattgatttgaactgccgtttcccttttggacagaggtcagaggtggtccgccctgtcacctcataaaagactgggagttgaaggcacatttttatcaaaaaggggcttttcgcgagtggggtgaagcagaagtgccttgtagggctggtgccctgggcagaaaggcctttctttcagagtgagctgctgggtgaggaagcagcctcacaggcacggcttggacgactcagcacaggccgggcttggctccaggcagtgcccttgctgtcgaggctcatattcgcatcttcccgcttgacctgggtcagggaatcacgtgactaggaaggagcaggggtgggagtggaaccctggtgtccagaggttacggactttataatctgggtgggttaagtggttcacataagaggactttattcctccattcaccttaaaaagcaggtgtctgtgaaaaaacaagggatcctccacatttaagccagcatctttctctttcctcaagttggattttctagggagacactcgaaaaccgtgaaacctgaaacatgtagctgcttgtttttgagaccgagctaagggatttggcagaatctgtgaagctttttgggggacattttggttttgagaaagaagggtagacctgagtcttcagggttgaggagaggaacggcgtgtccacgggaaggtctcgctgcagagctggttcacgccactcctgtggtcttcagtcggtctgcacttttttttttttttttttttttgagatagagtcttgctctgtcacccaggctggagtgcagtggcacgatcttggctcactgcaagctccgcctcccgggttcacgccattctcctgcctcagcctcccgggtagctgagactacaggcgcccgccaccacgcccggctaattttttgtatttttagtagagatggggtttcactgtgttagccaggatggtcttgatctcctgacctcatgatccgcccgcctcggcctcccaaagtgctgggattatgtgcgtgagccaccgtgcctggcccagtcggtctgtacttctaacgttccccttgcttttctggcattgagcctctgtgctaatgagttaattatttgttccttcgataaatatctgattgcagaattccattgtacaaggtctaagatctgtaaactcacataagtgcaggtgcagttgcaggtgatatttacagaagtgcatgtcgttatttcctgctcacggtttgcaggtctgggactgcaggtatgcgccactgcacccagataatttttttttttttttttgagacagagtctaactctgttgcccaggctggagtgcagtggtgcgatctcggcccaccgcaagctccacctcccgggttcacaccattctcctgcctcagcctcccgagtagctgggactacaggtgcctgccaccatgcccggctaattttttgtatttttttttagtagagacggggtttcactgtgttagctaggatggtctcgatctcctgaccttgtgatctgcccaccttggcctcccaaagtgctgggattacaggcgtgagcccagtgcacccggcccagtttcaccacgttggccaggctggtctcgaactcctgacctcaggtgatctgcccacctcagcctcccaaaagtgctgggattacaggcatgagccactgcgccaggccatgtctggattttcttaaggcccagcacatctgcacccagaggagggtttttgtttaatgcatacactctagccactgtgaaaactttcctgttgctttctggttctctgcttatggggcataaatcatctccaagatggaatgaaaattgtcaattttgtgaatttggaaatgatttgatattttgggtaacagcttttctttaaggagttggaactgtggagttagatttatcagcagatgtaataagcattggaagcatctcaggttctttatgaaagtggatgtgctcagaactgggtcttatgttttaaggggacccaagtagtgcagcacagggcagcacaccagtaagttcatggataaattctaatctcatgaaatacatacaaataaatacttattttttaaagggatgctactgagtcctggtgcggtggcttacgcgtataatcccagcactttaggaggcccagttgggcagatcacctgaggtcaggagtttgagaccagcctggccaacatggtgaaactccatctctactaaaaatacaaaattagctgggcgtggtggtgggtgcctgtagtcccagctactcgggaggctgaggcgcgagaatcgcttgaacctgggagtcaggttgcagtgagctgagattgcatcactgcactccagtctgggcgacaagagtaagaggctgtctctcaaaataagtaaataaataaagtgatgccactactgtgcatcaggtttcagcttcatgagcgtaaacttttcttcatgcctatgaagccctctctgtcaggctcttgactgtcttcctgttttatatataccgtgtgtcagatttataataagggccaacaaaactacaagttttgtagacttgaatatagcacttgtcagtccacttgagccttcctaacacaataccacagagggggccaggcgcggtggctcacgcctgtaatcccagcactttgggaggctgaggcgggtggatcatgaggtcaggagattgagaccatcctggctaacacagtgaaaccccgtttctactgaaaatacaaaaaattagccgggtgtggtgacgggcgcctgtagtcccagctactcgggaggctgaggcaggagaatggcgtgaacccgggaggtggagcttgcagtaagccgagattccgcccctgcactccagcctgggcgacagagcgagactctatctcaaaaaaaaaaaaaaaaaaaaaaaaaaaaagccacagagggggtgcgtaaacaatggaaatgtattttcttacagttctggaggctggaagtccgagatgagggtgccagcatgattggtgtctggtgagggctctcttcctggcttgctagtagccgccttcttgctgtatcctcacatgctggggagtaaggagaacttactcactctagggtgatgttcttataagggcacaaatcccatgaggccaggacctcatgtaacactgattacctccaaaagaccccgtctccagatagcatcacagtgggggtttgggcttcaacatatgaattgtgggggggacacggacatttcgttcacagctgcaaaggatgatctcacatgcttcagacacaactcaaaattatatctacctccccatgcccctattaaacctgtaacactatgaagcatgaagacattgtcagagcaaataaattccttccagctaggatggtgttttctaagtctcagagtgatgacactttaaacagggagctttggtttgttgaggtgcattatttctagaagtagtacttgagttcattaatgagtaagagggaaggtttgattagatcaaggaagctgaaaacactctgcagcctctcctttattcctgatttcctagaaatgccttaaataaaatatataaatctatatgacaagcaggggtccactcagtggactagaaattgaggaatccctggaagaagataaatgggatcagctggagaaggaaacactccccacagcacatacaagaaagaactgccgggggcggcaagagcagcttcagagttccccgagtgcagaggaggtacattcagggaacaggactgtgggagggacgtcgagactggtcacgctctcctgaccttgtgtctagcagtgattgtgtctccaggtgggaaaagcaagagggagcacttagtccgtgaaaacaggcagcgtcctcggtgggtggcagcaccaacaaggagaaatacccactcccagagaccagccgttggctgcctgacctgctcctcttccagatcactggaggcagctgcagcaaaaaccagaagcaagtagcattctgttaggccaacagtgaccctaaaatacaaagacaaacacccaccaagcaccaccaagcgtttgaggaaaccagcaccatgaaagagacatgaaacccaacaaacagaagaactaaggctggaggaaacagacttaatggaaacaatagaggcggggagggcggctcatgcctataatcctgacgtcttagaaggtctaggtgggaggatcacttgagctcaggagttcaaaaccagcctaacatagtgagaccctcatctctataaacagtttttttaaaaaaataagccaggcatggtggtatgcacctgtagtcccagctacttgagaggctaaggtgggaggatcacttgagcccaggagtttgaggctacaatgaaatgtgattgcaccactgcattctagcctgggtgacagtaagactttgtctcttaaatcctttatcaagccagatgtggtggcatgtgcctgtagtccaactactgggaggctaaggcagaaggattgcttcagcccaggagtttgaggctgcggtgagctgtgattacaccactgcactctagcctgggcaacagaatgagaccctgtctcttaaaaaagaagcaggaggctgggtgcggtggctcacgcctgtaatccgagcactttgggaggccggggtgggtggattgcctgaggttagaagttcaagagcagcttggctaacatggtgaaaccccatctctactaaaaatagaaaaaaattagctgggtatggtagcaggcacctgtaatctcagctactcgggaggctgaggcaggagaatcacttgaacccaggaggtggaggttgcagtgagcctagattgcactaatgcactccagcctgggcgataagagcaaaactctgtctcaaaaaaaacaaaacaaaataaaaacagaagaagcaaaaaaacaataggaggaaactttttatagtaggatatttgtgtatattataaatatcatcaaagagatacgataggatgtttcttatccatgatataaaaatgggggattgtgaaaaagaaccttggaaatgaaaactaggagtgtgtgtcacatcatcacttgagcatatggagaagacgtggctgaagagtggacgtgtgctagaacagagtttaagaattctttattcagttttgcagagacctacaagaaaacatgcacggtgggtccagcagcccaaatttcatgtaatagaagtcacagaaggagagaatggaaagtggaggagaggaaatatttcaaagaaatcttggaatattttagaactaagaaaaatccttagattcaaaggccccaccaaatgccaagcaggataaaaattgaaaagacttatacacatagacgtgtcaagtaaaatgttgtaaaactcatggatagaggaattcattaaatttcccaggaaggaaagatcagattacctaagaagaaatgaggagcacagcaagcttgtcagggatgctggatcaaagacaggaggggagcagtgcctgccaaggcctgaggaaacatgatttaaaaccccaaattctgtctgtcctgtcactcacaagagaaggtgaggaaacacatgttcagacacacaagggcttctctgatgtctaggaattgtgtaattggagcgtgacacctcaaaacaagaaatgactacataggataaaaaaggaaaggcatgcaaagaaacaagcaaaactttgaatgtcaaagtgagaaatttattgtttaaaagattttttttaagtccaaatttatgtcagtatttaagtagcaagggggaaaggaaggaaggaaggaacagctaaggttttctagatgttgatagataaaaataagtttaaatacttgtcaaaattttaagagtaatcactgaagagaaataggatttttaaattattaacaaacattgaataaagaaagtttgatccattcaacacaaggctggaaaggcctgtgaaatagaaagtaccaaataaggggtcaggagtaagtgctaactaatcagtgctcaccgtagatttgattgggctaaagtaatgacaagacagacacttgggtattaataaaataatataaaataaaatccagctttggattgagacccacacctagaagagaaacagaaaaagatagagtaggtgtagtgggtcaaatggtgccaccgcccccatttctgctgtttgacttttaaatggtattttaaaatagtaaacatttctaataatgttagaacactcactttcttttatgagtatttacctagtgtattagtattctagggctgccatgacaaatgaccagcaacggggtggtttaaaacaagagaaatctattctcgctcagttcaggaggccagaagtccgagatcggggtgtgggcaggattgctgcttagactgagggagaatcccttccagcctcgctcctggcggctgccaccctcctggtctccacagccgtgggcacctcactgtggtctctgcctccattgtcttgtggccttctctgcaccttctcctctctgtctcataggacaagtgtgattgaacgcagagcttctgtgtcctcctcctctgcttgtctctttgtcacctgccagatagcattctccaagaaatgtcagtgttttgtgtgttctgaattttagggcaggccttgagcatccagaggaaggcatgggagcctcatgcccaggcccattcagttccctgggcttcagctgacagtggcaggggccttcaccatgcagggtcaggcccccagccctgtagccccagagatgacaggacaactagtgatccctcagggtgtcctgtctctcctcccacctgcagctgatggcctcacctggcttctccaccggcctcacttgttttcctcacttagagccaatagcaaagccccagcactgtctttcctgccctaggctctgttttcagggaacttgggctgcattaggcctctcgaaggaccagacctgcattgctactgtgtgtgtgtgtgtgtgtgtgtggtttgtgtgtgtgtggttgtgtgtgggtgtgtgtggtgtgtgtggtgtgtgtgggtgtgtgtggtgtgtctgtggtgtggtgtatgtggtgtgcgtgtgtggtgtgtgtgtggtgtgtgtggtgggtgtgtgtggtaggtggtgtgtgtggggtgtgtgtggtgggggtgtggggtgtgtgtggtgggtgtgtgtgtgtggtgtgtggggtgtgtgtggggtgtgtgtgtgggggggtgtgtgtggtgtgtgtgtggggtgtgtgtggggtgtggggtgtgtgaggtgtatgtggggggtgtgtgtgtgtggtgtgtggtgtgtgtgtgtgtgtctgtcttgtaatttagatggtgcccctgtgggtaccatcaccagatacatatgagaattgatttaggattgttagactcactgatttttctggagaataacattaaaacatggtgcacaaattctaaatgtacagcttgaagaatctttataaattaatacactcacataactgcaacccagaacaagccgcagttgtagaatattacagggcacctttctgatgcctcatcctagggaattcactccccagggtaaccagtccttaatcaccataagttttgcctttttaaaaccttctgtgaatggaactgaaatactcttccgtgtcgtcttttgctccatatcatgtctgtgagattcattcttgtgagtgttcattccatttcatggctgtagagtcttccatcatgtgattatgccagaatgtactgatcggttctcttactgactgttttcagtttttggaaataaggctgctgtggacgttcgtgtgtttaaaaaaaataggaaatttctggatggaccgtgagggtatgaggcagccctggtcttgggtactgagagtcttagctggataaagcctctctgaatttgtagaaatggcctcctggcaaattgatttctgaattccctattcccttgccacccttgccaacacatattttgaaactggctgcaaggctgtgttagaggtaaacatttctattaataggttcctgggacttctcatgagacagtgctcagctgattcaggccaggggcagcccattgcctttgagattgtcagctgtgccgcagccctcagagtgggcatgagctttgactggatgagcttggtggcacagcatgtcagtatgtttttggcatcaggtaatagaaaatccaacaaaatgtatcttacacagggcgaggtttatcttctcacacagctgtgtagcagtaggtggctcccaagtggcaagaaggcggtccctgtacacatctcagggtttcccatgtgagatggccactgtggctctggtcatcacataagtgttcaaggcagaaaggaggaggaagagcagtgctggctcatgggctcctttttaccaggaaatcaaaaactttccctccaggcttgcctttctgtctggccagatctgggtcacaaggtcatttctagtgccaaaggcagccaggaaactccctctctagtgaagggggtggcagggagcggggaccagcaccacccgcttgctgcgtccctgggagtggggccaggttggccaaccggcagtggccaccacccacaaagttttcctcgcagacacagaataaactatctttctaagcttgggaaatctaatattactgttactcctgcctttataatttctaataaccacctgtaatggtttgttcaataacccatttgtctgtcttttaacttgttaaactgaacaggaggaatgaacgtgcgtttctttggtggataaaatgtagtatggatttgggaaaatcagattgtgcagttgtatgggtgtctctggtattatttttgctgtgtccataccagtaaaatcctgacactaagtgtatttctgtctttgaaaaatgagtttgagtgacactcctaaccagtgcttccattttaatgttcttcagggaattcagtttctaatagaaaatgacctgctacagagttccccagaagacgtcgcccagttcctttataaaggagaaggcctaaataagaccgtcattggggactacctgggtgaaaggtgagttagaggaggatgcaaagccctacctggggccactcagccctgcagcttgacctaggctcacgctccactttcggggccatcacagcctaaaggcatgatagagccacgggctgtgggcatccacatgcccgtctcaataccaagcgagcccagtgcaaccggttcctctcccgtgtccatgggaggagagaggcattaccgtattatgggatcctgggactcctctggaatcctgtttttcagggagccacaacagaactgacaatgctgctgcccctttctccttgtcttggaaagcatcttaatcgtcttctgttttgcccagaaataagcctgatttctcagtggttttctttctcctgttacttgcagtatgaataaaggtggaaagtgaatttttttaatggaaagcagcaggtcagatttactttctgactgcgactggcttagcagaggttagggcaggactgctgaggcagcacatgccctgagtatggcaaacagacttttgtcaaagaccagaagaaagtgtttttaaacaaaagcccagtagttcctaaagttgggcggttttggtttttagcttttttaaaaaaaatatttgatcgaaagtggaaagtggaatacttcccgactcattctctgaggccagcactacctgatacccaaaccaaagacaccgctagaaaatggcagaccctatccttatgactgtaatatatagtaagcaataggtaaaaaggattgtgcaccaagggggacttaccccatgcatgcaaggttagttcaacatacaagtcaattaaagtaatgtatctttcacataaaggacaaaacccacatgatcttctcaacaaatacaggaaaagcatttgacagaactcaaaactccttcacgataaaaacacttaaaaagctaagacaggcatggaacttcttcaacatgatggagggtacctataaaaaaccccactttaacatcatacttaatgatgaaagactgctctcctgctaagatcaggaacgagacaaggaggtctgctcttagtactgctgttcagcccggtgctggcacgccttgccaggacagttagacaagaacataaagacatccaaattggaaaggaagaaattaaattctatttgcagatgatgcaatcatatatatagaatatcctaaggaatcattaaaaactattagaagtaatacattcagtaaggttgcatgatatacaattaatatacaaaactcaattggccaggcgtggtgcctcatgcctgtaatcccagcgctttgggaggccgaggtgggcagatcacaaggtcaggagatcgagaccatcctggctaacatggtgaaacctcacctctactaaaaacacaaaaaattggctgggtgtggtggtgggcgcctgtattctcagctatgcaagaggctgaggcaggagaatgacgtgaacctgggaggtggagcttgcagtgagccaagatggtgccactgcactccagcctgggctacagagtgagactctggctcaaaaaaaaaaaaaaaaaaaaaaaaatcaattgtatttctatacaatagcaatgagtaaactgaaacagatattaagtaaacagctccatttataatagcattaaaaggaataagatacttaggataaatttaacaaaaaagcaacatttttactccaaaaaccacaaaacattgttgaaaaaaatgaaaagacctaaataaatggaaaagcatcccatgttcgtggattggagggcttactattgctaagatgccaatattccaacactgatctacagatttattgtacttcttattgaaatcccagctgacttctttgcagaagttgcacatcctaaaattactatggaaaattcaagggacccaaaataaccacagcagtctaaaaaagaacaaagttgcagaactcacatttcctgattacaaaataaagtggccaggcacggtgactcactctgtaatcccagcattttgggaggctgagacgggcagatcacctgaggtcaggagtttaagaccagcctggccaacatggtgaaaccccatgtctacaaaaatagaaaaattagccagacatgatggcaggtgtctataatcccagccactcgggaggctgaggcaggagaatcgcttgaacccaggaggcagaggctgcagtttgtcaaaatcatgttattggactccagcctgggtaacagagtgagactctctcaaaaaaaaaaaaaaaaaaaaaagactaaagtgtatagtcaagacattgtaagactggcataaggatacacatacataaatgatggaacagcattcagaatccagaaataaaccctcacattaatgtcaaataatttttcaaccaggtaccaagacaatttcagtggggggaagaatagccttttcaacaaatggtgctgggtaaaagtaggtagactctacttcatcagaatattgtgcttcagaagacatcaagaaattgaaggctggccgggcatggtggtgttcatagctaatcatcagttacagattccttggttccttccccactcccactgcttcacttgactagcctgaaaaaaaggtaaaaagacaacccacaggccatcctgggtaacatagtgagccctgcctctacaaaaaatagaaataaatcagtattacttgcaaatatcttcatatatttctccttatataatctagatgtaagtccttagcagattataaggaccagttatcatactgattcagtccttgtaatctcctaaggacttctatctagattatataaagaactcttccaaataagagtaaaaataacaaaaattactcagttataaactggcaaaggatctgaatagacgttacacaagtggccaataagcacaggaaaaaatgctcaattgatcatcaaggagatgcagattgaaaccacaaggagaggctgggcgtggcggctcaggcctgtaatcccagcactttgggaggccgaggtgggtggatcacgaggttaggagatctagaccatcctggctaacacggtgaaaccccgtctctactaaaaatacaaaaaattagccaggcgtgctggcgggtgcctgtagtcccagctactcgggaggctgagacaggagtatcgcttgaacccaggaggtggaggttgcagtgggccaagaatgtgccactgcactccagcctgggcagcagagcgagactctgtctggaaaaaaaaaaaaaaaaaaaaaaaaccccacaaggagataccatttcacacccattaggctggccgtaataaaaaagacacataacaaatgccagcaaggctgcagggaagtcaaacccttattcattgctgataagatataaaatgatgcaggcaggtgccgtggctcacacctgtaatcccagcactttgggaggctgaggtgggcggatcacctgaggtcgggagttcgagaccagcctgaccaacatggagaaaccccatctctactaaaaatacaaaagttagccgggcatggtggcgcatgcctgtaatcccagctacttaggaggctgaggcaggagagtcgcttcgaacccaggaggcagagatttcggtgagttgagatcacgccattgtattccagtctgggccacaagagtgaaattctggctcaaaaaaaaaaaggatataaaatgatactttggaaatctctctggcagttactcaaaatgtaaaacataaactttaacatggaacccagtaattccactcttaggtatttactcaatagaaataaaaatgtggccaggtgtgggggctcatgcctgtaatcccagcactttgggaggcccagggaggtgtgggaggaccacttgagcccaggagttgcagaccagcctgggtaacatggccagccctgcctctacaaaaaatacaaatgttttaaaaaagcatggccatgcagaaacttgtgcatgaacgttcatagccacattattcatcagccgcatcttttaaaatgattgcgataatgtacattaggtttgaaacttacttctttttttcccagggatgaatttaatattaaagttcttcaagcctttgttgaactccatgagtttgctgatctcaaccttgtacaagccttaaggtaagtatgatcatttgctgggtgtagagtggatggggaaggccagaggaccactgcctgggcagcagtggcggtgaattgactccaggtaacttggtgccacacgagtctcacagatgctggctccttttccggatgatccagctaatgctgtgtgacactgagcagccctagacaggaattggggcacacgcttaagataagggccgtgctttcctcactgtggccgctgatgctccttccattccgtttccttttatttgtaatggtgtatggcagtagtcgagtgccttgttcccaagctctgtatggcgtggcgttggtgctccatggggttacttccttccacacttgacccaaagcaccaaacgcatggatacctgagtgtgccagagaggatgtaggtgtctcgccattttggtgtctgggacacactccctggatgcccccttgagctgcccttcctgcacgttgtcttcctcctgctctgcaagcaggaagttgtctcgcttccttccttggtgccctggctgagtcgcgtgggctcttcatctgttctgggccttgaccctgagccagcactcagcagcatccgggggagaggaggcagggcttctggtgggagtcgcctcagccggcccttggactaagaaaatcaggccgcacctcgtcatcttctcaaatcttcggcttcataccttgttctcgtttacgtggactgtttgctcatggccttacctcaactgcagactgcaatgttggcagcgtttttgtgggaccctcgtgatgttgtgctcacagcgcagcctggggctgaacagtgcgctgagagttcgcaacatataagaatcctgcagccgcagttcaggcttatcagattgcgtttctggaagctgtacatccagagaagggtgcaggcctggtgagtctgggaggggtgtctggtgcggcccttgcagctgtgactccatttctttcagtccatcagtctctggcgagagccggagaggttcctattaattcccacagccgtgggagcctggcatagccccgtagagggcctgatggaggcacaggatgggcgggaatacaggcaggtcctgtggcctgaggagctgccctgaggatgttagcttttgtcctgagggacacggcaagcctgtgtggggcagaggcatgcgggctgactcgagacgcatcactgctgtggggtgggcaggtgcatgctttgctggtgaatgtggggcagagagggagtgaggggtggaggaggggtggttgtgttgagtctgaaggctgctggtgcaggcctggcggagaagaaggggcctggtagagagtggggccagacgtggctggaatcctgggaagagagagcagaggaaggaccctggggagctgccctgtgtgagggacgtgcagaggaagaggagccccgcggggccaggctgcatcctcccccgatggctggtgggatcagtattttaaaaagcccagagacttaattggagcctcaaggtctaactcggtcttgatccttgtgctaaatccacggcagcatcagacgttgctgaatagctggtgcgggaggctgcagctggccatggggactgcagcccctgcctccggggctcactcctgggcgggcagacggtggctaaggcagacaggtagcaggggtggtgccacgcagccaaggaacgcaaggaagggaagcagtgagcgggggcggggcgggttgttgggctgggggttccaattacaggcagggcagccagggagacctcagccagaggggatgcctgagggtgggagtgtctgctgggcctggtctctgaggcaggcatgtgtctgcccagcaaggcagcagcagcttctgaccgcagcgcccagtgctgtaggtggggctttggataccgtcctgtgggctatggctctgccttatgtgtgggagttctgaaaggaggaccggctggtggcagctcgggacaggcagggctctggtgatcacctggcagcagcaggagatggtggcaatggggacagagaagtgccaggatcctggatatttactttttaggcagagacaaccggcctcgctgctgaattggttgtagttacaaaaagatgagccatcagtaagcgtgtctcgagttatggaacggaaggagactgtcctgggtcttctcctttctgtctctgcgcccccaagcccctgccagagctgtaccccaggctcgggaggaaaacgtccttcctgagctgggcagaagccgcccttggccgtgaggcggtgttggttctgatgcggcttcccatggctttggtgtctccacaggcagttcttatggagcttcaggctgcccggggaggcgcagaagattgatcgcatgatggaggctttcgcttctcgctactgcctgtgcaaccccggggtcttccagtccacaggtcagtgcagagcccacagcctggccccttgccaggcacagcctccagctctggagggggcggcccctgtgggcacagcccagcgtgtgttcctggggacctgccttccctgagcgaggacgacctgtgggccgggcacctcttgcaggcgggcccccagcacgcggggtcccactgtccactggaggttctggctgagcccagcaccccggactcgttgcagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgagggtgagctccccggcccgcggccgctgccgtctgcaggatctcttcgctgtgagcggccgcagcgcccgcggctctagacacgcctcccaagcctccttgccgccctggtcccgctgagctttctgcccggccagccattttcctccgagtctctgaactggctgctgttttccctccttgcagaatttgtatgagagcattaagaacgagccatttaagatcccggaggacgacgggaacgacctgacccacaccttcttcaaccccgaccgcgagggctggctcctgaagctgggtgagccgccggcccagcgggacccgggcgtgacccctctgcccatggcagcagcccctcgggttcctcccaggctcatcgtaggaatgccccccaccgcaggcagagacgttaaaaagaaacgcggttaagccagagcccgctctcggtagctgcatggccacggctgcttctccgagccggggcctcagagccatgcccgcggcagagagtagcgcccaggctgcacggcccgtcccagaaaactgctgagttagcatccagatccagccagggcagcttcctgcacgagaagcaagcgcattatctccacagagcctgtgtgcctctctcggtttggtgtggctgtgatttttgacgcgtggtttaaatgtgccttcttgttgttttccttctgcctgtggctcccacctttctgttctgtgacgggctgtccctgcttgtcctgctttaggaggtaggtacccagtggctccccgccccctcagcggctcattcctctcgctctccccacgttggtctgtgtgagctccgctgtgtggctgccattcatccgatccatctgtggacttgctggggctgcgccgtgcacggtgtggtgaatgctacacccacccccaggggcggggctgagagtggctgggacctggagcacatggggatgctgtgtgggaaccaacttgccccccaccctgtgtctctaggggtccgcagcagtagagaagcagacagccagccctgtccctgcggcgtcaccctccaccccatactaacccagcagcgcatggagagatttcgggagtgctctaaaggcctttggagcaatttagggcaattacgggcagttttagaaatgctgaggggttgttttgcctgcggggcggggatggttgccttatgcccacagtgaagcgggcgagatgcggtagctgggttcacgcaagcctttctgagagcaggcggccgctgggcagcacgtgagacatggagtggagcatcctggtgattttttaaaaattttatcagccgggtgcagtggctcatgtgtgtaatcctagtgctttgggaggctgaggtgggaggattgcttaggccaggagcttcagaccacctgggcaatatagtgaaaccccatctttacaaaaaattagcctggcgtgatggtgtgtgcctgtagtcccagctactagggaggctgaggcaggaggatggcctgagcccaggaggttgaggctccaatgaaccatgactgtgccactgctctcccacctcggcgacagagtgagacctcgtctcaaaaaaataaacatcaaggaagggtgagacacggtgtgacgggcacaggcctcctcagctggtggaaagggtgtgagtcccacaggtctgccattcccattagggtctttgaccttggccattgctctttgacttttttctggctgtaccgaggtttaggggagttgtagatatttgcctgaaaacctagtaccatggtctttggctcgggtgcctgagagacccgattcaaatcacattgtgcgagtgttctagagtgagggccggtgggggggaatgtaaccggaaatgccggcaggcactctggggccgggataagtgggatgttcgtttgattagatgcctcccttctggttcctgcgttgcccaccagtgtcccctcgagggacagtgacgccatcagcctgcctggcagccaatgtgacccctgccaccagggaaaggtcggctctagagacgtaagtgtgtgaatgaaatgaaggcacagcagagctcgtgttgtctaacctgttttctggttgggcagataaacaggccatgaaatgagtgcacacagtgctcacgggaaccaagagctggctgggcgccgggtgccaagcgcaggggccctggaggggctggtccagctggcgtggcctcagtgtggtgggcggcccggtgagcacctgctgctctaggggctggcttccttgtcctctcccagcaccctgtatgtctgctgtgttctcagaaacaaagttcgagaccaaaggctggcgagccagggccctggctggaggcagacgagatgggtgcaggatctagaacgtgcttccaggcgtgtgctcagcggggagtgcggcctggcttggttgcattcttattgtagatttgcttttagaacaggtggtcttaaaaaggcctggatgctttgccagagcgtaggagccctgctgtgtacacaggcgtggcttacgattgttggtaacttaagacttcgagtcttgaatcaatcaccagaaaaaaaaaaaaaaaaaaaatcctaggaggtggcccaatccgagctgccatacagaaagtgtgtgcatgtggacctgtgtgtgcacgtacgcgcctgcctgctaacggcaatgaagacagaaacttacagagagaaagtggctcccatctgcaggttccagaagccaggctcttgtctgcaggcgagaatgctgtgtggtgtggccagaaacaagtgtgagcagagcctgctcggctctgagaccaagcttatcaccccttccctgggcctgcagtcctggtctgcaacgaccccctggccctgaggactggacagggatggggctctgcatgggaggtgtgagcgggggacccaaggtggagctgagaggccacctggcagacccctcccaggcggggccaggtgtgtgggctagtggaacatacaggtcctttgctgtccaccatgctgggagcgtggaggaagagagcaggcgctggacagaaacacacaacctgggggctcctggatgagctccccaagaactggagactcagataacagggcagggagaaaggccacagctggggagccaggaagggcagcccctgctgccgcccaaggagttgggtttaaagctgagtgcagtgggaccctttggggggcttcaagccggaggggcatgattgccacgtttttgaaaagatgcctttggccgctgtttgggggatggcagctggcaccagtgcagctggagcggggcctgctctggagtctctggagggaagcagaggcgaccgtgacagtgacggatgtcagggtagtggagttgctgtcagctgattctgccacagcagttcaagctggagcaagtgcctggaaggaatcagcactgtcctcctgtccctagggtctcggggacatagaacacctctcactgctcactggaggactgtgggacaaggcaggttgcccccagggtctcctgccctcccctgtggacttgggcctccctggtgtgctgcagtggaggtggggaaggtgaaggccaagggcttgcagagagcatggagcccgcggtgagacagggacacgagggcaacaaggactttgggccttgctgtgggcctggctgggtcttaaaggggaccagtgaggcggtgccacagttggggcagagggttccagtgacggagcagcttgcaggggttcggggagtggaagccccgccagggctcaggagagatgttgggggcagggtctgagggctggggagatgcagcagagagcttgggggcagatttgcccagaccagggtctagacagaccctttaacaggtaggctggtgggacactgatgagactggggcctgtggggagaggaggaacagctggaggctgggctcctgttccaggctggcggtggcaaccgcattgcaggctgccttaggcatcaaaggaggacggcagcactgagtgaggcaggggccagagggtcccagagggactgcagagacccgcttccggcctccagttccgctgagccaggcttcctcccacctgcagctggttcctcctcacccagggtctctgcaaaccaggccccaacagggaaagccccctgtgtcctggtgatccatccacagagcccttcgcacacagtcttgcctccaggcctcagcgcccgtgctggcccccacttagggagggagggctactcccctgccggcctgtcacagagaaagccgggtgagctccgcagcgctggagaggcatggggcagagagggcctagtaccccagggagcacttgagttcattgtcaccagcgtgtatttctttgaattatttaaaaaacaaacaccggcaaggctatagcagctgaagtcagtttgtctctgctcagtgtttaaggatcagagatttccttcccttagggagaggagggcaggtacagatgggggtacgtgcgtgtgcacgtgtgctccagatcttgttacaaaattaattcagtctcacgattccttgggcccaggggtgactgattttgatggatcccagggctgcccaagggcctctgtaatgcgataaccacctgacatggtggggtcaggtcctggacagagccaggcgcgcagtcctgacttcatcacactgccatctcatgtgggaaaatgacgccatccatcccactaactctcccaggaagcgaattgtagcgcggttgtgtcatcaaggggcccatcagtgccgtggagggggcgccggtgtgggcggggtgggtgcatgtggggccctgcggtgggaacgctgaaggacacctgaacccaagcctggcgcctggtggcctttctgaaaacgcagtggtctgtgcaggtccagggccccctcttggacccgcgggctccctgtgcacggagcgcagactcacggggcccttctgcttctaggagggcgtgtgaagacctggaagcgccggtggttcatcctgaccgataactgcctctattactttgaatacacaacagtaagtaagggccaggcctccttgccgcctcccagcagtcccggagctgccctggggccgagggaccctcaggctggtgacccacagtgagccccgccgtgtactttcctcttgtaggataaggagcccaggggaatcatcccgttggaaaacctcagcatcagggaggtggaggacccccggaaacccgtaagctcttcctcctgaaccttctctcctgccagccacctgggagccatcctcactgcctgcagggaacctgccccaagcccccctgaccgcctcccctctctctttctccaccagaactgttttgagctctacaatcccagccacaaagggcaggtcatcaaggcctgtaagacggaggccgacggccgcgtggtagaggggaaccatgtggtgtaccggatctcagccccgagcccggaggagaaggaggagtggatgaaatccatcaagtgagtggggcctcgggggcggggccaggcccgtcttctcgtgccggttggagggcgggggatggtctggaacatggatgcttccgtgtgcaagagtggaccttctgtctccagaaaccccagagggccgggctgccaaagccgacgttcagatctgagcctgcggtcctgtctgaggggcctctggggctggtgggaaaggggaggtctgtgtgtcacccacgacctaacctgtgtgttttccttttttcaccagagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggg

SEQ ID NO: 12338 - DNA, 26434 bp, Human
ggtaactggccacgccttgctctagacattcagagacaccggaggaaacctcaggccagaggacacctgggatgaggccctggaaataccagctctcctccctcccatgcttctccccaaagcaacaggacacggtgccgacccctcatttacaacgatgagctgtgaacaccaggagagtctctaaaagtgcacccttgcctggctgtgtccggcacgctcggactggccgatctgggggcggctccacctccaccttcttcccaggatcaaagtcgtcagcctctccctccgtgtcacagtgctccctctctcgcttccgcttcttctcttcctgggcggcagagtcaagggagtgagaaaggcaggagtaggcgggatccggacaggtctgcccaatcccctcgcagttctcaggggagggacagaactaagggaaaccccctccgagatcctcctcatgccaggctccctcctcacagagaccctggcagggtctgctgaggaacagcacacccaggatcctggaactgagtctgcgggcctcagcggttcgcgttttgctaccaacggaacaccccctcccctcctccagccacgcaggcgcactctgcctgggtcctgggaccaggctccccacgggctcctcgtgggcagcgtccgggccaccgccgctgctcctttacctttcgcttccttctttcctcatcgtccagatgcttctccttctcggacttcttcttcttcttctttttcttttctttgtgcctctctcgctcatggtctgacctgtcatcatagtaactggagtcgtggccggatcctgagagttcagtcacttcacttcctccgaccttcaggactagctttagaggcttctccaggggcttgtcggcataatctgcacagacacagaccgagttctacccgcgtgctcaggtgcaaacgccacgcagccaggtgagacgtgaaggtgctaagagggaaaggcctccctaaggagtacagcggggctgccaaccagcagggaaagacggaagggaagaccacagtggcggcatgtcactgcctccttgttctcccttcccctccgcagggagcttcaggtccctttcgagccacggtgtcctcaccagaggccctgtgggatgttgttcacattactcgttcaagaagatggattaagagggacctggaaccccggagcccgatctccctcctagaaacccccagcacttcggttcaccctcgcctgacttcctgcaggcgcccgtgctgcccgctgacacccatggagctgctgcgggagcaagggagagggagggaaaggcgggagaaagggcagcccagcttctccctgagctccacacaaaagccagcacagatgcttccctagtctccaggaccggggtgagtgggcttgcagcctcgaacccagaaccctctaccaggaacgtaagcgcctacccaggacccctcacgtgtgcccggttccctgcccgaaatcccaggaccccctcccgcgtgcccagaacccctccctcgtggccaggacctcgcccggtgcccaggacccccgtccgcgtgcccggaactcctcccccgtgcccgggaccccgcccgccgcgcgtcacaaagcgccgccgcctcaccctcgtaggacgagcgccactcggccttgtgcttcttgtgcttcttgcccatggcggcgccggcggcgggcccgaggcgggggctgggaacagctggcacccggtcggaccttggccgccaccgccccctggccctggctggccgcccgcgctcgctgcgccgaggttgccgagctcgctgggccgcgccggaaacggggcgaggcggggccgcggcaggaagtggccctgccgggcccgagcgcttccgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcaggtgagccggacctgtccgacacatcctctgggcacccacccgccccgaccccagcgcgtgcaccgagccccgaccccagcgcactgattctgatgcgaccgaaccccagggtactgatccggcccgactggacccgggcgcacaggccgcggggccccgaccggatcctagcgcaatgacgcgaccccaccgcagggcactgacccggccgacccgagccctgcgcgcaggaccccagctcacagattgagccccgacccgacctcagctcacggacctggccctgaccctgcccctgccccggctgtcctccagtgcattgatgtggccctgagtcccacgttggagaataggatggctgcgcattacagagagctctagtctcagccgaaagctgggtggttattctttgagccactgcttctcagaccctttaattgttcccgttcctcacggactcgatgttaaatttttagggttcaaagcacatcccactcatttgtgaccaagtcagttcatggtatggtggggcctgtgggctgtgctgctccctggagtggggggaactcagcggcggggccagaccttcacagaccctccttatgtccacggagggtggattgaggtcaggtgagaccaccagcctcagaggggatgcagaggaagagacctttcctttaacagaatagctgttgactgggtattttctaggtgctggagttcagacacgtcagcataattgcaccagggcccagagacacctgcacaaagccccatcacagcctggcgacacctgtgtaaacaccttagcgctcagagacacctgtacacagtgccaccgcagcctagagacaccccatgtacaaccacacctgggcccagagacgctaggcataatcacaccagagcacagctgcacctagaggacagacacctacgtacaactgcaccagagttcatagacacctgcacacaaccgcactatgcatggtggtcgctgcttgtagggtgctgggacgattgcaaaggggccacatgtcacctgcctggctctgaggagcctgtccaggagggctcagagggaggcagacattgaataggacttagagggtgactgcagttgatcaggccagtaagctgggacagtgcatagcagggcacagaggtgtgatccgggaccaggtcactgttgtagaaaggggaggtgttaggaggactgcagcaagggggaccaagggaagccctggataccaagctgaaagcattagattttctcagcacgaatcacggctattggagacttgttacaatgcagaccccaggcctgaccccacagctgtggaacttcattagtaatagtgaaagccaacattattgcgtgcttactatgtgccaggtatcgtcctaaacactttgagtgtattaatgacttcacagtagcccagcatagcgagaactcttactgttgtcccctttttctaactgggagctgaggcacagcttcttcagggcacagctggtagaggacccacaggcaaggggtggctctagatttggtcccaggcaggccaactccaacttaccctgttaactactgggctttcttatgtattgtctgagtttttcaaaacacttcattttaacattttgtttttgaactaagatcatttatgtgtgttttggcttctttttttagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacaggtaagttactaatttgctgggccaaggaacagttagctgaatacaaaaggttgtatcatgaatgtcttgccgttttcatagcctgttgtcagaaacaggttcacttctctgttggtttgggtggctagacaagttcttttcactagctgtcaggagccaggtgctgggagtaggaagtagccctgatgtcggggtgctctcagtatagcagtaacagattggaaaccaggaatgagaatgcagtgctgtacaatagtgggctgcgctggtaaggcctgtgtgccatgtctcattctttcaatcagcaaatgtttataaagtgctcagtgtgtgctaggaccataggaggtgtggggccacagagatgagaagatgggcttgccttatagaattcctttatctcatcccatgcatggccacctcacccaccatctgagttgatgcgtatgggttagaggagctttgtgtgagggcgtggaggcattggggcgattctggcaccagtataaaaacaacctgaaacattcctaaggaagacttatcacttacagcagtacaattcctgtcctgtaagaaccagctgtgaaggacaggcttggtactaagttctgctcgtgaggtggacctccccattcatacgttaggactcatgtttgtgcatgctcagagctttgtgcacactgagatctgataatgccgtggttttggccagtctgagggaaggaagagcttcccacactgttgtggagggatggacaccctaactggagggcacgggctgcccagggaaagttctaatgttctctgactgcagattcacttgtaggaatttatcgtagctgataatcatgcaattttgtagatctttctgaacagatgtttgttagatgctgttaataatagccaacaatttgaaatattttaactgtccaccagaggtcagttaataaatgtaggaattccatatatctacactatgtacaatatagccattaagaagaatgaaatagatttctatctaccaatgtaaacatttctctgagttaataacaaatgtaaaaagacacagttaggaaaccgactgggcaaggtggctcatgcctgtagtcccagcactgtgggagaaggatggaaggatcacttgaggccaggaattggagaatggcccggggatcatagcaagaccccgtctctaaaaagagttttaaaaaattagccagtgcggtggcgcacacttgtagtgtcagctactcagaaggctggaggtgggaggatcacttgagtccaggaatttaatgttgctgtgagctgtgatcgtgctgctgcactctagcctgggcgacaaagcaagatcccgttgcaaaaaataagttaattaaaaaaaaacaaaaaaccttatatgataaaactcagtttttggtcccatctgtgtgagtgtatttatataataacgtcccggaggctggatttagggcactttttcattctgtaagtaaatgtagggcccaaagagcaagggatgggtattagctttcaaaagagccaatcctcaatctgaaataaaataatagccttctcatctaatctgagaactagctttgattatactgtacattcagtttttatttgtagaccttaacatctaatttgtatggttgcagttaagtgagagttggaaatgtgtgtcgatattggcttttccctcattttagcccatcgatttgagtgcatgcactgttgcacttcacattttccagctgaatgaagatggccccagcagtgaaaatctggaggaagagacagaaaacataattgcagcaaatcactgggttctacctgcaggtatggggtgtgatgggagttgaaggggaggctgaggtcagaggattgtatactccatgccatgtcagttcacagggggggttctgtttgtccatttgttttgtaggattttaggatgttttctctcttatgaaatggaaagtatatcacaaaagaggaaagtagagatttccagtgtgggaccatactgttcctttgggtgggtaccttagagttcctggctaacggagagtgcccatgtgctcttctcacatgcctgcttggtctgtcctgctgagtggctccttgtctgcttgatgcttctccgtgggcattgctgatgggctctagcaggccaagcccacggcttcattcagtcagtgtgtggggaaacaggtggatttggatgggctctagcaggccaagcccagggcttcattcagtcagtgtgtggggaaacaggtggatttggatgggctctagcaggccaagcccagggcttcattcagtcagtgtgtggggaaacaggtggatttggatgggctctagcaggccaagcccagggcttcattcattcagtgtgtggggaaacaggtggatttggatgggctctagcaggccaagcccagggcttcattcagtcagtgtgtggggaaacaggtggatttggcatctggacttgtgctgaagcatatggataaaagacaattgtaagtggctatgatcataaattttataatgtgttgttcaccaccaaaaaatgatagtttaatgaaaacatattgtggggattatgttatacgtcaatggaaaataaatgacaacaataccttaaagaaggatgggaagttaaagtttttttaaaagacaattgtgcgtgataatgagacgtaaagtgtaattctttgactccatccagttgtctgccagaagttacatgtgactggcatttattttgcatctttgattttaataaaaatcaaaatttgaagaaaaatttgcagaatttatactttcctgtaatcagaatcatagtcttgcctggagcagcacaatgggaagctcaggcttaggctcaggggagactgactgggggtggctgtaattgcttgccttcctgaaatcaggtctttgtttaattctgtcacagctgaattccatgggctttgggacagcttggtatacgatgtggaagtcaaatcccatgtaagttgctgtgccttttcccagaatgccctgttatttgaagaggaaccattactgttttgctctccaacacccctgagcaacttgatgcagatgggtttttgggagcccctgtctgctggcagcccttgtcctggacatctatcctctagtattgctccagagtagagctggtctctgaggagctccctgagggagaagagggaaagggagaacgtgaaggcaacttagagaattaaaccctctggagatgggaggagggaaggtgagcaagcctggtccgcacaaaggaaaggccggtgtgtcttaacccctgcaccctcttcaacgggaagggtctttcccatgccagcagctggctagaagactatcactcagctgtcctctgcattgatagtctgagactatcactcagactgctcctctgcattgtggctgttgttattttgcgaataataactgctgtatcattctagggaaggagcttactcattacttgataaacaaaccccttagtggttttgtttaatgttggcactttaaataaaagtgatcattttgttgctcttcttatatttataatagtaatagccagtgtttttccttttcccttttggaagcaccttctcttctgaaatgaaagcgtttggaggtgatgatctcttaggaggcggcctcgctccctgtgctccctcttctcatgtaggattaagccctgggggagggcacatttcttggggacctttgccttgttggtatctttgtcaagctcttttctttttctctatcagctcctcgattatgtgatgacaactttactgttttcagacaagaacgtcaacagcaacctcatcacctggaaccgggtggtgctgctccacggtaaattatgcaggcttttatttgaccagataagtggcatgaaatttagcctttacttgtaccttcgtccttctgcaaggagttacggctctttgttttctgaaggagccacagctgtcctagaatgtcccctctctgtgaagcagatccagctcatgacacttgggacattttttgtttgtttgtttgtttttgtttttgagacagagtctcgctgtcgaccaggctggagtgcagtggcccgatctcggctcactgcaacctccacttcctgggttcctcccaggttccagcaactctcctacctcagcctcccgagtagctgggattacaggcatgcgccaccacacccagctaagttttgtatttttagtagagacggggtttcaccacgttgaccaggctggtctcaaactcctgacctcaggtgatccgcccgcctcagcctcccaaagtgctgggattacaggcttgagccaccgcgcgcggcccctggggcattgattactcggcacttaatcaagtcttcctgtggggggccacattccaagacatcctcagatgccccaaacgtggataatactaaaccttatgtagactattttttcctacagacattcctatgataaagcttaacttataaattaggcttgtagtactcagagctttactttgtgaggagtaaactgaaaaagccatattttaaagaaattctgtctggttcttctcaggagaaaatactgatggtttgttgtttggttttgttttgttttgttgtcaatatcaccgggtagaatggggacacgggaattgagtggactcgagagtatgaaactgtagccaagtgttaaatagaagcttgaagggtacttggcttctttaagtcagttaagattgcgtgacaaagtgaccttaaaacacaatgttcttttaaagagcagacaggccccgcatactgccctcatagcacagtcagagtaagcagcaggtgttttaattagtgaaataagttgtttctgtttggaaccagttacgtatttcctctttaattcttgaaaatacctgcagaaaattagagttgtatgtctccattttctgttagatgctttcctttttccatattggtcacctcgcagcttctgtgaggcatcttttgtagggtccagccccacagggttggtgagttttctccccatgtgcaaagacgagagagtgtagaaataaagacacaagacaaagagataaaagacagctgggcctgggggaccactaccaccaagacgcggagaccggtagtggccccgaatgccaggctgcgctgatatatattggatacaagacaaaggggcagggtaaggagtgtgagccatctccactgataggtaaggtcacgtgggtcacgtgtccactggacaggggacccttccctgcctggcagctgaggcagagagagagaagagaaacagagagacggcttacaccattatttctgcatatcagagacttttagtactttcactaatttgctactgctagctaaaaggcagagccaggtgtacaggatggaacatgaaggcggactaggagcatgaccactgaagcacagcatcacagggagacaggcctctggatgactgcgggcgggtctgactaatgtcaggccctccacaagaggtggaggggtagagtcttctctaaactccccgggggaaagggagactccctttcccggtctgctaagtagcaggtgtttttccttgacactgacgctaccattagaccacggtcagcttggcagcgggcttcttcccagacgctggcattactgctagaccaaggagccctctggtggccctgtccaggcataacagaaggctcgcactcttgtcttctagtcacttctcactatgtcccctcagctcctatctctgtatggcctggtttttcctaggttatgattgtagagcaaggattattataatattggaataaagagtaattgctacaaattaatgattaatattcatatataatcatatctaagatctatatctagtataattattcttattttatttattttattatactggaacagctcgtgccctcggtctcttgcctcggcacctgggtggcttgccgcccacatcatgctaggggacgcttggcaggcaggcgtgcaagaagagtgctggcctctgcctcttctagtatggggtatgagcccactgagaattgtcttaggaaagagggtggttctgggggcaacaggaataacacatgacccctccacctccatttatcaagaaaggtgtgtttgatctctgaaaggtgccttgatgagtggatttcataaaggaagagtggggacaaggacaggtgtcagcaaagatgtaggctagaaaatgcaatgttcattcccgacgctaagtgagactgtaggccgagaagctgggagcagtgctgggggtggggaggcgatggaggctgagaccagaaatacgaagttgagtacaaataagaaagagggggagacgtaagtgtattggtaatatttcatagcatttaagtttctaagcagacttcattgtagtaataacattaatagcttttaactgtattccttatattttatggataatggaagttactgttgttttaagaaatttgttgtagcactgacttaaaaatatatttgcttggatctttgtcacaggtcctcctggcactggaaaaacatccctgtgtaaagcgttagcccagaaattgacaattagactttcaagcaggtaactttcggtaatctgtgagaggagagccatgggaaggggatttataacgggaggttgtttttttttttttctaaatcattttacgcaaataatagattcctctccactgtaagtcacttgattcctctgtattcagcatagttttgagttatgatttcagtcttttaagatttgagacttacttgattgccagcacatgatctctgctggtgaattgcacttcagaagactatactttctccccttgctggatgcagtgttcgtctctaattacggatttgtcttttcctcttgagttctgtctgtttggggcttatggttttcatcacatttggaaaatacctggtcattgtttcctcactgaatttccttgaccctcccctttatctgggactctgtctgctttcatgttagactgtttgatgttgttccacaggccactcctgtgctttttcattttttttttcagttctttagaaatatgttttattcgaaagtttctattgccgtattttaagttgactgattttctacatcgtctaatctgcttttaattccattcagtgaagttgttatgtctgatagtgtatttttctgctctgttctatttgattctttttatactgttttttcattatgttctcgttcacgtcttgaacaaccccataatagctgttttaatgttctgtctgctaattccatcatgattgtcatttctgattgtgtttctattgactggtttttcttctggttaggggtcacatggttttgctttgttagcatgttaggtagtgtttgattagctgctgaacattgtgatctgaagtgtgtggattgtgtgttcctttagtgagtgttagattttgttccgttaggcatttccattacttgtgatttggtgtgatcctttgaggtttggtttttttaagctttgactgggaggggtttaggtttggtcttaacactcaattgtggtcctctggggtctccactgagtgtgctgaaggatccgtgggcactctccactctggcggtcggagtatgcactcctctcagcctgtgtgaggtccaggagcccttcagctcacagaccacgggcgccctttacatagctgcagggaatgtcccctgctcacacacacctgagtattcatccaggacatcgggggcgccatgaggatcctgggcactccttctgaggtatttcttcatatttccttcccctctggaattctgttctgcagccttcagtcacttcagactccctgaactccaatctctgtctcctcgactcagcgagtggctgtgctccacttgggctccctcccgtgcctgtggttggaagatgcctcccggcaagaaagttagagcatttgtagagagggtccctggtcttccgactcaggagtcccagccctcactgccctgtgtacagcaaccttaccagatgtcatttcatccattttgccttaaatgaggttttctcatttaagattagatggtaaatctgcttcctgttactccagtatgactagcggaaatcctgtgaggtttaatttcgtatacataatttttgttcttcaaaaatgtcttgtaaatgtttttacatagggaaattgctttattttgaccccttagcttatgtttagcaacttgccctttgctttgacatattgaaatacatgtgtgttttcaagatctctaggggcatgccagcatggcggctcaatgcctgtaatcccagcgctttgggaggctgaggcaggtggatcatttgaaaccaggagtttgagaccagcctggccaacatggagaaaccctgtctctacaaaaaaatacaaaaaattagctgggagcacatgcctgtggtcccagcttcttttgaggctgaggtgggaggatcaccttagcccaggaggtccaggctgtggtgagcctgggtgacgggagtgagaccctgcctccaaagagtaaccaaaaaagatctctaggggcagagagggcaacacaagagaaggaaaatgttattgtaaggaatatagctttttccagtacaaagatctggaaatatgcattggttttatggcttagaaatggcaaaaagaagtcctagcaagacttttcctcactctatcaaagaatcaaaatgttttataattaattttgtttaatattcaacccagtctatattttgttagattgtctgtatccctccactgttttaataaacagtatcagtaaacggtctctctcttttttacgtggaatgccagtgatgcttcttgaacgtaattctttttcttttgtggacttttgacatggaagcaactgaaaagaggacctggaagtcagtttctctctggcctcagtcttgttctctggtgatttagtcagcagctaagcacgcccagatctgtctgcgggcttctgaatggatagaggagtgtttctgggttccagtcagtctgtgtgtgttaaggttaactttgggccacctgagcattcctgggctctggggtctgtgctgtttagggttctgtggaaggaggggaaaatgctcagctcctgccaaaagctcttgatgcttctattttgttttgttttctgtcttatgttagtactgctaatatttttaaacatagaaatataatttgtaaatagatataaaatgggagtttttactctttaactcaattgatacagtctagaactactgattgaatcttgttagactttttcataattatttagtacacggagggctggattcctcaattctttgtcagtaattgtaattcccccgatgctgggcacttgagatgttgcattcaggacgcgtgaatggctgccgctgaggatccacaggaccagttagtaattctctcaactccttttttctatctcaggtaccgatatggccaattaattgaaataaacagccacagcctcttttctaagtggttttcggaagtaagtattaaatattaattctaattgtctggattgtatagctgaaaaaatgtcttgtatgttaggcaaatcctcctccagaagcttcaggagagaactgggtgggaagggtgtgtgaggattggggctgactgtgatcagagaaggttccggagctggggcccttggggaccctcccttggttctccccagacctgtgactgggtgggacaggacaatcgatggactctcagaagggcagggctggcactcaggggactgcagccctgccatgcatgtccttggtgctcatgcgccctagcactgtctgtgagttgagggggtcagacaaggtgatgtcacatgtgattcttacctctgaggagctgtgcccaagtcacctggcatccgcacatccctctggtgaggtgaggtgggaccaggcacgctgggcacaggagagcctgtgaggagtgcatcccagcctgtttgcatctgtggtctgcctcttttcctcatcagagaggacacacaggtaaagcagaggtacaggtcaccctcactgtgccgccccgggcaggtcaggtgtggtctcaggtctcagcaccctggcattcaaagcagaggggaagagtgttaggctgacctcctcccatgctgccctagcttctctgatttagggagctttctgaggggccgtcaggagacagtgggcttgtggggacaactggggcagcaggccacatcagggtccccctgtgcacctggcagtgtggtccctgcacgttgacactaaaagggtgtttgggttccagagtggcaagctggtaaccaagatgtttcagaagattcaggatttgattgatgataaagacgccctggtgttcgtgctgattgatgaggtaggcatttccagataaggaaattcatgacagaatcgccttttgccattgtggggacacagcctactcctgatgctcctagctttcccctcctacagccgggctgccctctatccctccctgcactgtgcgcctttccaccttgccgcagcatccgcaggctaggcacgggaacacccattcattcatctttttcacgtgctcagcgggacgtatccccatagctgcctgtgaagtgccaggccctgtcctttttgaccccactgctccctcccaacaggtggagagtctcacagccgcccgaaatgcctgcagggcgggcaccgagccatcagatgccatccgcgtggtcaatgctgtcttgacccaaattgatcagattaaaaggtaaccaggacatgcagcaattttccctgagaagtgatgagaagtttgtcccaaagaaatgcgtgatacttgtgcaaccctagatcttagtgcccagctctttcaccggaaagtgcatttggcattgagtatcgactccttttccacattggaagcagcatatcacaaatgctttttaaagaaattgtttttagtgtgttaaaaatgtaatagaaggccaggcgcggtggctcacacctgtaatcccagcactttgggaggccgaggcaggcggatcacaaggtcagtagattgagaccatcctggctgacacggtgaaaccctgtctctactaaaaatacaaaaaattagctgggcatgatggcgggcgcctgtagtcccagctactctggaggctgaggcaggagaatggtgtgaacccgggaggcagaacttgcagtgagccgagatcatgccactgcactccagcctgggtgacagagcaagactccgtctcagaaaaaaaaaatgtgaaagaaaactcaggcatggtaagcattttacgtagcacagaaaagcataaaatgaagaactgctacgttcaggccttatcccacccacttctctcctatcccacccactgtcagcaccaactagtgctgctcgtaggtgaatggctgtcccctgctcgccctgctggcccaggacagacagcttcgtgtgcagatggtccacgtctccacagcccagcctcacagggccagggcctgttgtcattgtagcccaagtttatcaagcttaaggagcgacagctgctggcccaactcccaaggaagtgatgggcgagccagaacctgcctgtccctgtgtggtgctcagccaggactcaggttccttctgtgaaatgttctttctgtcctcagggtgcctggggagtccctggcattctcagaagctggattgttgagtgtggggtgacagcagactgaactgtgcagaggaacgttttgtccaggccatcaccactgtctcaccacagagagcgtatctggcttcctgagaagcgctcgttttggggtcagctgcaggaatgtgtgccaagaccagctcggtcggggagaccctaacccagcggcgctagaggaattaaagacacacacacacacaaatatagaggtgtgaagtgggaagtaggggtcgcacagccttcagagctgagagccccgaacagaggtttacccacgtatttattaacagcaagccagtcattagcattgtttctatagatattaaattaactaaaagtatcccttacgggaaacgaagggataggccgaattaaaggaataggtggggctagttaactgcagcaggagcatgtccttaaggcacagatcgctcatgctattgtctgtggcttaagaacgcctttaagcggttttccaccctgggcgggccaggtgtcccttgccctcattctggtaaaccgacaaccttctagtgtgggcgttatggccatcatgaacatgtcacagtgctgcagagattttgttatggccagttttggggccagtttatggccagattttggggggcttgtccccaacaagtgtgcaggtcctggaggggggcctcccctgcctctggcttccttctcctcttgtccacttccttccccacctggcttgtctctcagtctactgcaatctggctcctgcccccgccgcagcccagcagccccgcattcacatgagtgttcccttttctctttctggaactttgcacagcgctgacaccctgatggccccttccctgaatctctttgtgcctccctccccggcctccattctcctgtctccccggtttatgctgctggcgtctctccgcagggaggggtctacacagcctgtctgtggccttctctcctggcgtgtgccccttcagcatagctcagggttctgtggggggaatcccagacctgcacatccacctgtgaccagacatcaggcttagatgcccgggatgccaggcacactcccacactgctcactgggccccaaatccctaacttcctgggattccacacgacgctgatggcctcgctgtgcacctgccactcaaaccagaggatggaggccaccgtgacttctccctgtcagtcacaagggggtgtggctcaggaagaaacaaggagacacgcttgcctctcttgccttcattccctcgtgcttctggttccagcccctctctagaggactctttctgtcccccaccagtcctgtccactcccgcatctctggattgtcagcccctgggtcgtgatctgcaggcctaggcctccctctggcccttcctgcagccccaccctcctggtgctggactgagcagctgtgagctcacccaacctctgtgccttgttcctctgccggggacccacaggctccctgtcctgcctctgcttagctcaccccggcgcgcaggcacagggcctgccctcccttggccagggtctaggtgaagttgaccttccccaggcagcagtggtagcactgccacatgtgcagccacgccccccaggcctgtgcagcatgctccctgggggcaccttgtgcccgctctgctggctcatgctgggtccttgggggacattggtcaacagaccagacaacaggggctctctctatggagtttagacgctagaggggagagcagatcatgaacatgggaagtaacccagctctagagtatgtctagggatgatgagtggccatgcccaggtggtggtgggcaccagagcccacggtaggtggcacaatcaggaacgccatgcgaaagtgagatccttgctaggccgggcgcggtggcttacgcctgtaatcccagcactttgggaggccgaggcaggcggatcacgaggtcaggagatcgagaccatcctggctaacacggtgaaaccccgtctccactaaaaatacaaaaaattagccgggcacggtggcgggcgcctgtagtcccggctacttgggaggctgaggcaggagaatggtgtgaaccggcgaggcggagcttgcagtgagccgagatagcaccactgcactccagcctgggcgaaagagcgagactctgtctcaaaaaaaaaaaaaaaggaaagtgagatccttgccaaggttgaaggcagtgagggaatgagcgaagtggggctgtagaattcccagaaggccaaggagcagcgagagcaaaggctggggggtctgcgtggcctgtgttggcacaaggccactttccttcctgttggcagcctgctggccatcgtcctgccaacctccttgccagatagggcaggatagaattgggtcaccgacagccgtgatgactgtggtgcttgcttctcggccacaacaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaaggtacctttattttttttttcctcttgatacaaatggatttcttatatgttcttaattaattaagatagcttaaaataagctcgttccagtacggaggatttcaacatatgcattaactcccttcttaaattgaaaactagttttgtatgtgacaggttgagctgatagttgaaactagggccactgactcaatatttttgttcttttggcacaatacagtcatcattgttcattatttgaggtaccagtcagtgtaggggacgtcagtgaccggctgtgtttacctggctggctgcacaaaccttagttctcagcttaccccgggcttttccaatgccctgcctctcgggggcctgtatccttacctgaaagaggaaacatcacgggcgtagtatgggcctggttttggtcacggggtccacatgacgtcacgttcttgagtcgcctgttgtgatgataggcaggaacactgttgccgtgggcagagcgacgcgtgcgggttgtgtgtgtgagtcaggaaggccgtcgccacgggcagagcgacgcgtgcggggagcgtgtgtgagtcaggagggccgtcgccacgggcacagtgacgtgcggtgagtgtgagtcaggagggccgtcgccacgggcacaatgacatgtgcggtgagtgtgagtcagtaaggccgtcgccatgggcacagtgacgcgtgtggtgagtgtgcgtgagtctggaacgccgtcgccatgggcagtgacgctgcggtgtgtgtgagtcaggctagcagggacctgccccatgcttgtgtttctgctgctctagcccctgtgggaacagacctgtcccagacaaatcatcctgcaggggcctttgtttagggtagttgggcggtaaccaagcaaaccagtgaatggggatttaaacagtgatgagtttaatgcagttgttgccacctgctggtaccacagagtaggggtgttaacaaggatggcacaccctgctgtggttggggacgggagaactggtctcagccatggacccactgggcctgcccgggtcagcactgtccaggcatggttttcttgggggttggggaaaggagacggagctctgtggagctttgcctggagaatgccagtgatctgaagactgattctacagcagttttgctgccaaggagccccacgtgatagcagatcctgcgaggaagtcgtgtgtgttggaggtcctcacgcaccttcagtgtgggttccagccctcgcagtgtgacgtttatacacttgtacactcgtgctgtgaatccaggggctgtttaaagtgttagctaagagggatggactttttctgggacagtgtaggacaggggtagttttttgtttgtttgtttattttgagacacagtctcactcttacctagagctggagtacagtggtgccatcgcagctcactgcaacctccgcctcctgggttcaagcgattctcgtgcctcagcttcgtgagtagctgggattacaggtgcatgccaccacacctggctaatttttgtattttcagtagagaaagggtttcatcatgttggcctggctggtctcaaactcctgacctcaagtgatccgcccacctcagccttccaaagtgctgaggttacaggcgtgagccaccgtgcccagtgataggggtagtttcttattttaggcagtttatatgaaattaagacatgcagatgtcacagtggatattgaactggtctcgaaagctcaatatcccccaaagcacaagcacaaactgtcttaattttgctcacacccctcaacaaacctccaaaatgttcagacaatgctattttcttccttctccttgttcctgagtcagaacggttcgtattagaattcagtcatagtaagtcagtgtgcgcacctgactgttggcaaggctgcttggaaaagcatgacttccagacaaatgatctctgaggggaacttctggtgctcagctcctcggtcagtcagacactgtcatgctgccaaacaagcctcacctttaaaacagacaaactaggatcctgctttggaagtcagtggaagtcctggctctaagtcccagctctgcccactgtgggttttgacgtctccgaaggtggcataacagactggactgggtgcctccaggtcccttcccttcctgacacacagggaggaaaagttttggctcgaaacacagaagaggctatgttgctactggtttctgaggcatgttccgttatttgtatttgtttgaaaaagcagaatgtgtacgctgagaggcatgagagagcgagcttgttccctagtgcagctgtgcatcttgagtcgtcaccgtctggatttctgtgagacgtggcgtggttgacatttgacctgcaggtgctgtccctcttgctgacggtgcctacgctcaggcctctgtggactcagctaaccgcctgtacttctgtctccccagtgtcagatcatataccctcgccagcagctgctgaccctccgagagctagagatgattggcttcattgaaaacaacgtgtcaaaattgagccttcttttgaatgacatttcaaggtgcaaattgacctcatttttgtaatcaagaagaatccatttgtgatattaactagggagtcattgtttcctttgaggagaccagggagggccctgggtgtgaactctcaacacagtataggtatgaacatgcatgtacacacgtgtgtgtgtgtgtgtgtgtgcatgtgagtagaaacacgcagcacagccacctccttccaaaggagatgtaacccttgctcagggagggcgctggctcacactggaagcctgcaaccctacggctgacgacacttacaaggattcgcagagtccacagaaaggaaatggctttgggggtccagggagggtggaagggaaggtaggaaaatcaaacggtgccttgaaggatagaatttggttccagctggagagaaatcaggaaggctgctggagcagtgtgttcaggtgaccgtctagtgggttgcagtgtggaggctggggaggtgccggagaggcggggggtggaatggacagagcctcgggtttctggccagagtttgaattttattttgaagttggcaagaatgtggaaggctttaaacaagggataacatgaagaatgtagtattttttaaggatttggattatctgttgaagagatttaaatcagttaagatgggaacgaagaacagttcagagacttctacaaaaattgaagatgtgaacccacccattatttggggactctgtgcctactgaccatgtgcccgctgcatcgtgccttacgcctggtgctcccaggcaggtgatgccttccctgagcgcaaggatgctggccctggggcagaggctcccgggcaggtgatgccttccctgagcgcaaggatgctggccctggggcagaggctcccaggcaggtgatgcattccctgagcgcaaggatgctggccctggggcagaggctcccgggcaggtgatgcattccctgagcgcaaggatgctggccctggggcagaggctcccgggcaggtgatgccttccctgagcacaaggatgctggccctggggcagagcacacaggtgtgccttgggtgtgcttcagagccgcgaggacactgcctcccagagcaggagctgaggatggggagagaccggccccatacgagaggccgggggcaaagagacattcagagggcaaggctcaggagaccagtgaggggcaggaagtgccctgtgaacccagggtgtgcttgggacgcctcggcttgtgttcccagggatgcctcggccaatgaggaaaattagtcctgaaacgtgtgattgtataaattgctgtctctgaactgggttttctttacacaggaagagcgagggcctcagcggccgggtcctgagaaaactcccctttctggctcatgcgctgtatgtccaggtgagtctccactgctgtcctccagcacccgccctgtccacaggtctcagcctcgccggagattccgcttagtagccctggggtatcagcctcattttatctcagtttctaaaccacagggtcctggggccggaggaggagctgaccttggcaccgaaacacaggggctgtcttgagtcctttgggaggaggcggctgtgccacatgcctctgctcacacgcatgcatgcacacacatgcacgtctgcctctgtggtgtgctgagctcgtggccagggccctcgctggcctcaccagaggtttgtgctctttcagtctgggttcagctcacatagaacagtgacctggatccacagcctcacccactgggtgctgggcctgttgcagatgcttcggcctggggcactcacccctcccctgcactgtccccagcagccggttggggtaaggactcagtgtctggcagagcagatacacttacatctgagaagagaaaacccccatcttggaatgtttcctttcaaatcagaagtgactcaggctctgtctgatcagtagcagcctctgtgctggacacagtgctcagcacagaggtgacagtggccatggatcatgagtgggagccttttgatgcaggggaggtgacagctctgggcactgggccatgggaattctctggttataagcctgggacatagggtgggccctccagggtctgctccctacagcttctcatccttctcagtgtgtgggtggctgccttggtgctcccctgcccacccccgcagctgtttctgacattcaggacatggcgggggcgggggtcacgtagccaccttgttcgccttttctgaagtaaagagcttggctgatgtgcgtcctggacgtgtgtggtgcgcactcactgctcaccttatcagctaccacccccttctgtgctatctgcactgtgggtggcggcaggggctgtggatgccagatggccccaccaaacgtgagttgagcccctccagcaatgaccgtgtaccttctaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaattttcttgttttgattctaagtatctcttccaagtgcttttaattttactaaaaattactcacatgattacttaactttaagcctgatttatggtgtggggaccttatggtgtaactgcatcatccagaagaaattgggaaggtgccagtggcccaggtgcagattcaggaggtagatcaccaaggccaaggcatatgcaggttctggtcaccgtgtcgtctgctgggccttaactctagattcagaacccggagccactcctgccgtggaaagcagagcctggctctgggggtggcaggttgaggagtgggcccagtccatgcatgtcagtgctgttaaaggatcttttcaccagtgggcacaaccctaacagctcccccacctccactctccaggagtcagcttggggtccacagtggcttgcggcccttgtactcacaagttcttcaagaaacaatttgagctttttaaaacagttgggggtggggtatagtgaataaggcaaaagactcatctgagagtaaaggcagtgtattagggttctctagagggacagaactaatggaatagatagatacatatataaaggggagtttattaagtattaactcacatgatcacaaggtcccacagtaggccatcgcaagcttcagcaaggagagccactccgagtcccaaaactgaagaacttggagtccgatatttgagggcaggaagcatccagcacaggagaaagatgtaggctgggaggttaggcccgtctcgccttttcacattgttctccctgcttatattgtagcctcactggcagctgattagatggtgcccacccaggttaagggtgggtctgcctttaccagcccagtgactcaaatgttaatctcctttgacaacaccctcacagacacacccaggatcaatactttgtatccttcaatctgattaagttgacactcagtattaaccatcacaggcagacgcatgtctagaagacaaaaggtacaatattcttgctgccgaagaaaagaaaaaattgccaaacctgaattgctgtgaaggacatagcttggaaggcatgacagaaggttccctgcagttatggaggatgagtatgggtgaggtgctgtggaccccagctccagtatcactgggcaagtcttgacaggacaccaaggtcatggaggtcagccttgtggagcccatgctgcactcagatgagatctgtgggtccaaacagctcaggccatctgagtttgtcctgtttgatttgcttgttatataaaatcaatcaatcaaaagatagatgagtgataaacgtgccatttcatttacaccgcttctgaaaccacacttgaattctggaggccgctggctcgtgcgtctcaggcaggcccactggatgtggtgggactcggcagtggcagggacttctcatggactcattgcaggtgtcaagttcctgaaaataagatacctgtggtagagaaaccaggctgtgtccttgaagtcccttcaggctattaaccgagtgggaattcagggaatttcacatgtcaacagtaggatgattgttgtgtttaactgcatgacctctgcaaaatggggattaagagatcaactgataacaaagtacttgcccaagttcagagacctaccgcagcacaaccttactaagaaatagaggttgaaaatggcaatttcagtatagaaatacgacttttaaacatattaattctagtagttttttgacagcattcttaggattctttaggcacttgattgtgccagctgggaataaagacaatttgcttatttttttaatctgtgcgcttcctcccccccccccccattttcttgccttgctgcataggccatggcaagtatgaggttgaataaaaatgccttagtgga

SEQ ID NO: 12339 - DNA, 74527 bp, Human
ggctgattcctgccttaactgatgacattaccctgtgaaattccttctcctggctcagaagctcccccaccaagcaccttgtgacccccccgcccctgcctgccagagaacaaccccctttgactgtagttttccactacccacccaaatcctataaaactgccccacccctaacaccctttgctgactctcttttgggactcagcccacctgcacccaggtgaaataaacagctttattgctcacacaaagcctgtttggaggtctcttcacacggatgcccgtgacaagtgcctgccaccacatcccactaatttttgtatttttagtagagatggggtttcaccatgttggccaggctggtcttgaacgcctgacctcaggtgatccacctgcctcggccttccaaagtgctgagattacaggcgtaagcccctgcacccggccctgtttttttttttttttttttttttacatcccggagtcacactggatatctgaatgtgcttaaaataaaattcacatctcattctggaagtgtttattaaatgctgtccctgcattcatgtgaacatcacagcccagcggttagatgtgcagactccaacgcctgactgcctgggtctgtcacttactagctgtatgaccttggatgggttacttaacatttctgggcactggtttctcattagtaaaatgaagaatgggcgcctgtagtcccagctacttgggagcctgaggcaggagaatcgctttaacccgggagacgaggttgcagtgagcctaggtcccgccattgcactccagcctgggccacagagcgaggctccatctcaaaaaataaaatttaaaaaaaaaaaattcagctttcacggagaattactactgcctggtgccatcagatcccaaatactggaggcattcccaatgttctgttcacaaactgtgcaatctgtgatagcccctcttgtgaatataatcaaagtgaaagatgccagtatacttattgctatgcttaaaagaactgcagatctatcatatccttttgaaaccaaaaaatgtggaagtctccctggctagatgctgtgtgtccacgtatcctgcaccaattgcttgaaagtcacatgacaacctttcttcctttagggaaggaagcaagcaaggtaggactctgtgtgttacagccagtgtgggtaactaaggactgagggaggtgtgggcacttgcatagctagtgccgccaataccataggagcgttgacactaaacggcacttctctattaagttgccctgctgtcttctaacgagtcattttgaaaaacggttgtccgtttttcaactacttgggtgagggcagcttcatgaaaaaagctcatcgtatgttaaagaaggtagggtttcaattgtgagctataaagccaccagaggagatttctcctatagaaggaaggtgtgtttcctgcttggacacctgaatttgcaacccatcctttcttttttcctttttccttttttttttttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaaggtaacagctggagcgagggaagggagggcttttctaagaccctgggaacgtccgtttggtccctacttccatcagtcaggagacgcggacaggtcgcaaaggaatgctgctcctcccttttttcttcacacacctcctcttgcctcttctcaacagattttctatgatgaaagaccactgggggccaggggaagagtcctggttctcctctctttaaatattctggatatctcaaagtacagtagagtgaaactgctcctacgttaagtcgagtttattttcgtttggttgatccacgcccaccactttgccctcagtttgggggctgatctcattcttaacatcttcctgtattctgacccagtttaaagaattgtatatctgttttctatttttgtaacagttgaaataactcataatttaaacacttggtgagttttgctcttttctgtcttgagtatgttatgaaacacggccatgtttttctatttaattattttttacttttccttattgtgatgatacattatagcgttccagctgagaatgtatttttgtgtataatcgcccatttcgcccatatttcgacagtagaatagggaagacaaccctattcttaaggtacccttagcaatcttcactcatttttgaagtcctcaatctcgttttactaatgaatagtgacccagagttacatggtaatcaatggctacattagttactatccattaattactattttgatttcttggcattttagtaagcaatgtttggatcaaaacagtttttaagtttcaatctaagtctgctccagggagataatgggctgttcttttgggtgagagctgctgctttgacaattgtatttcttataaataaatttaataaattagtattctggcttagtttttttttttaattgctaatttaacagatccttcatatttatttggtagaaatcgggaaagattgtttgatagaaagataatgcttatgttttgaatttctgtggggtctatttagatggaaggaagaatagactggggagctaccgaaatccattttaccgctttacgttccccatgccataaaggtgcatcagtgagacagctttggggatagaaatgaaagggcttctttatgtgtgggggaaagcatgggaccttgagggcagtcagaagcacagaagggctggataactatgggaaatgactggtcgctccttgtatcctagataggggaaaacggttggctgttccttagaccctaagccagagaatatgcatccctcaacctggatgtcttccaggtttaaggtggtgttcattttgttctcctgccaaatgtgctgttttctcattcttaatagcttcactctcagtttcctaaactgtaaatcttcgtgtccttgttttatgtcttttttcatctcctacttccagttggtcatgatatcttgtttatcctatgccagaattgtcctttgctttattactccttattctttagatccctataatctttcccagggactattcctctttcatgtcctgtcacccatttctccctaccccagtccattttctattgtattgtcagttactttctaaaaacaaacctgcgtaaaaatttcttgaccctgttacagaataaaatccaaacctcttagttttggactgagtctcactctgttgcgtaggctggatgcagtggcgcgatctcggctcgctgcaaccttcgcctcccgggttcaagcaattctcctgcctcagcctcccaagtagctgggattacaggcgtgtgccaccacacctggctaatttttgtatttttagtagagatggggtttcgccatgttggccaggctgatctcgaactcctgagaccgcaggtgatcctcctgccttggcctcccagagtgctgggattacaggcgtgagccaccgcacccgaccttcaatgtaccttttctagttgccataccagttgctgtacatgtgcacatatatatgcttgcttgtacgcacagcttctgtcgtgtgggattttgtcaggcacttacacaacttcaagcctctacatggaaagccctttcttctctatttcctccttcacccagaaaacaattctcctgtacaaccctgctcatatgtcaggtacttaagtacttggtgaaccattctgactcccacacaggttgagttgttgagttgaatgttggtgatctgtgttctaacagaactttgtggatctctccctgacagcatttaacatgttgagttataatttatctgttttcctgatgcccagcgtgaggactgaatttttttgctccttatattaccaaatatgtgacaccttccttttggcacatagtagatgctcaataaaaatggcacaagtgcgtgattagaaatctgcaaagttgcttaatgcctttattctttcccctttgtatttcaatcggacttgcttaacacctaatttattgattttgtaaatttttaaaaataggggtctggccaggtgtggttcatacctgtaatctcagcattttgggaggctaaagtgggaggatagcttaaagccaggagttgaggactagcctgggcaacatagggagatctcatctctacaaaaagtttttagctgggcatggctgcatgtgcctgtagtctcacctacttgggaggctgaaatgggaggtttgcttgagcccagtagttaaaggctccagtgagctgcgattgcaccactgaactccagcctgggtgacagagacgaccctgtctaaaaaaataaagggaatggagggtcagagtacagttcttttattcattgaacaagtatttattagtgtttaccctgtgtcagtaatgaaaaataaaacagttccaaaatagcactatgtggacaacttgaaagccatccatatttacaatatcagaaggttgcagttttacctaacactactgatttattcaaggttaggagcttgggcttttaaatcagagagacatgggttgaaattctgcttttgtgcattacaagttgtgggatttttggcaaattattagaaattaacctccaaaagcacagtttccttatatgttgaatagggataatcatacctattgtgaggttgagaggattaaatgaaatcatgagtgtaaaatgcctggaattgtgtctaccgaatcgtaaacattaatgaatggtaaatgtcatatttgcccttattgacaaagtcagaatatttttgtctgcataatatctcccctttgtacttaaaaaggccaagtttttcttgttgggggaggtgtggagtttgcatggacttgtaaaatccctctttaaaatagttgctgcttttaacaattaccttcctaaacaaattagattataacttgtcctcttcagagtagcaattaaacagtcctttcatagtttcaagcaagatgtacaaccaaccacagatgtaaccctacctggtgattttctaaacaagagtgtttgtcactgtaattactgcatgcttcttttgatttaaaccaagcttgtccaacctgtggtctgcaggccacatgtggcccaggatgggttttgaatgagacccaacacaaattcataaacgtgcttaaaatgttatgagtttttctggctgggcgcggtggctcacacctgtaatcccagccctttgggagcactttgaggagggcctcaggatcacctgaggtcaagagtttaaggccagcctggccaacatggtgaaacctcgtctctttactaaaaaatacaaaaattagccgggcatggtggcgcaggcctatagtcccagctactggggaggctgaggtgggagaatcacttgaacccaggaggcagaggttgcagcgagctgagattgtgccactacactccagcctgggcgacagagcgagactctgtctcaaaaaaaaaataaataaataaataaataaaaaatgaggttttttgcgatttttttttttttaaagctcattagcgattgttagtgtattttatgtatggcccaagacagttcttccagtatggcccagggaagccaaaagattggacactcctaataaactgtagtccagataagttatttttatattaaagagctgtgagtaatgaaaaaaatactagtacttagaaaaaaaatctaactctggatgatgattttcttttcttttcttttttttgagaccgagtcttgctctgtcgcccaggctggagtgcagtggcacgatcttggctcactgcagcttctgcctccccagttcaagcaatttctcctgcctcagcctcctaagtaggtgggattacagattataggcacctaccaccatgactggccagtttttttttttttgtatttttagtagagatggagttttgccatattggccagggttgtcttgaactcctgacctcaagtgatccacctgccttggcctcccaaagtgctgggattacaggcatgagccaccgagaccagccagatgatgattttctaacagcattagtggtgccatgttgacactgctgggctctcactctacttttaaatgaaaatgtacaaaaccaagggccatgcatggtgacttacacttgtaatcccagcactttgggaggctgagtgtggaggattccctaaggctaggagttcgagacctgcctgggcaacacagtgaaacctcatctctccaaaaaagtaaaaaaattaggtaggtgtggtcgcatgtgcctgtagttccaactacttggaaggctgaagcgagagagtttgaggctacagtgagccatgatcacaccactatactccagcctaggtggcagagtgaagtgagaccctttccaagaaaattaaaaaataaagatgaaaatgtagaaaaccagactgagctcattcccatttttaataaattgtgtctatgttactttaaataagtgttctcagtgtatttttcttcgtttataggtcacttattatttgatagtattgagagcagaagttagtgacagagcaggagcactgttgttatctcagacaaacagtgccactttaagttccagctccctttccttttttttttttggagacaagagtctcactctgtaacccaggctggagtgcagtagcacagtgtcggctcactgcaacctccacctcccaggttcaagcaattctcctgcctcagcctcctgagtagctgggattacaggcgtgtgccaccacacccggctaatttttgtatttttagtagagacgaggttttacctgttggccaggctggtctcaaactcccgatctcacgtgatccgcccaccttggcctcccaaagtgctgggattacaggcggtgagccaccgtacctgacctccagctccctttctagcctcatgcatttcaaggaagtcacttctcttctaactacaagcagccagaaaaagcagacagtaaaacacatacagagggagtgctcgggcacaaagggaggtgggggtaaagtctcttgggtaactgccaaacttcactctcatacagtgggccccagtaaagcagtgggccttagaaagcacattcctttcccttcaggtgcactaaaatagggaagctaaagcagactcggggggtatgcctgcagctctagaataaatggaacaaatacacaactctccctcccagataagcactacaaaaaaacacagaagcagtctaagcctctaataaattctcccaccctaaatccttaaaaactcttagtctggaaaagagtgtgcctctaacctaactcagccgaacacccctctcaggtttgttttctctaaaataaacctgtcttaactggcaagccaccctttgtgtttctctcctctttctttaattcttacagttagaaataaggcctaaagccccagttgagtaagcttcatctaaaattatagcagcattagcccacagagaaatagttttaatttctaaagcttaatttcccacaacaaaattctaatgaacatttctaaggggtaaaggtagacatcctaagatacagggcataggcaaaaagaatgacttttatgacaatgaagaacattagtgtcagtgaaaagttgttatggaaataaagcgatttgtttcttctgaatgctttcatatcagcctactattctgtgtaaactcagtgaaatatattttcttgaaaatacctatttattacttcatatggtattgattaaatattcaatatttgttatttctcttgtagcagaattacctgattctaggacaaaggaaattgaagccattcatgcaatcttgagatcagaggtaagaaaaatcaaagactacttagatttttcttttttgaagtcatgaaggttactcaaacattactttgatcctttctttttaaatgtactgcttagcactttttttctcttcttgtttaattttgattgttttttgagcttttatcaaccttctgtagatgaaaaatatatttacctgttactgcagtttgctattctttaatattcccatctctatttctgtataagtaggaaaactgccaaatgtagaaataatagtatcaataatttatcataatccagagtttactgtgttctaacagcatactaaattgcagtggcacatttatttaagaataattttttttttttttttttgaaacggggtctcactctgtcacccaggctggagtgcagtggcactatcttggctcactacaacctccacctcctgggttcaagcaattcttctgcctcagccccccgagtagctgggactacaggtgcacgctaccacacccagctaatttttgtatttttagtagagacagggtttcaccacattggccaggctggtctcaaactcctgacctcgtgattcacccgccttagcctcccaaagtgctgggattacaggcgtgagccaccacgcccagctaagtataatattaagaatgcaattctgtttaacctggagctttttaaacactaaaatgataataatatttggatacaaaaaagttaagaatataggaatagcagccaggcacagtggctcatgtctgtaatctgagcactttgggaagccgaggtgggtggatcacttgagatcaggagtttgagacaagcctggacaacatggtgaaaccccatctctaactaaaaatacaaaaaaattagctggatgtggtggtgcacacctgtaatcccagctactcaggaggctgaggcaggagacttgctggaaactgggaggcggaggttgcactgagccgagatcacgccattgcattccagcctgagtgacagagaaaaactccatccaaaaaaagaaaaaaaggatacaggaatagcaaattaattttaatgttttattcattattagggtctagattgggcgcagtggctcatgcctgtaatctcagcgctttgggaggtggaggtgggaggatggcttgaggccaggagtttgagaccggttacaaaaaataaagataaaaaaattagtcaaggtgtggtggtgggtgtctgtagtcccagctacttgtgaggctgaggtgggaggatcacctgatcttagggcccaggaagtcaaggctgcggtgagctgtgatcctgccactgtattccagcccgggcaacagagtgagaccttgtatcaaaaaaagaaaaagacattttaataatttaaatacagcaaatccaaatttttatttaatttttttctggttttgaaagcataaagactcaaaataagcaatgttctttgaattcagtgaactgctttttaacccttaattgtataacctggaatatctttatcttgtaaaatattgattccaaagttcagttacctctctaatagatttcaggttattattacttctagttcttttcgttgtggttgttgctttgagacatggtcttgcttttttgcccaggctggaatacagtggcacagtcatagctcactgcaaccttgaacttctgggctcaagtgatccttctgcttcagcctcttgagtagctggtaccacaggcatgcaacaccgcacccagctaatttttaaagatttttttgtaataggccaggcacggtggctcatgcctgtaatcccagcactttgggaggctgaggtgggcagatcacttgaggtcagcttggtcaacatggtgaaaccctgtctctactaaaaatacaaaaattagctggatatggtggtgggcgcctgtaatcccagctacttgggaggctgaggcaggagaatcacttgaacccgggatgtggaggttgcagtgagccaagatcgtaccattgcactccagcctaagcaagactccatctccaataaataagtaagtaagtaagtaaataaaaaaataaataaataaataaaattttttgtagagacgatgtcttgctctgttgcccaggctggtctcaaactcctggcttcaagcagtctttccaccttggcctctgaaagtgctgggattacaggcatgagccacatgcccagcctggttcttgattgtgtcattaaaagcaatacttttgaaaattttaatggctcatgattttattgaagagatgatggctgtcatctttgctctataatttcaaaagcatgtttattcttagatttataaatgccaattagaatgatcagtccactgagtttttttcatttctgtgtcatctgtttcctcccagttgcctttgtgtacacacctgctttcagccttctacatatgaacatatcaagtaaatgttggtgtacaaatatacatgatgaaagaatactgtcacatggccaggcatggtggctcacgcctgtaatcccagcactttgggaggccgaggtgggtggatcacctgagttcgagaccagcctgaccaacatggagaaaccctgtctctactaaaaatacaaaattcgctgggcgtggtggcacatgcctgtaatcccagctacttgggaggctgaggcaggagaatcacttgaacctgggaggtagaggttgcggtgagccaagatcccaccattgcactccagcctgggcaacaagagcgagactctcaaaaaaaataaaaaataaaaataaaaaaagaatactgtcatgtatctgcttagcaaaatgaaatggtttaagtccttgtcacaaaataatgcagagtgaagtattttcctgttgaatgactaattgatctgaaagccatatttcttttttgttcttaaaaatatattattcactcatcaattcttttttttttttttttttttttgagacggagtctcgctctgtcgcccaggctggagtgcagagtgcagtggcgggatctaggctcactgcaagctccgcctcccgggttcacgccattctcctgcctcagcctcccaagtagctgggactacaggcgcccgccactacgcccggctaatattttgtatttttagtagagacggggtttcaccgttttagccgggatggtctcgatctcctgacctcgtgatccgcccgcctcggcctcccaaagtgctgggattacaggcgtgagccaccgcgcccggcccactcatcaattcttgacttttagaaaattcttccaggatattgccatctgaagatttgtgtaagatttcacttctacagtcagtttcaccataaccattagactctaggatgctgctttctgtctctgcattaatcttctaagttgtctaataattgtgaatgttttcctttgtcagttttcttctcttcatcaaataattaaaaattctgagtttttaactgtgttcgatgaaagagaaaaaacaaaactacaaaaagtggtgtctgtagacagctgttttcttttaaaaagatgatataggccaggcatggtggctcacgcctgtaatccatgattacaggctcatgcctgtaaactttgggaggctgaagtgggcggatcatgaggtcaggagttcgagaccagcctgaccgacatggtgaaaccccatctctacaaaaaatacaaaaattagccgggtgtggtagcacgtgcctgtaatcccagctattcaggaggctgaggcaggagaattgcttgaacctgggaggcagaggttgcagtgagccgagattgtgccagtaaactccagcctgggtgacagagtgagactccatctcaaaaaaaaaaaaaaaaaaaaaaaaaaaaaaaaataatactttgggcaatgcagtcagaaaactggttattttaccattgcatcattctcctaggtgatttcataagttttccgttttcttgttattgtcatttttaaaatagttgggaataattttttaaatgattttttaaaattcccatgatagtaaaagagccaaatgttttaagatacagaaaatacaagttgattttgctcccatgatttttcttagatttataaaaagatccacggtaccctatggtaattgtaagatagaatgttttattctatttttgaaaataggtaaattttctctttgttggtagacccctcagaaagaataaaaatcataaatatcaagttttacgaatagttaggactgcctaaaaaagaaattaagttgatttcagtggaccctaatggtataaccaaagattaagcaggacggaatattttaagatgtgagtgtcctatggatttcaatagcagaaatgtagtctgactttagaaggactgcagctagaactggaggccatcaggagtctgtctctcttttcatttgtactctcttttcttctttctatgcatttattcttttctcctttcagaccagccccctctgttcaatattccatataatagaaaatattatctctggcaactcttttcatattttatgggttcggccacatgaagagaaactgtccttcatttgctctctcagcctttctttttgttttgagacagggtcttgctctgtcacccaagttggagtgcagtggtgtgatcatggctcccctgcagccttgacctctcaggttcaagcagtcttccctcctcagcctcctgagtagctgggactatgggtgcaagccaacatgcccagctaattttgtatttgtattttttgttccttatgttgcccaggctggtcttgaactcctgggctcaagtgatcctcctgcctcagcctcccaaagtgctgagattacaggcatgagccaccacgcctagccctttctcaatctttctgactctcatatggctatggagatgagggcagacaaccaagtagatattgaccatattcaaagtttcacagttctatttattaatcagagttaaataaataaccttaggtatttttgtgtgaaaaaaaacctgaagtgaacttttataaccagggtttgacttcagtatattatatcgctgagttatgtatggtgtttttcatataaacagcttacagaaagtcatgcaaaagcagccagtagaatagaaggtaatcagctgttgggaccattggtcctgtttcttactactagttcttcaggataattaaggtctgtgttagatttctggggatagagtcccaaactaggatttgtggatgctgtaattattcctttgattattccattggttttctctgggaatttatgtaatcttcctggatcattattttcacatctgttgacatcagaagttcctagaatctaagaagaaaacaaatgacatccccaaagtgaaaaagtcttcaccttttagcaagagctttctttctcactatcagtcttctttttctcattcattgttgttaaaccgtgtttgtgggtatattagtagaatgcttagtaaattgttatctgcaattatttgtaaattcttttttgtagagagttttagtgtccatttcttttgccccattatgttctttttgttgttgttgttagaacaactcagcaaaacaaaattcctgtttattgttggacaacattgtctcacacatacatcagacaggccaaaaaaaataaacagcaacttcatagacaaaaaaggaaaaaaaagaaaccttttatttttggcctttttaaccatctcatacaaaccaactacttatagtacagctaagtacatacacaaaaaagttattggaatgctcggaataagattgtttttctgttgtcgtttttgctttttttacaaggttttttttctgctttgagattataatgaatatggtcacaccacaagtaaagtcagaagtaggacaaagaacactccgaaggctggtttggtcatccgagatcattaaaaatggctgaccctaacaatatgtacaaaaatataaaatgaaaataaaaaatacaaatttcctttttaaaatacttttaagaaaaaaagcagggccttggaagttttggttctttttcctcccctgttgcaaattctcatggtttgggttgcgtggtggagagcgcgtgtcatctgctggtggcactgcccacggtgggcgggcgggcctctctacttgaaggtgaccacgtttagattctgagaggggaagtggagggtgaataggtcgcggcggccttttttttagtttaacttttccttttttgctgtctagtcatcctcgtcggtcttctgcttcttggtatcaacatcgtcatcctcatcatcttcagctgcccacttgccggtagctgactcagcttcctcatcttcatctccatccttcttcctcaccctcaccttcttcttcctcctcctcttcctccccaccttcttcctgttcttcatctacttcattgtcagcctcttgctccccattttcctcgtcagcaggggcgtctcttccattttccgcctcttccacaacttccttcttctcctttaagtccttggtggtgatttcggagctggtgtccacggctgcgtctgacatggtagggcacgccagtgatccgatgcaggggattaaaaagaaagcgagagttcagggactctggcgataaagctgccggctgcggcgagcaaggaggcggacgaggaacaatgcaaagatggcttttcagagcagccagtggggcgccccattatgttcttattatttcattcaaataaggaatgataataggttaagataatttaatatttaggtacatacaatttgagtaatttttttcatgtttttcaacatcttaaaagacagtgtgtaatgtctaggttcattgaattaggctattttgtgtacttttaacttttttcaaacagttctagtagtggttttcaaattggattttttccgaggtccttcagggaccctgaaagacaagcaaattatgtgagattttagcctcctccctgtacttcaaccagaaagatttctttttaaaaaaagttctgtttggggaagaaaacaaaagttcaaacatgtaatccatttatttactagacatgtattgactgctgtgtgctagaactgggtatacaaagatggggaaacattgattcgtggccttttcttagcagaaaatcaatctgagcaaaatgttaatatttcactgtttggtttagaattatgcatattctgtctgtataaacatggtcagtgctttttttttttttttttgagacggagtctcgctctgtcaccaggctggaatgcaatggcatgatctcggctcactgcaacctccgcctcccgggttcaagcaattcccctgcctcagcctcgcgagtagctgggattacgggcacacgccaccacgcccgtctaatttttttttgtattttagtagagatggggtttccctatgttggccaggatggtctcgatctcctgacctcatgatctgccttggcctcccaaagtgctgggattacaggcgtgagccacagtgcccggctggtcagtgcatttttaactttaatttaaaagcatattttaaagtccagaattctgtccgagaccttttatatttgacatttttggggggggaaagcagtacgtttttcataatgctgtgcacataactaattacatgttttacttgcagtctttttgttgaaaatactttttttttctagaatgaaaggcttaagaaactttgtactgatctagaagagaaacatgaagcatcagagattcaaataaagcagcaatctacaagttaccgaaatcaacttcaacaaaaagaggtaaatgttatcacagttacttcatatgtacttcactgtaatgtatttaggtatgtttttagagttagaatataaatcgaggtatattcagatctgtaaaaatatgaaaaggtgatgaatttaatgattttcgactcagtttgatatcccttatttaataagaactttgtaaggtaatgtaaactttattaagtttacatatataaaccaacctgtgtgaagtataatttttttctttccaaagaagaagaaaaagtttttgtataaaatatctttagggatctgttgcttataatttctgattttatgaagcctaatatttgttgtattggcatgtgcttgattttccatggaaaaactattaaatatatgataatttacatataattgctttataaatgtttttgggttttttagtttgaaatggctgctttggaattgatttatctttgctttacagtgctggtagtagatattatataatttaatgttactctgaatccttaaaatacagtctgtgtcctcatgtgtcatgctgttactgaattctctttagtgtttagtacctaagtggcccccaataaatacttacattgaatggaaccatttcctgttatattgtccagatcatttggatgtttttcagtttgttgactaagtgttcatttctaccataactttatatttgggtttttaaaatttaggtgtcatgctttctaattcctatgctttctagttcctttagtgacatgctaaggtgaaagataaaagtatagcacgttaaagatatacataggttttgaaagtagtgcttaaatttccaatttgttgggaagtgataatttcataaaatacaatacaaaatgaattactataaaaataaaatgaatactaaaaaaggcaaagttgcaagttcaaataatttttttttttttttttgagacagagtcttgctctgtcgcccaggctgaagtgcagtggtgcaatctcggctcactgcaacctctgcatcccggttcaagcaattctcgtgccgcctgagtagctgggattacaggcatgcactaccacgcctggctaatttttgaatttttattagagatggggtttcaccacgttggccaggctggtcttgaactcctgacctcaggtgatctgcccgccttggcctcccaaagtgttgggattacaggcgtgagccaccgtgcctgtcctcaagttcaacttaaagttacaaggctactttttttttttcttgattccccatctctactaataatacaaaaattagccggacgtggtggcgtatgcctatagtctcagctacttgggaggctgagacaggagaattgcttgaacctgggaggcggtggttgtagtgagctgagatcacgccactgcattctagcctgggtcacagaacgagactccgtctcaaaaaaaaaaaaaaaagttcagcagatataaaattactactaaattgctttaaaagtcttaaaccttacttttcacattgctatacttgctctggactggtagtgagcattcaactgcattcgtctgtggaccacattttgagtagcattgagttataaacattatgatagaacagtagttcctcctacccaggggtttacagctgtgtcattatgacactttaaaagcatatacatgtttacaccacctaggagattctaacttagtgtactggaaagaggccctggtgcaggttgagcattcctaccaaaattcgaaatgctccaaaatccaaaactttgagtgccagtttgatgccacaagtagaaaattccacaaataagtactgaacacaagctttgttttatgcacaaaattgttaaaagcattttataaaattactttcacacgtacctgtgggtataaggtgtatatgaaacataaatgaattttgtgtttagacatgggtcccatccccaagatatctcattacatttatgagaatgttctcaaattggaaaatacctgaaatgtgaaacccttctagtcccaagcattcggataaggatactcaacctgtattggtcattttcaaaagctccacaggttattctgatgcctacctcacagttgaaaacactggtggggaaaattttggtattttatgttctacttaactatcgatattagagggcacattaagcattcaggtttggaaatatctgttattacagcttgcacttgtataactacaagttgatataaatatcatataatgatagctttttaaatatagctacatttgaaaaagatgtggattttagtactttttacgaggatgaaatatatgattatatagatctgttatttcctgaatctatgtgcggccctcattgtgatgttcatattctccaagatggaatttatctcatgtcatttgtgggaaaatgaatgaaatttgtacagtactataaatttccatttgagaaggggctccaatatgaaaaacttgtttgttatgacatacaacataaatgtgtttggtttttgtctacttgcttaactttatgcatatagaaatactgttacttgttggctgtcttcctaatatcaaattttcctcagttgtggcagtgtcttctggactactctactttatagaaaacttttttcagttctgtctatattgtttgattttgtgttttgaataatcttttacaagaatggatgtggcattttggtaggtcctgtgtttataatttcttttgcgctatgacttacccgcctttagtcaaaactgctggtaatttcagaacttcagaactgttctcttcctaaataggtcagattttcgctggctcctctttgccaaatctaaagctaagaccactttcagtatattatttctttttaagattcatgggctaataaccatgggctcactgtttcactgttatcttatctaaaaagattggatttataaatcaaagcattcttccagctgtgttgtgcaggtcaatacaaagttacctcagattcatggtgcattttaagcctacatccagccataatcagttacacaacacccttgtaacaggagatattctaagaaaatttccagtgcatagacggacacagctttcattttctcatcatttaagatttggtaatcacaaacagaaccctaagaaattgcctatactactccatgcagagaagatagcaaacccatgtttaactgagaaattcattgctttagttaacatacaaaattctgatatttctactatttgtaacattatttatgctttaattgtgagtgtgttttaaataaaaatgttatggttagaatgttatataagacttagattcagttgatagaggaccatcattggataatcttagacaaattattgtattgtgtcttttaatacaaatctataaaaagtcaatatgattgttttaaagtaccttctctaaaacttggattataaatatataggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcaggtagataaaaattttttagagtttttgaaaactttgagtaaaattactggtgtaatataaaaaactgtatgtagagcttttgatatcagaaagaaccctggactaggaaatagaaaaggtgtattctaattccgtcagtgactttctttctttttttttttttttttgagacagaatcttgctctgtctcccatgctagagtgtagtagcgtgatcttggctcactgcagcctcggcctcctgggttccagtgattctcctgcctcagcctcctgagtagctgggattataggcacacgccactatgcctagtttttgtatctttagtagagatggggtttcaccattttggccaggctagtctcgaactcctgaccttaggtgatctgcccacctcggcctcccaaagtgttgggataacaagtgtgagccactgcgcctggcctctgccagtgactttctttctttctttttttttttttttttgagacagagtcttactctgtcaccgaggctggaatgcagtggcacagtattggctcactgcaacctccgcctcccgggttcaaatgattctcccgtctcaacctcccaagtagctgggattataggtgcgtgccaccatgcctggctaatttttgtatttttagtagagatggggtttcactatgttggccaggctggtctcaaactcctaacctcgtgatctgcccgccttggcctcccaaagtgctgggattacaggcatgagccactgcgcctggcctctctgccaatgactttctaagtgattttggtcctgtcatctttctctcctagtctgagtttccctttctgtacactatttggaaaaaattttcaaaaaaaagcaacagatccttttttttttttttaataaaacatgagaggaaaaaaattgagttgctgtggttgaaccaagaaccttctcttctggagtccctgagactcctctggtgtaaacaccaggactccgaggcaccatgtttgaaaccgcttgcttagatgttgtctgaggtttctgctagctctagttacatgtaaaatgaaaatctggtaattgatattataaaatatgataaaccattttgtgttgtttctcatgcactagaaattaatattttgctatttggggctgtaaactttcttccaaggagcccttttttgtcttatatatcagattttatacaggatgaatatctcttatccgaaatgcttgagactagaagtgtttcagattttggattttggaatcttttcttgttctttcttttctttttttttttgagagagagtctcagtctgttgcccaaactggagtgcagtggcaccatctcagctcactgcaacctctgccacccgggttcaagcaattctcctgcctcagccttctgagtagctgggattacaggcgcccgccaccacaccgggctaatgtttttttgtacttttagtagagatggggtttcaccatgttacccaggctggtctcaaactcttgacctcaggccgcccaaagtgttgggattacagacatgagccacttcatccggccagattttggaatattttcataaacataatgagatatcttgaggatgggacccaggtctaaacatggaattcatttatgttacatataaactttatacccataggtacttgtgaaggtaattttatacactattttaagtaatattatataacttgtgtgtgaaccaaaatttgcgttaaatatttatgtgtggaattttccacttgtggcatcatgttggcactcaaatgtttcagattttggagcatttcagattttggatttttgaattagggattctcaacctgtatactatggaaattgtagacatgagacctggagtaaactggaacactgtttatttggatttaatttcatcaatgtaaaaaaaaattacatgagtaaagagattattttttgtgtttttatgaatgtaatctagttatgtaaaggagaaatcttcccacttaaaattatctccttctttcacaagttgctagacattctcagtacccaaaataagctttagagaggatgatctgtttgtccatcttatctccaaaaagcagtaaactttctatgtataagaaatgacctggagaacttggcagtattgtagatcttctgtggtaccttcagggatatcaatttgttagccagttttagggccttaaactgcatttaaacaaatagccctggtgattctgataacctaaggaacacattttaagaaacattgttagagtaagatttcatagggaagagaatggtttttggtgtgttcatttcagcatatcttgaatgcctactccatgacagacctgtactagactataaagttgaaaaaggcataattgggaccgttcagaggacttaattttctagcaagacgtaataaaaattaatatttgcattacattttatgtttccatatgtattatcccaatatattattatgttaataattatgagatagatgtattacctctattttataaataaggaaactgaaagttttttttttgttttttttttttttttttgagatggagtcttgctctgtctaccaggctggagtgcagtggtgggatctcggctcactgcaacctctgcctcccaggttcaagcaattctcctgcctcagccacccaagtagctgggactacgggcacccgccaccactcccagctaattttttttttgtatttttaatagtgacggggtttcacctgttggccaggatggtcttgatctcttgcccttgtgatccagcggccttgcctcccaaagtgttgggattataggcatgagccactgtgcccagccctaggaaactaaaagtttaagtcatataatccattgccacagtggttaagttatgattcaaacacacgtgttttgactaaatcctgtattttttctattatactttattctttctttcagtcctagagtagcttttggttcattaaaatgctacatagtaatattaataaagataaatgaacaacatacagctttgaatgagaagaatccaaaagttgttttatttatttattaaaccaaagattattctctattgggtagagatcttctgggtaaaatcatttgattttgccaggcatggtggttcatgtctaatcccagcactttgggaggccaaggcaggaggattacttgcagccaggagctcgagaccagcctgggcaacatagtgagatcccatctctacaaaaaaaaaattagctaagcatgctggcatgtgcttgtagtcccagctacttggaaggctgaggtgggaggattgcctgaacccaggaggtggaggctgcagtgagccatgatcacaccactgcattccagcctgagtgacagagaaagaccctgtctcaaaaaaaaaaaaaaagaaaggaaaaagaaatttccttttagaaagctgctcaattatctttacccttacattttgtcaagctaagtaaaatattctataaatttttctaccttaactttagttattttgtaaaactgttgtcccccccattagttaatacattcttaaatatgatatcttttatttattgtgtattattcactattagactaggttctttaaaaggtccatggcattctttagtcggaatctgtgaaaatccccctttttacaaaagtattcttgtaatgaagttagtttgtgactttctgttgacaagaaaatcagtataattatttactaattctctttttctgatctagacttccaaagcacaaggaacagataactctgatcaaagtgaaatatgtaaactacaaaatatcattaaggtaagtcaaattgttgattgatgatgggagttatacatctaaatctgcttattaaaagcataggcctgaattagtaaaagtctcagttataaaagtcattatcattatatagattatggtacttctttttcttttagagataggatctcactgtgttgccctggctggagtgcagtggcatgatcaggtcactgcagcctcatactcctgggttcaggtgatcctcctgcctcagcttcccatgtaactgggactacaggcacacatgccaccatgcctggctaattttttctgattttttttgtatagatggggtttgctaatggtgcccaggctggtctggaacttctagcctcaagccatcctcctgcttcagcctcccacaacgctgggattccaggcatgagccaacgcgcctggtccatttaaaaatatttttttttaatattctttattatttatgtaaagtatataaaaatctctgtctttccagaatcatttggttttgaacatttattacggagcttatctttcgtaagtctctatactctattgtatcttgtaaaaccgtctttattaaaacctaattgcagggttgctgaagtttcaaggtttagagttaaaggatatggacaaaataaaatactaatatcatgcattggaaatacttattttaccttagcggtagaatttcgctagtttgtgtcaattattatttctttaaagaaaagtcttagttgcatatattattgtggcagtgaattatttttagtgttaaaattattgtcagatatagaatttttagttttgggttcattattattacaatactagagtggatagaatccggatcagacctgtgtttgaatcctggctgtattatttacatgctatgctaatctcgggcaagttacttctgttttattatcaatggagaccatgataatacctatcttgtaggattgttttgaggtttaaatgtaaagctcttagcccagtggtggcacataagtaagaagttaatttatagattaggatctttttttttcttttttccataagagcatcaatttttctgtagattaggattcttggttacaagcaacaaaaaccatctctggccaagtaaagcaaaagaggatttactggaagaacccagggtagtccatccgcaggattgaaggaggagttgaatgttttggcctcaggttggataggagtgggaagagtgttaggaatctgggtggcgggacccagtggacagactcttgagagggcacctgtcctggtgcttcccgtcaaaccagtttccctagtcgatggactcagctcaagatccaggttcctgcgagagacacagtgggctcaacttgggtaggaaggcgccaggttgacagtttgggagtcccaataagactggtgaaaggaaaggctgagtgagaggatggaagtagtggaacagcaggtacagattggtcagaggggtgacactggtattggcagaaagtgtcattaggaaaaggagaagttcatggtcacagatattaaggaaaagacatttttacttatcgtttgttttagccttttcttgctgatgttccctcattagaagtagaaaaactgtttttgagacctaagaaaggaaagggtgaagttgttcagaatagtcctaattttgggtctgtgtttaaattcttttcagccttaacatgttctgagaattctttttaataatgcacacttttggacaacagttaaatatatagcttacataaatttattgattataaatgtgaataactttgtttttattttttaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggttattagttttatttctttattattattattttttttgagatggagtctccatctgttgcccaggctggagtgcactggcgcgatctcggctcactgcaacctccgccccccgggttcaagcgattctcctgcatcagcctcccaagtagctggattacaggtgcctgccaccatgcccagctaatttttgtatttttagtagcaatagggtttcgccatattggccaggctggtcccaaactcgtgatctcgggtggtccacccacctcggcctcccaaagtgctaggattacaggcatgagccactgcacctggccagttgatagttttattaatttaacatattagatgacataactaaatgatagacctagcattctaagaccaggacagtgctgtaaacttgccctaagttataaggaagtgtaaatgactagttctgcttatctgccagaaatttgcagtggcacctctgcttttaagattctgtggccgggagtggtggcttatggctataaccccagcattttgggaggccaaggtgtgtggatcacttgaggccaggagtttgagaccagcctggccaacatggcgaaatcccgtctctactaaaaatacaaaaattagctggacgtggtggtgctcgcctgtggtcccagctactcaggaggctgaggtgggaggatcacttgagcccaggaggcagaggttgcagtgagccgagatggcaccactgccctccagcctgggcaacagagtgagactccatctcaaaaaaaaaaaaaaaattctgtgaaaatggaaatgtcctttttacctttgtggtaaatagttataatttatagatttctttgcattgtttggtgatgatactttggtaataaatgattagagatattatcactttctttcaaactaagatacataggcctttatgtagttgattcaaatattttcccccaacttatttattttaaaacacttagtttattatagtaatttaacttttaagctttccaaattctgaactgtcttatatctcttagttgtatatagcaaaccgtttatttcttggtacttgacatttgatgtcattgttttgtgtttatgttctaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctggtatacagtctttggaacttatttcagattgctgtttcattgcatagtagttgtttttagagacagatgcttcactaactgaatacttagtggaaatggcatattcctggaaatgactgtgtgtcatttgggtagaattgtgtggtttggattcagtgtaagagttaatagattgcaaataggaatttcctattaaaaaggattaggtattgctatactttctgtaactcatcacagcccacatcctccagttagggaatacagcctttcttcttcaaagtcagttgttacctgtttgaaacgatctcctatatccaagcaaagccctgagtgcttagagccataggtcttccaccattttctatgctcatgatgatatttagttactgtaccagtattctgtgttacagaaaattagtactaaatgaaataggccaaacaccagtaaataaaataaattttaaagtaattgtacttacgttttaaaaaataagtttacttatttaaaaaataaatttacttacataagactaatacatttacttacttatcatattgggtgatccagatgagtttatgtgcttaaaagacaaacccactgccttagtccttcctcttttttctattccattgacacagaattacttcagccagtcataattgctttttgcctatgttaactatggcagctctctgaatggagcagaatagcgtagtggttaaggacatgactgggttggaatcgagctctatcactaattagctgaccttggacaggttaacatctctatgcattggttatttcatctatagggttgggataataatggtatcttccttgtagttttagtaatgaggattatatgagttactttctgccgctctttaggatagtgtctagccaatagtaaatgttgaagagttagctttttttttgtttgtttttttgagacagagtctcgctctgtagctcagactggagtgcagtggcacgatctcggttcactgcaacctccacctcccgggttcaagtgatgctcctccctcagcctcccaagtagctgggactacaagcatgtgtcaccacgcccagctaatttttgtatttttagtagagacagggtttcaccatgttggccaggatgatctcgatctcttgacctcatgatctgcccaccttggccacccaaagtgctgggattacaggcgtgagccaccgcccccagctgaagagttagcttttaaaattctctgttctccatgattccttcaatctatttttttcattctgcagccagaataatttgtcagaaatgcaaagcaggttactcccctgcatttagtactttatagctgcctgtgaacttcgggatgatgtttaaatttcttagttagacatgataatgtctctcatgatctagttcctgcctatctcttcagtttcaactattcccatgctcctgacattctaaacttgaaccatattgaattttctatagctccttaaagcagcaatgttacctcttcactctgttacccttgcattttctgctttctctgtgtggagtgtctctatggctcttttagccgactctcagtatattgattcagtgcaggtattaacctccactgagaagtacctagcactgccacttcttggccccatttgctcctcctaatctagattaggtgtttaccctgtttgttctcatagcacctcgtgcttgctctgtcatactatgttataatcctgtgcttactagtttttcttcctctctgaattgtaagctcttcgagagcaagggctaaattttaccagctttttgtctagcacctggcctcatagtaaatgctaaatatttcctgagtgaatgttgaatcaatgatttcagctgtgtttttttgtgtaccctcttctttttatagatctatctataataccaaattgaatggtctttttctcagcattcatatctaaatcacgttagataattgagagattatggtattgtggtggtttaaatatacataataaaatactacttttaaattgttttcctccaatcttaaaccatgtactatttcctgcttctcaaatgaatcaattcattttgaaacctggttgtcattagcatttttatcaaggcaataacttgtgactcatctacaatacaatttcaattttttcttatgcttatccatagacttggattttaatgtggtttttaactggcatttacattatgatttatttgatatgacaaaacaggaatacaaatatatgtttcactcagaactgttactgcttgccagtggtgcttatatacactttaattgggttgcatttctgagtttaatattgaagataataagttactctaaataattttaatgtcaagttcatttgctgtttttacagatgccgaaaatgaaataatgagattgagtagtttaaaccaggtaaattaattttgacaaatgttatgtgcatagagacagtggaagcagatcctataccaagtgagaaatgagttttaattttccttaagagattcaaagagttgtttctttttctaataattagaagttattttgtaaatatatttttatatttttccaagcataataaggaagtcttctgtaagagtgtcgaaaatgcatgactggtttcattcgttttagacacttttataagtgttgcattcttttttttttttttttttttttttttgagacggagtcttgctctgtcacccaggctggagtcgcgatctcggctctccgcaacctccacctcccaggttcaagcgattctcctgcctcagcctcccgagtagctgggatgataggagcgtgccaccacacccggctaattttttgtatttttagtagagacggggtttcactgtgttagccaggatggtcttgatttcctgaccttgtgatctgcctgcctcagcctcccaaagtgctgggattaacaggcatgagccaccgtgtctggccaagtattgcattcttataattactacatatcattaaagaaatactgaatagaaacacacaattgtatagattgccagcttttttataaactggaaatttcttgttacctgaaaacactgctttaacatttttgtaggataacagtcttgctgaagacaatctgaaacttaaaatgcgtatcgaagttttagaaaaagagaagtcattactgagtcaagaaaaggtgggtgctgtaaaaatgggggcagaattaaaatggtatgtgtaacaggtcacagccaagggccagttgatatccaaatggaatgttgagtaattgagctcaagtccttagaataaagctgatctcactgatgcttttcaggctaggtggaagtacctgggtaaagttcagagtataagtggctggcttgagttcgtatttagaaataagctagtaggcacacagaatcaagcagaaaagataggtggaggtcctgttttggtttctgatgatgtcctgacagcaggaacatacacaggtaggtcaggaggtctggagtagcatactgtaataactgtatatgctgcttgtgtgcttcagaatgtgtccattttggtggacagtactttcttagtggtgaggcataaagagcaacagtttcagtggtagaaagaagttctatttttttttttaatgagatggagtttcgctcttgttgcccaggctgtagtgcagtggcgcaatctcgggtcaccgcaacctccgcctcccgggttcaagcgattctcctgcctcaacctcctgagttgctgggattacaggcgccagccaccacacccagctaattttgtatttttagtggagacggggtttctccatgttggtcagggtggtctcaaactcccgacctcaggtgatctgcccacctcggcctcccaaagtgttgagattataggcgtgagccaccacgcctggtgaaagaaggtctttataggggtacagagcaacagtttcagtggtagaaagaagggctttattgtatgtattcatagcaaggaaggaataagattctgaaagggaaaggtatttagaagtatttttatgtttgaaccactttggggaaatttcttggctaaggcaggtgcttaaatataggagagttgtaagctagtattattaagttaaaggccagtgtcttaatttaaattcctaattttaaaaagtgatgcatattttctgatatatgtgttcagaaaacatacatactgaaaaccttcggatagtacaagtagagtatcttttgtacctctgtggcttggcctctttcccagaggcagtctctgttaccaatttctagtgtttctttctggactatgtctatgcatgtatgattgtatgtatcagtagctttaaaaaatacaaatgtcagcatattataaatatcctttttacataccatatttccaacatctttccacattagtatatatgcagtgtttctcaaagggactgctattggcatttaagcaggaaaattcttagttgtgggcactacactgtgtattgtgggattcttgctgccactctttctacccactatgtgccagcagtatctcccagtcgttttaaaaattactatattatatatattttatctttcctgtttttgctcccattgtattctgctctttacctgactgacctagtcgtttgtagtttgcagaactctctgcacttacctggcagggcctgtaaccttttcatgatgtgtttggtttctgtagcttgtcctgatagctgtttctcctttcttttgatgttaaagtagtccattgtaactcttccttgagttgtgtctgcttactgattaagaataccaaaagtgcctatgagggccgagtgtggtggctcacgctgtaatctcagcactttgggaggccaaggtgggatgattgctcaaggccaggagttcgagaccagcctgggcaacatagtgagacaccatatctacaaaaaaacactaaataatttttttaaaaagtacctatgaggctgtgtgtgcttttaagatctacctaaagaaaatgtctgtgattctcctaatttgaacagataactttagaaagacttaagagaatgctgtttccatctttcagctgtagttagaataaatttttgaattagaaggaaataagaattgtgatacagatactctagtatagcttttatcggatctctgttttttcaaccaactctccatagcaatgttgagtttcttttataaggtttatattaggctgtttctttgaaggaatttgagattcttatttttttaattttattttttagagagagagagtcttgctgtattgcccaggttagagtgctgtggctgatcatggcatgatcatagtgcactacagccttgaactccttggctcaagtaatccttctgcctcagccacctaagtagcctcctgggactatagataaatgccatcatgcctggttcaatactctatttaaagtagattccatatgggtttgatttttaaaaatctgtcaatgaaagaaggctttaatatatagtttattacaaacatcataactagagactgaaataatgttgaagcatagagaactgtcccacttctgagattttggagaaagcattaaataccaggtagtagactataaaatgtatatatactatctttaggaatgtcaggtgtgacagaggggaacctagtctggttaaaaggtaaaggaaggaaggaggattctttctagggtcaagaaaaagttccatgttctaacagaagcaaaagtaataagggaaattcctttagtaagagaaaagaaaccttttattttctaattagagaggctaaacatttgggtgaaggagtgttgattttttatatttttatttagtctgaggctgttgatgactggatgttagagaatggaagtgaggaaggcagaaagacttgcggacattttggaaagtatgtatgtatggtaggtggggccaggggatggataaagggtagccacggtggagcaggataggagaggctctcaaatgggaacgttttttataaagaagaacttggtgctagaggacaaacttacagtcgctgcatctgtctagggttatagaaatgttttgcttgaagctacaagtaaaattgcacatgaatgaaggatgtggtttgttgaatttcacatacaattattgaggtattgttcaatattatttccaatatagagcacttaaatagaatcccaagttttgcttctatgtatgtttttaatcttttggtgtctccaattgaaagtatgtgttgcttttttccttttatcatttcaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaaggtaacactgtattaaatacagtaaggcagcacattctactaagtaaactaaacacagaaatggtgggtgtgatttaattaatattttagttcatagagattgacaaacctttttggtaaagtgctagatagtaaatatcattggccttgtaggccatattgtctcagtctactcaactctgttgttgtgataccaacaaatgagtgtgaccatgtttcaacaaaattttatttacaaaacaggcagcatccctgagttggccaatggctatagttcgttgactcttactctagtgtagagttaaaaataaacaacatgccgggcgcagtggctcatgcctgtcatcctagcactttgggaggcagagacgggtggatcacgaggtcaggagttcaagaccagcctggtcaagatggtgaaaccccgtctctactaaaaatacaaaaaattagccggccgtggtggcaggtgcctgtaatcccagctactcgggaggctgaggcagagaattgcttgaacccaggaggcagaggttacagtgagccgagatcatgccactgcactccagcctgggcaacagagcgactctgtctcaaaaaaaaaaaaaatactatttaccatctttggttttaaattcttatccctaaaatgctttaagaaatgacaagatggggccaggcacagtggctcatgcctgtaatcccaacactttgggaggctgaggcaggcagatcacccgaggttggaagtttgagaccagcctgaccaacatggagaaaccccatctctactaaaaatacaaaattagccgggtgtggtggcgcatgcctgtaatcccagctactcgggaggttgaggcaggagaattgcttgaacctgggaggttcaagaggtggaggcggaggttgcggtgagccgagattgcgccgagccgagattgtgccattgcactccagcctgggcaacaagagcgaaactccgtctcaaaaaacaaaaaagacaagatgggtttgctgtaaaataataataagtaattttgtagtgggtgtttttgatagaaaaacaatgtttttaagaaggattagaaatatttgaggattattttctattatgtatgagattttataaaattttctttgagtactaaaatgagaacatgttgtaaagtcaccatgcaaatttttctttcagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacaggtgtgttctggatggagtattgtagaaggaagttgggggtggaggagactttttttaatgttatttcatttatattgtctttgaaggggactgtgcatttgttcatttagaaatatttatttcaaggtgtgattcattctaagtaaattttcctcagagacatctggaagttctccctcaaattgttagatatttccaaatgcttttggtagtaaattaattttttacagattgctaagtagtacttaatatttttctttaggaaacagatgtgtctcatgagagaattttgaagttacttcaatttaatcaaattttaggtattacagtagctgttaacattttagagattcttatatataaggaaagcactgtaaaatacacatatgtctttaaccatctgcagtaagaaatacatttcacgttgtgacacagtaagagtatgtatgtgtgtgtgcgtgtgtgtctaactgaaaagtttgaggaaccagaaattgctcttattacgtgtgatactctgtttgaaaaagaatgtgctggctgggcgcggtggctcatgcctgtaatctcagcagtttgggaggccaaggtgggtggatcacctgaggtcaggagtttgagaccagcctgaccaacatagtgaaaccccgactctactaaaaaaaatacaaaaaattagccaggcatggtggtgggtgcctgtaatcctagctacttgggaggctgaggcaggagaatcatttgaacccaggaggcagaggttgcagtgagccgagatcatgccattacactcctgcctgggtgacagaacaagactctgtctcaataaaaaagaaaaagaaaaaaaaaaaaagaatgtgttattcaggtagagtgacttgggttagaaatttttttaaaataataagaaaatgtgctgagtgactcattaaattgatttttatgtattgattagtcacaacctggaatttgaaaagtattagccatgagtaatacttttctcatagtaggctcagtaaatattctaatcccagttctgtcactgatgtgattttgggtatgttttgaccttattggtttattcagctataaaacaggagttcatagcagttatatggatagtgccagtagcttttgataatatttaaatttttatatgcaattcattttagtaagaattattgaggatttcctgttacactgtatactatactgtactatatgatagtatagtgtagggcttgtttggcagtgtatagggtgctgtgtagggtttgtttagtagtgcctttttactgtgatttctatgcttttagtagcagaaattttgaaaagagatgataggcaaaacaataaaatattcaactagcacttcttgagcattacttgctgccaggcataagatacaaagtgattcaacttcatttgccagttaggttccctcttagagtcttggattaaagttgtgaaaacttcattttttcctttgtcatctgatgaagtaggcacactgattatcagtgttaaggtgttcttctgagataacttcttagctttaatggtactggtctataattgatgtgaagagagtcctagaggctagagcttcctattgttcactagcccaaattggctctagcttcttaaggttataagagtagaacagaggaataaagtacaatgatgtcttctgtcatttatagatattttggagttttagcgttttgtacaatttagttctatttcattgacctttgcagatctaaagtgtgcagatattattaacactctcctcacttttaggaagcttccctaagttagctaagtggtacttaactattgtattacttgagggtaattagtgtaaactaatttcttccaatactctgtatataatataaaagtacctttagattatatcttgaatataatgagtaacatctttttttagggagaaaaggatgttctcaataggagatattcagatctatttaatttctcaagcatttgctctttctttgtagtgtgaaaaaaaaaaaaaactgaaaaactatttggaaaatattggcctccctatccagaagtgttaatattaaaggaacagattgttttatattttggttataatgatttatcctgggggatacattacatattcttaaagaagtggaaagtttacatgaaaactaaaaatatactaaactgtaaataggttcataagatatgcatatttaaaatggagaaaagaaacggctgtagaccgggcatggtggctcacacatgtaatcccagcactttgggaggctgaggtgggtggatcccctgaggacaggagttcgagatcagcctggccaacatggtgtaaccctgtctttactaaaaatacaaaaattagccagacgtggtggtgcatgcctgtaatcccagctacttgggaggctgaggcacgagaactgcttgaacccaggaggcggaggttgcagtgaaccgagatcgcgccactgcactccagcctgggcaacagagcaagactccgtctcaaaaaaaaaaaaaagaaaaaaaaagaaagtggctgtaaagcagcctgacacgtttttgtgctttttagaatttcagctattgtctgaaacttgtggccctacttttgcagtgaagttactttctctcataacaattgtggatactttatgaatggacagcacgcacatacgtgtgcacacacgtacactttttgttgatttgggggttctgaatactttgttgtatagggtaaatttgaagacatttttgtcctttgggttccttttaaaacatttctaataaacttattcttttagaatagttttaaatttatagaaaatttgcaaagataggtctcatagacctcatactgagttttccttgttaacatcttacattgttatgaggtatttgccacagctaatgaaccaatattgaggtgttactgaactaaagttcatacttgactcgaattccttaatgtttactaaatgtccttttcctgtaccggcaggataccgctttatattcattatatttagatgtcatggctccataggcttctctagattgtgacagattctctgacttttttggtttttcatgactttgacatagttaactacgtttttaaattaactaggagtctctctgagcctactcagagagtaaatcgggaggctgccctatttaaaaattaaatgaattaataattgagtgaagaaaatgtctcttttaaaatatgtgtgtgtgtgtgttttttaaagctaaaattttttctttccaaaagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggtatactttcactttaaaagaattatgaatcaaacaataagtttaataactattaagagaactggaaaggtgatcagtgaaaatgaatttctctgttaggtgatttttcttattcttcctctgctgtgcagtagtaaaattttaatctcccatggtgcattttatttcagtcttcaaaagtgaaaatcatggcatatctcggatataagaaaaattgcccacccataaagtgtgaaaaaaatgagatttgctgaaaaagtggcctgtcacaaagagtactttatacagaatgaattttataattccattttccattatagccacaggggaataagattctgggaagtaaagcttccagatgcatattcaagatgatttcaagataattttttcctagcataaatacattttgcagtatgagaaattggtatacaattaatatcttcaataatgggaaaaagatttgataacaaaatggtttgtagcagtggaaagggagcattttgtaaaagaaaaataatgtcctctacctaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaaggtaattttttcatttttttgcattaactttaactgaacacttcttaaatatcagactcagtaagtattttttgtatgttagctcatccttgcaaaattcattatctgtattttatggatgaagaaactgaaggtaaagagattaaataacctgcccaaggtaggcactcagagtgtgtgtgggggtttcacatttgagtctgtgactctttagatctggcattcaaactgtctgtgttttgaccatcaccctagatcactgcctcttaccattttaggagtatagtttgaaattctgactgattttaattggctctgttcaactccaaaataactatttatgtggttgtatttttcatcaaatgatcttaagttgaacaggatgtggatgttagcaggaagagagtaaaggaagtagcagagtagagaccaaggtcagtatgaagaattaactgggtttattagcactcttgagtgacccggtccctgtttatatattttagatttttatttctctcaagaaaacttttttcttgtttttttttttttagttgtaaaaaggttatatttttcatgtttaggaaaatcacacaaatcacacagagccccacatgcccagagataatctttttgtgtgcctttttatacttttatgtctgtgtgtatacattatataccctttttaaagcaaaactgagattataatattcatactgttttgtaatctgtttctatcaataatatgaatgtcagtacatgttaagccatgtatgtttgcaatattttgtggctacataatatgccattatttggatttgccatgattaacgcagtcatttattatgtgttttaacttttcaaaatcactgagtgttgacatgatatcccaagacatgtatttttgtgttgatgacagattatatccttagggtaagttttgagaaacggaacttctagatcaagaagcattttaaaacttctgagattatactgccaaattatttcacaaaaaattgtgtccatttgtattcctattagttgtatatgcatctttgtatttatctttttactatttatgacacaaagggagataaaatgagataatcatttctatctgtctgcaaataaattataggctagtagagacaatattcctgcgaattaacccctaccccacctttgcagagtatattattataccttcagactcagctggaaaacttgtttaaaacggggattaaaacaatgagtgatcatttggctatatgtttcagtttggcagaaatgctgtaacattctgtattctcactctttttttgcacttttcaagcccttattttctcttaattaaaatagtttctagtctctgcacttttcatttatttttcataataactttgagaataaccttccttacatagaggtgtgatctttttactccttttttcaaaaactggtcttgactcaaggatggtcccaggctcctaccaccttagccttatttcatgttatcagctacatccagccaaactgtattactcactttctcagagccactgttttcctgtttctttttcttctgctttttcttttcatatgccttcttctgcctgaagggtgaacctgatcccctgcaagttgttctatgaatcttgcctattcttcaattccattttcttcctaaagggtgctttatttagcaccccacttgtcatatccaaaaacaaatcttcctggtgtgatgtttttcctttgaacttgcataatatttagtttgagtcttatagtttgagggcacttatattttaatttagggtacaggtaattgtcgacgtgtcctatactgcctcccacccaatgaaatgtaaagtcactgggaggtaggaatgggctcattcattttctacctatcacatagcatatattacacagagtttaatagctattcagtaaatacttgttgtatgagtaactcagatctacaaaccggattatggtggtgtgagcccttacttaacaatagtaacacctggtatttattaacttctagagtgccatcatagctcatttcattcctacaatcacccactgagtgattgctaaccaacaaagttgaacaaggtccagagatatttgggagctgaatttagatcttctgattaccaacttgtgctctttccacaagagggtgctaatgggtaaagtctcttcaaaatgagttgatcctaatgagctttaatgggctgctcttgaataagaatttaaccggaaattaaaacccctgggagactattgcagtattttgaatgtaatcattatacattaaggaagtacaccagtgacataagcctagataggtgctttatctatatctacctcttaggactctctggagtcagagatagaggttattgtgtttaatataggcagaaagatgatagtaaaagataactaatattcagagcagttcatcagtgggatagcctttggaaagttgtgaattcaccatgaatacaagggggtcaaaggcaagggagtgtcatagaatccattttgtattaaattgggagctggacaaaatgacttccagggttccttacaaaacattttatgataaattacatcttagagttttagcctggaagcacaaaaattgcaggctattcatttgtacctttttcttttatttgtagtttttagagacaggatctcactctgtcgcccaggctagagtacagtggtgtgatcatagttcagtgcagcctcaagctcctgggctcaaacagtccttttgccttggcctctcaaagggctgggattacatgtgagagccgcctcacctggactacatttttattttgctgacttttcttatttaacttaattcttagtctttaaaaggactgccatttgttcaaagtcactttcacaggaagagtgattgaatttacaaaaacagggcaacaggtaccagaagaactcttcaagtttctttgaaatttaacttgaatttaatgcaataaagtgtaggaaagatcacattaacagagatagatagtaggatggtagttttcaagggaaaggggaattactatttaatgggtatggagtttcagtttgagaaggtgagaaaagttctggagatggatggtggtggtggttgtacaacagtgtgaatgtacttagtgccactgaactgtacacttaaaactggttaaaatggtaaattttatgtatattttaccataataaaaaatgtaggatgtttcatcttattaaagtatctaaatactttgaaatctaacttgaatttaaagcaataagaggccaggggcggtggctcatgcctgtaatcccagcactttgggaggccaaggtgggtggattacctgaggtcaggagtttgagaccagcctggccaacatggtaaaacaccatctttactaaaaatacaaaaattagccaggcatggttgtgcacgcctataaccccagctactcaggaggctgaggcaggagaatcgctggaacctaggaggtggaggttgcagtgagctgagattgtgccactgcactccagcctgggtgacagagcgagactctgtctcaaaaaaaaaaaaaagaaataaaataaaataaagtaataagatgtagggaaggtggcttcttcttgttaaagtatctaaatagatgaagcagtttgacttttattctttttgtttgaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaaggtaagctctacggtcactctttcaatgaagaaaaattgtagttattggtaattttgcctaatttgagagctattttagatgaggcacggggaaatctctgaaaggttacccactggtagaggggaagggtgagtagccatcaaaaagttaatttagactccttttacaattaagacgagaaaataaactttatttagtaattattaaaaatttgttttagtatcctattaccagtgagagatgagagttgaggaaatacaaggaaagatgatcaagtaataaagaggagaatacaaggaaagatgatcaagtaatgaagaggagaatacaaagaaagagagatacgcacatacaaagaatagttaggttttaagataagggctggaggttgaacctacttcagataatcatcattaattattgttctttgaaatggtgattcacatgttcatagctattcatctatgctttgaggtaactacattttctagtccatatggaaggtgcttttttggagacacaataatagtaaccagagcagttctaccctgagaaacaaatataccttttcacattctacctcctatccttacatttattcactttagatcattcatccatccatttgtttattcatgcattcagtaattattgacagtaaattaactgctagttgtcggaggtgattaggggatatgagaatgaggaagtaacaaggacttgtagttttatgcctaagcaaaactttaaatttgtacctctgtgttacttcagggttgaaatcttaaattttagatataagaattcttgccgggcacggtggctcatgcctgtaatcccagcactttgggaggccaaggcgggcagatcacctgaggtcaggagttcaagaccagcctggccaatgtggtgaaaccccatctctactaaaaatacacaaattagccaggtgtggtggaagatgcctgtaatcccagctactcggcttgaaccctggaggaggaggttgcagtgagtgagccgagatgacaccactgcactccagcctgggtgacagagtgagactctgtctcaaaaaaaaaaaaaaaaaaaagtttttgaggtctactttacagtataatgtaattattagagtgggtatgtatacaaagcagtgtggaactgagactgtagagaaagtgttgccaaagaggaaatatttgagaagagttacgaagggagagaagaatctgcaagatagacaagatggagaagtgtttaggcagaggaaagtgatctcattagtttagtaccgcttaacattatcactaaggcatatattcttttctgtttgagacatttgaactgttttcgttggattattaaaatttaaaatggcttaacattctaacttaacacacgattgcaaaatactaatgttaactttcttttctctttagaggaaaaagctatgtattctgctgaactcgaaaagcaaaaacagcttatagctgaatggaagaaaaacgcagaaaatctggaaggaaaagtgatatcattacaggtaggacaaaatagttttctcttgtaggttttattattcatggaacagttacttgtagagtctttgtcttggaaataatctcctaaactgttcatttagtaaattttctaccctgaatccagccctctgctgtagcctgacagtgaacaagatacccaggatttccctaaggtgtcatagtttagagtagacacggcaaatgtaagatgacaggacatttaaatttttttggcacatagaggtattttagaggtctccggggaaaaaacacccaaattaatctataatttaactttataattttctctctttttttttttttttttttttttgagaccgagtttcactcttgttacccaggctggagtgcaatggcgtgatctcgacccaccgcaacctctgccttccgggttcaagcaattctcctgcctcagcctcccaagtagctgggattacaggcgtgcaccatcatacccagctaattttgtatttttaatagagatggggtttcaccatgttggtcaggctggtctcgaactcctgacctcaggtgatctgcccacctcagcctcccaaagtgctgggattacaggtgagagccactgcgcctggcgtgtaattttcttttttcaacaaaattttaaatttgtacctctgtgagcactcatttcacatggattaaaacaatatatattatcccattaaatctttttttttttgtataataacatcctttaaaatatttttctattccatctatatttcacacataggacaaaaattatatataaggaatatataaaaatgaacccctatgaagagataggacaccaaaacaacgtgcttttagatttaggagaaacttgtcttttttttttttttttttttttttttttttttgagacggagtctcgctctgttgcccatgctggagtgcagtagcgcgatctcggctcactgcaaactccccctcctgggttcacgcctttctcctgcctcagccttccaagtagctgggactacaggtgcccgccaccacacccggctaattttttgtatttttagtagagacgaggtttcaccatgttagccaggatagtctcgatctcctgacctcgtgatccgcccgccttggcctcccaaagtgctgggattacccaccatgcccggcctaggagaagcttttctatgtcataaatagactgtcaataactggtagaaaatgataaaattcatttacctgacattagtggaggtaattatgctgttcttcaggaacattaacgtcccaagtaagtgaagatatacttcctaataaagttttaacattttaattaagtattaaatggctgcaaaacaatttagataatatgtataaaatataagactaacaatgcagcaaatacccacactgtcaccacccagtgtaagaaataaaacttcatcctttgaagttccttatgcaccccttcacatcccattctcatcttccacctcttaggcaaccactattccaaaatgttatgtttattacttccttattttgtttggttttcttttttctttttctgcttgttttctttatggttcttatcacataggtttgacgctccaaacaatccattgtttggttttgcatatttttgaagtctatgtaaatggaatttgaactatatgtaaattcagtaatttttctgagacttgctttttttttttttttttttttttttgagacggcgtttcgctctttgctcaggctggagtgcaagggcgtgatctcagctcactacaacctttgccctgggttcaagtgattctcctgcctcagcctcccaagtagctgagattacaggcacacaccatcacgcctggctaatttttgtatttttagtagagacagggtttcaccatgttggccaggctgttgttgaactcctgacttcaggtgatccatccacatcagcctcccaaagtgctgggattacaggcgtgagccaccgcacccggctgagacttgcttttttaaaaaacttaccatagtgtttatgagattcagtcatattactgtgtgttactgtatataggcgatttgttattttcacttctgtatgcattgcattaatatataatttacccattttattaataaagggtatttcagatatcttctaaacatacaagagtttttttagatgtatatcttgattggaattgctgagttataggacatatatggtcaacttcagctttattagatgattaattgttttctgaagtggttgtgctaatttactcccactagcaggcacatgacttcttgttctacatccttgtcaacacttgacattatcagactttcaaagtttttgacaatctgatgggtaggaagtgtcttagtccattttgtgctgatacaatagaataccacagactggtttatttataatgaacagaaacttagtagctcatgggttctggaagctgggaaatccaagattaaggtgccagcaactggtaaacctccttgctacatcatcctgtggcaaagagagggtaaggtgagagaacaagagggagccaaactcctcctcttgcaaggaacctacttccttgattatgaacccactcccacaataaggacattaatctattcatgagggtggtgcccccatgaaccaaacacctcccatcaggccctacctcccaatactgccacattgggaatcaggttttcagcaaatgaacttgtgggtatacattcaagccatagcagaagggctgtcttcctgtggttttaatttgcacttccctaattaccagtgaggtcaagcatcttttaatatgtttattgaccatttatacttactttcttgtcagctcattaatacatttaaaagatgtattttatctaatactcttagtggtttctagtggatccagagtatacagtctgtggaactgctagaatggaagtccagatcttcttctcttttttcttagagacagagtcttgctttgttgtccaggctggtctcaaactcctgggctcaaacagtcctcctgtcttgacctcacaaaatgttggaattacaggcgtgagcctctatgcctggcatttttttcttattttaattagagatgaaatcttgctatgtttcccaggctggaatgcagtggctcttcaccagtgtgatcataatagtgcactacagccttgcatttctggactcaagcaatcctcctgcctcagccttttgactagctgggactataggcatgtgtcacagcacccagccaaatcttcttttaaaactagttttattttttaaaatttaaagtgtaatatacatttaaaagaagaacaaaataaatgagaagaaattgagggaattaataaaaataaaagctgtaattaatgaaataaaaaccaaacaactggtagaaagaataacaaaatctaaatgctgattttggaaaaaatctaagcgtagatttaagctttaataacttcataagtacaaatggtgtgggttaaaaaaatcatttgaaagtttacatttccttcacactaaatttagttttgtggatttttgaatagtaaatattttatttaaaattttcaatttcattccctctatatatcaatcaggtttcagcccctaaaagcaggatcagtagggtgtgtatgtatatgtgtcaaatttatatattgatatatatggatacacacatgcaatttattacaaggaattggctacaagattgcagccgctggataagcaagtctgaaatttgtagggttggcagtcaagatgggaagcccacatcaaaggcaggctggaactcagcaggcatgggccaaagctgttgtccacaggcagccaggaaaggaaagtcacaagcaggatggaactccataggcataggcggaacctgcggtccaaagaaggaatttcttcttttttagggggaaggctaaaccctggcttttaagaactttaaaactggttcagtcgggcccacccaaattatccagaataatgtgcctttcttaaattcaactgattaaggactttgattacatttgcagaataccttcacagcaacatctagatcatatttgattgaataactggggactgtgacctatccaggatgacacagtaaaaaggctatcacactgattgaagatggcaaaacttgaccttaaatttacatgggagaatacttgagaatagccaagaaaattatgagaaataatgcagtgaggagagacctgcctactagatgtcataatagagccataaatcgatacaatattgactagattagtggattaaggagaatccagaaatagagcccaggatatatttgagaatttgaaactaaaacctaaactaatttaatgagaaaaaggatagcttatctaattaatgatgttgataaaaccagctgtccataggaaggaaggaaaaaaaaacaacagaccctcaccttacatcataaacaaaagtaaagtctaattgtattaaagcagggattttcaactgggagtggtgctgattatctggggatagatggcatttattgggcaaggaatgccaaagccactcccattaagaaacactgtgttaaagatttaactatattacaaaatatcttgtaataaaatctggaagactacatttacattctaagggcaaggaggatcctaaccaagactaaaacttaagaagctgtaaaagcaaagtagaacatgtttgactatatagtatttaaaatgtttacatgacaaaagatattatagagtcagtagaaaaatggcagatatggtaacggtatttgcttagcacaggtgaaaaagcttcatatctgctatacaaggtgctcttacagatggacaggagaaatagaactcagtagaatcttgggcaatgtatgcaaagaggttttcacagaaggacagatccagcttgccctgtaaacatgaaaagtaatgctcaaattcactagtagtggtcagggaaataaaatttaaagtaacaaagtcataatcaacatcactttattagactttcaaaaatgaaaaagagaacatttgttgctatatttctggacttcctgtatctttgtttttttgtagtttatgttgttacttttttttttttttttttttacttctgtcatcatgttgtctttcagtggcatctgctctttttatttagttcctctaaatgaggcagtattgtattgaaaagaatgtgggttctgcctttgatacttattggttggatacatttgcccaaggtcatagaggtgcagcttcaccagctgaaatgtagaggttgactctaagatgtctctcagccttatagtttgtgaaataatttttgcatacttttttttaataaagttttctttctcaggaatgtttggatgaagcaaatgctgcattggattcagcatcaagacttacagaacagttagatgtaaaagaagaacaaattgaagaacttaaaagacaaagtaggtttttttcttttcatttttcccccactacaatactgatattaaatcaaatgtagtcttctgtcataaattggcatagttgagtgagaccaacttcattgatgtgtgacttccatttgtatcttccctgactgacttgcttcaatttaagtatggtcctagtgaaaccagagtcattaagttggccctggctgtccagttagttttcctggatgttgaggcaatgccattgcattggctgtcaccctgttgaccatcagaggggttgattggactgatttgactttttatggatatgatttctcccttatcagttcacgtgcatcttgcctaaggccatctgatctgttagagaaggcagaattctcaaataaaagagcaactttctgtagaatgaatgtctgggtatagctagatttttatgattgtagatggtgttttaccacaggtgcatcatgtattttttgatgtttataaggtgcctcatatgccctgtccataccctaaggtatgtcctatgcttaggattattaattggttcagtgatcaggtggcttacagggctttgttgaatccaacagctgacaaagatggcatatcctcatttcatctctgatttagaggcaaccaggaagtcaaaactattctagggctgcatttagtaggtaatgattcagggttattggaaaggtgataacggagcctagaaatgcatcaactttagatgtctaggttaggcacaatagtaacaaggcatgtagttaagaaatacataccacctaacatgaaattagaaataagcaaaaatagaaggagatggtacagcagaggagctgtcaacaacagaagcagtgacttagacactagggaggcaagccggcaggaaccactgacgcatggagaccaaaggacaagccaaagtaagctggcctaaatccagcaggagacaggacaggggagatttttaggaatacagagaaaaaaagatagatgtgaagtaattgtcctcaaaatgacttgattctgaggcaagttactgccaaaccaaaagtcttctaccttgtaagtcttgaccaggctaggatctctaaatctagtagagggcctgaaaatgggcagcaaggaaacaattatgtattgagtgtctattatggacatttgacataacatttatgtatttagtcttctcatcatttactttttataagcatctctaaaataagtggtattatccattttatagattaaagaggcaagatttgaactccgatctttttaactattaccataattcgtggtcttttcatgttattgtagccctatcaggaaaatggttatttatagtctgacttgtattttgttctgtatatctccagtttcccctgaaaatatggtagcatcttctgtattgtgccctaacgttgaaatggttgcctttaccaagagcagtatttatttagaaaacagtctagttagatcgaaggccagtgcaactacaacattatctggaagacatatgggcaactgagaggagacacactgggaattgataatcttcgggttgggctagactaatggaggtgaaacagcagtgttgtgaaccagctcattgctttgtgacaactcagtgctatatgttatgctactataatatctaaggccacatcctcttttagacacctacctaagtaattcccaatagttgatggtaaatttaaaattctaagatttattgtagttaataaatattatcagagttcttgaaatacaggttgagcatccctaatccaaagtctgaaatgctccaaagtctaaaactttttgaaaggtgacatgatgctcaaatgaaatgcttattggagcattttggattttggatttttggattagggatgctcagccagtagtactataatgtagatattccaaagtctgaaaaatccaaaatctgaaacacttctggttccaagcattttgggtaagggatactcaacctgtatttagtactttttcagacactcatttaagcccccactagtagaatattttcagatgttcttgattatagatgataaagcttaggtggaaaatactaatattcattgtaaacgtatacgaactttggattcattttgtggaatcaatattagctacagagaaagctctgattatgcttgtataactggtatttgaaagggcaggcaagaggccagtgttgcacaaacaggaaggggtgtaaagagacagttggttctgttatgtctgtaagtcattcttgccatttacagctcttcttaacaatctgttttcttatattacctaagtgctttaatatcacttttatatctctaaatacaaatgcaattttattttctcaaagctgcactcttgatttgataatgtaaacaaaactttgattagctcacttgtttcaaaagaatcgctgtatattttctctcctagatcattaagtactttaaatgttgattgatgttgtaatactgtactttatttttaacacaaaacttggccagacagcaaaaatatttgccaggagaaacaattttgaaaaagacagattgccttttgttggaagaaagtacatggagacttgaatcgtaaaggcaaagtattggttacttctaagcatctgtagactaatgattaattgatacacagtttcagcatttaaacaatattaggaagctcacttttaaaagtattttattccaaatggttgattatatcattgctaccagagatgagatgattcagtctggtcaaacatatgaaaaagagagctgttgcaaataatgccaatattgaaacagtagactgttgataatttcagtcatttcttaagagtatgtatgtgcatctgtgcttatgaattaagagtatttttgggccttgtgtgaaaagtatgaagacagatgcttatcaggcactaaatatttaatgagaaccaactacttggcttcccattaggtgctatatgagatactagatagtatcccttttccaaggagtttagctaaggaaatgacacatcgtgtagataccccgtaggttagtaattgaagacagtgatgcacaacagtgatcataagacagggcatatttagttcctccagaatcccattaagggtcaggcagcattccatggagaaaaggaacttgagtagagacataaaccagcagtagggaactgtttaaatatttctccctgtctccctccccctctatccctcttcccgggaaagtaacgaagaaaataaatcctacgatcctaagtactatagtttaatagacagtgttggctgttaaaagaattactgctatccttccttttaaaaaattattctttcagcattttacctgaaagtgttcttcaatacagttccaaagacttcacatgccatcccatatccaaactcagtagagtggcctatgaagcacatatgacagtggttttcattaactactctgagctgatcagagttcagaattccatggaattgctattgatgagaaattatacacctgtgactgaaccattaaaatgcattatcttgctatatttatggtcaaatttgacattttcctttccttcttgttctctgccatcatccttgacataaattcctgctaattgaaaatgatttggccggacgtggtggctcacacctgtaatcccagcactttgagaggccaaggtgggtggatcacctgaggtcaggagtttgagaccagcctagccaacatggtgataccccatctctactaaaaatataaaaattagccaggcatggtggctcatgcctgtagtcccagcttcttgggaggctgagccacaagaattgcctgaacctgggaggtggaggttgcggtgagttgagatcacgccactgcactccagcctgggcaacagagtgaaacttggtcccaaaaaaaaaaaaaaaagaaaagaaaaaaaatgattggataaattgaaataaaaagcacaagatattgttattttgataactatgattcagaaaggtggtgaattttatggtgtgcaaagaaaagtgagttttcataagcaatacaaatttagttctaacatcaggaagatcttttggtctgtctgctagtttatacctgtatctgaaagggcagcataactgattttttttttaagaaggttgaatgactacttttaaaagtctcctaagagttgagaatggaaaatttccttggaccattttttaaaagaaaatctagaagaatgtataaaatgagtcccagtaaaacttactgtaatatgaagcataaaaacatgttttaaagctacagatataaaagaagcttaaaatatttttcgtggaactacctttacggtgctggatggtaaagtttttattttaaataaagacattccgttttccaggacatgatttatacaagaaaacatataatgtcctgttgaacacaggccaaatacattcccagacgctttgttacccaaaccttttgagagatttctttatagatgtttttggcagaagtggtgattttagaggaaacatataagaagtaccagatgcagttttctgagttgccataaatggttaaaaaattattttgatgatataaacatctgggtatactagacaatgccaaaatatgagttaagaaaaaagtgtatgtcaattaggtaaataattaaacctttttcaactgaactgtattttagaaattgcagtttaaaaaaattcctctaagtttaaagggaaaagtaaatgatatagcaataagaatgttttgagttaatgtgttttgtgtccttgcccttatttctttatgtatggatgagttcataattcagaacataaattgttctttttgtccagtgttctgttctttgcagatattctcttttcccagagaaaatcaatcattatttgacttacttctcaaatattcattgtttatttgctgtgtgctaagcactgcagtagaactaaagatataaataaagacaggagacaagggtcctgccttcaggaggtttacagtcaggcaggaagggaagatgacatgcatcaaatacatgaaacaaatggtttagaaaggaaagagctatcctttgtacttggtgttggtagcatggaagggtagacaaggttagtgaagggctcacttgaaattacttgaatggtgaataggtatagctaagaaggcagaaagttggggaaaagtgttctagacagagggaggaattcctgtgaaactgtgtgtcataatctggaaactggctgaagatacagttgactagtaatgaccaagggtggtgggtatgtgtgcacatgcatgtgttggagtggagtgctgaaaaggtggaggtagaagtgggttgccgtgtggaaataagaatctcttagtatggatcacaaacacaaattgtaaactgaggctatgatgataatataaaagagcacatgaaactaggtaaagactgatcatttgaagtgtttcttatggaggcagcagattctcagctccgcccagctgctgccatgcaggaatgtgggcccagtgttgccatgtcttcagatctttgaagagaccctggatatctgcaattttttcatgaaatatctcattaaaaaattaatttcaacttgtggattcaagggtacctgtacagggttacttgtataggtttattactgcttgacactgaggtttggggtacaaatgatcttgtcactcaggtagtgagcatagtacccattaggttgtttttcagcccttctccccctctcccttttccccctctggtatctccagtgtctgctgttcccatctttatgtccgtatgtacccaatgtgtggctcccgcctgaaagtaagaaagtttgtaacacttttaaaattaaatatatattctgtctcacatgccagaggagtaacaagtatataaccactcataatatttactctttttaaaaaattagttctgtttcaatatggagaaatatagttcagattatctgaattcataataaagggttaaaggaagagaatggtgaggaaaaataaatttgatttggttatattaaaaatatttatataaaatcaagtgtacatagtaactctggtgaataatccaaatttggtctacaaataatccagtagacctcaaccaatcacagattctgatctagtggaattcagattaatgaagttatactgtattaatataattcttttcctgtgagttcattgctaagaagtagaagtttatttttatttttaagaggcaggatcttatttttttttttttgtggagacggtttgtctatgttgctcaggctggtcttgaactcctggcatcaaatgatccttctgccttggcttcccaaagtgctaggattacaagaggcatgagcaactgggcctggcctagaattttaaaagatacttttcactcagcagtgaacaattatgattatgggacaacaaaacatttaccatatactctagaccttcaaattctgtgttggatacagttgaaaataattgagttaaaagacaaagcagggctgggcacggtggcccatgcctgtaatcccagcactttgggaggctgaggcagatggatcacttgaggtcaggagttggagaccagcttggccaacatggtgaaagcctgtctctactaaaaatacaaaaaaattggccaggtgtggtggcacatgcctgtgatcccagctactcagcaggctgaggtgcaagaaacgcttgaaccttgggaggcagaggttgcagtgagcagagggtgtgccactgcactacagcctgggtgacagagcgagactctgtctaaaaaaacaacaacaaaaaagacaaaacagatgcttgtaaagcttaacctcaaattgcaaatagtataatatcttttaaaaatatattatttgggccgggtgcggtggttcacactcgtaatcccagcactttgggaggctgaggtgggtggatcacttgaggtcaggagttcaagaccagcctggccaacatggagaaaccccgtctctactaaaaatacaaaaattagccaggcgtggtggcaggcgcttgttatcccagctactcgcgagaccgaggcaggagaattgcttgaacctgggaggtggaggttgcagtgagctggggcgccactgtactccagtctgggtgacagagtaagactctgtctcaaaaaaaaaaaaaaaaaaaaaaaatatatatatatatatatatataatatacatataaaatttgatgttaaaagtgatcttgtataacttgaaattctgtaataaaaaagatctaatttctagcttttgctttgattatatttaattaaatgaagaggttaaatttccttattaggtttaatattgtatcagatttaaatttagttttaaggtatccagatgcagataagacaccagatgcaatttatttattgacatatatatatgtatgtgaaatcatctttctaacatttttttcttccttctgttgactccttggcctcaaagatgacaaacatgcaaaatggaggggggaaaacctcacaaaatattaacattaaacagagtaatatatgtgatactgattcaggctagattgaaatatgaactttttagttattttaagaaattggatgataagtactaatgctttatgtagcactttactatttagaaaagtcacatttgatcattcagttgattctatcaaattctttgagataagcatgttcattttacaaaataggcaacaaagtctggccctggtgataggaccatgattcatatccacttctgactctcaagttctgtgttccttttttttctcagtcaggtgactgttcagtaaatctgacttggatcttgcctacaggagcttactcatgaaatatccaaatgactttgtaagcagtatgattcattttaagatgtagtatgattcattttaagatgttctctgaaggcagcattgtagtgtactgtcattaattacaaatgaaatgtaaaattatgatgtgccaatttgttgcaatcaattacattttatgttcaatttttattttaaaccaaatgttgaagaccatggcaccatgtctaggtgttccagagaagagactctgatatggcaagttttactatgtcacagatgtagagtaactctttctccaaactagactaaatctcagttgctttattgctgaacttttaaagttcccccctccacctttttttttttttaacttccaaaaaattattttggcatgtgagattatttcacagaaatattttatttggcttaaaactcatttctgaataaccatattttccctgcccatataaatacagttctgatttcaaattgtggtttgaattagggttcagtttttgtagagaaatattcagaatctctgatgggaggaaaataagggtgcttgaagaaaaagaggcatctgtagggacctttgtagtaggtgtttgactttcttttcctttccaaacccctcatagttaataccatccttctagcaccgtcccttaaattctgagtttttccccctagactcaaatatcagagtacattctaactactgcttgagtttgcaacagccctttgcattccacatcacattagctcagggacaaactgtatgttctgatagtgagtttaggaaattttaaccctgtcattttcgccttaaggatgttttgactctacctttctgaatacagagactttaataaaaaccataccaatcttagtaagttttcatcaagaaagtatttttgatttggacttctacgcagtttgatttcttgatcagtttttcatagagcaaagttaaaattttctactttattttactaaaatttttatcaggctcagctctgctttgtgaattttactctgaagatgtctgtcatttcactttctctctctctctctcttttttttttttttttggagacagggtctcgctctgttgtccaggccggagtgcagtggcacaatctgaggtcactgcaatatctgcctcctgggctcaggcgatcctcccgcctcagcctcctaagtagctggaattacaggttcatgccgccacacccgactaatttttgtatttcttgtagagacagggttctgctatgttgcccaggctggtctcaaactcctgagctcaagcaatatgcttacctcggcctcgcaaagcactgggattacaagcgtgagccactgcgcccagcctctctttttaaaataagagatagtatagagtagtgttatatcctggttatgttctaaaagcagtactgtccagtaggaatatactgtgagccacgtgcaattttaaattttttagtggccatgttaaaacagtaaaaagctataggtgaaattgtttgataatatgttttatatagggacaggcacagtggctcacacttgtaatcccaacattttggaaggctatggcaggagaattacttgaacgcaggagtttgagatcagcccaggcaatatcgtgagaccccatctctacaaaaaattagaaattagctggttgtggtggtgcacactggtaatctcaactatttcctgaggctgaggcaggaggatggcttgaccccaggagtttgaggctgcagtgagctgtgatcatgccacagcctgggcaacagagcaagaccctgtctcaaatatatatacacacatatatattttatatataacccagtataaccaaattattatatagacatgtaatcaatatacaaattactaattttagaggaaagtaggtaggagaagggaagtctcagggaaagggaaggtgggggttggaggtaggttagctaagcttgacctctgtttttctgctatctttctgtagccttggggaggaatggaggaggaaggaggagaagaccatgcccatctttactctgtctcctactttagtttgtgagtgggacggttaagtcaaaacagtgacgagagattaacttatttgctgagttctatttacattcagaatatagtgctagaaaaggcccagataacaccatgtgctagtagtatacatgtgcacattaggaatctaaagtgtcttttactgactcagactttaataatagtcctgtccacccccaccttttcgccctctctctccccttctctctctccctctctcgtccaagtttaaattccttactggaaagacaggaaaggaaaagttcgtagtagattttccaaatacaaaccttgcttttataatatggttatggcaaccatctctattttggtaaaattggcctattatatgaatgacattttgcaagttagatttttgcaatttaggaaaaccacaagccatcgtaaacagttaaacgagacattttatatacgaatttagtaccataaatcggaattttgggcattgtgcagaagcattgtacagagcagaatgaaaacataaagcaaacagacctggcctaatctgtaaggctcaaaggaaaattctttaagaaagtgagttggaaacagagacatgaaaggtgagggcagtcctgatggaaaagagctttccaggcaggaaaaaaaaaaaaagaaaagaatgacaaaacatttgcagaattcttacagtgggaatttagagtctagaaatataccatacatttatggtcaattgatttccaacaaggttgccaaaagaatagtttcttcaccatataatgctggaacaagtggatatccatgtgcaaaagaatgaagttggacccctacctcacaccatgcacaaaaattaactcaaaatggctggtagacctaaattttagaattaaaactataaaacgcttaaaacaggtgttgggttaggtatagtttcttagatatgaaaccaaaagcacaagcaacaaaagaaaaagtacattggacttcataaaaattgaaaacttttgtgtttcaaaagatatcatcaagaaagtgagatgacaactcacagaatggggaaaacatgtttgtaaatcatatctgataacggaacttgtatccagctactactaggaaaatgcagcataattcaaaggaaaaggtttgtggcagagtctagcgtttggatgtgaatgtttctagatagagctctcctctttatttctttcagaacaaaaacttataatctagcttaaaattactgagcatctctttcagctcaaactattcgtttctggcataacagaacaggtgtaaactctgtttgactgagagttccttagtccagaaatccttgccctgtggcatggctgaatttaggaacagggtatctcctgttgtaattctagactttgcctttaatactgcttaaattccaactattccaccaagattttatggattttgcttcctttttaaataataatttaaaaataaaatagtccaggcatccttctaagtcagtcataagctatagtatcttgatttgtatattagagccgattacctgaattatattttgcaatttccttacccccataatagtttgtcctatccactgcatcctgagccatggtcttagttgtgttagatacgcttcttagtcagctcaccaaaaacagagtctggccaggaaaatagaaaaaggaaaatattaaagtcctttctacttcctcctgttaataagagtggctctggaaatgtttcatgcaaggaggcagtgatgaaaatctcttctttgctattaagtttttaaagaggatgaaaacgtttcttggtttttcagtattgtattacaaagttgattactttcttgggagtaaaccatgtgaattaatgcactctggcttttagaggatttctatatgagagcctagttccctggaccaaagaagagatagaagttattgaatattcccaattagaataagtgtatatattcagaggttataataaagatctcataaatttcattatatagtcatccagactattttaatcagttaatggctatctttattcacatattttacaacagatgagctccgacaagaaatgctggatgatgtacaaaagaaattgatgagcttagcaaacagctcagaaggaaaagtagacaagtatgctttttgcttttaatgtttgtatattttgtggaaatcacttttatggttaaaaaaaaacttctaaatgtagatgtttatatgtgattaaatttttcaaaagccttttttcccctcactcttagtgaggaaggatgcagctttaatgaggagtcagcagaatcacttaccttcttttatttttaatgtggatttttttccagctcattctttttcttaaaaccatatagaagagctaaaatatcacctcagtaagaagtacttagaaaataaaaaatttatttttaccattcttttttgcttcttttactgtccttaaatgaacataatcttgctcaaatgtattagatctgaaacctcagtatatatgcaacagtagctcatttaatattttttaaatgtatatattattagtaaatttttaatacatttggatggggaaatataagcataacattaaacacaacagtcatcaccatttaagtttctgcttcaggtgaacattagcccagtcaggagcttggaattactaaggaggcgccacctcggtcagtaactgggttgaataaagtgggtggctagtaagtgagattttaaaagatacacattttgggatgtttgaaatattcttttttattttattttttttgaaatattagacttgtcaagattttttaaagacactttaaaatattttgtttagacttttttataagtaaatatttaattgtttaatataattaaatatttctatgcttagtgtttgagtgtacttaatgttgagttcacttgagctgtttctgcctttattttcatagagtcctaatgagaaacctcttcattggtcatttccacacaccgaaaaatcagcgtcatgaagtgttacggttaatggggagcatcctgggcgtcagaagggaggagatggagcaggtgactggacgatgaaagccatctgaacacattcataatccagatagtggctttgtagacaattacttccttttactgtatgtaacttttactgagtgtaattttctcagtgtggaaatggaattacttcatacaacattgaagaggcagatttgttcaatatgtatgatattagtttaaatgttttgtaacttacaaactactcatatcaggatgctgaaatgttgaaatatccccagactttcatttgagatggtgcttgggatggcattttattgtatttgtagactctatcagtaggaaacatttactaggacttgaacttgaaaagcatgctttacaactatcagaaattatataaaagtggtccttgtttttttttttttcttgtactgataatatttgtctgttttaaaataatctttcagttgtttcatgacgatcagggcggtgttaccaggtggatgactgggtggcttggaggaggatcaaaaagtgttcccaacacacctttgagaccaaatcagcaatctgtggttaatagtgtaagaaacaattttattcttgcttaaggtgaatagtaaaatgactgtatattacattcatttgcaaagaatcagatttttttttaaaattattttatacaacccttttattttgaagttgcagaaactgagttccagagaggtgattaagcttaaggataacaagccagttttcataactttattgcatataggttttattttaactctatatggtgcttttatttttcaaaatattaacttttcctttgtacttgatcatgctgccataggcagtcttgctactaaattatagtagcaagatagaggatttattttattcgtctatgtatgttccaaatcgttgagccagtgaatacttactgagtacctgctgtgaactagactgttctaagcattgaggatgcagctgcaaactggatagaaacggcgcctgccctcataaaacttagattctcgaaggaggaagcagttaataaacatgaaaacacagtgcctggtatgttgtaggctctagatgaatattaattgaattgagtagtagtatcagttagaatgtggagtttctttctcttagcttttgttttgttttgttttttgagacagagtctcgctctgtcgcccaggctggagtgcagtggtgcgatcttggctcactgcagcctcagcctcctgggttcaggcagttctcctgcctcagtctcccgagtagctgggataacaggcgcccaccaccaccacgcccagctagtttttgtatttttagtggagactgggtttcaccatgttggccaggctggtcttgaactcctgacctcgtggtccgcccacctcagcctcccaaagcactggggttacaggcgtgagccactgtgcccggcctctcttagttttttaataaagaggacacgaaggataggtgatttacccagagctggttaaagataaaaccctattttacttggctggcataaaatttaatttaaaggaaaggtctacactacattattttaatctgacaatgttatttgtgatcttttgttattatattcattggttagacctgactagaaaattatgtctaatgtgtgttttcctttcatataattttttatgtttgtgttaatagttattaaaatgatcagattcattaagtgctattcattgatggcaagaaaaataagtattatcagttggctaattctgaccatgaggtgttagaagtgagtgttaccatcagactattgattaaattgttaaatttttgtaatgatgatcatctatctaaagtgctagtattttaggccaggtgtggtggctcacgcctgtaatccccgcactttgggaggccgaggtgggcggatcacagggtcaggagtttgagaccagcctaaccaacatggtgaaaccccgtctctgctaaaaatgcaaaaattagccgggcgtggtggcgtgcacctgtaatcctagctacttagatggctgaggcaggagaatcacttgaacctgggaggcggaggttgcagtgagccgagatagtgccattgcactccagcctgggcgacagagcaagacaccgtctcaaaaaaaaaaaaaaaaaagtgccagtattttcaattgttcataaagctgatttgtaaaaaaaaattattcaagtggcatgattaatttttaatatttaattagaaaagctggtacatttccttagttgtagtgaatataacttaattatctagcctaatataaccaaaatattttttcttagtctttttcagaactttttgttaaatttctagaaacagaatctcatccatccattccaccaccaaagctttctgttcatgatatgaaacctctggattcaccaggaagaagaaaaagagatacaaatgcaccagaaagttttaaaggtaaaactagagatttaatttttctataatttgaaaattgaatgtttaatgtatgattatgtttcacagtgatattaactaaatttttagtatttttggaaatgtgtaatcaggacttccagaattccaataaggcatcaggcttttccaataaggcatcaggcttttgcttcatatattcttgtagcaatctgatatttaattgacttagattaatttaaatggtaagaaatatattccctttgtatatcagaataattcttctctgtctgcctaaccagctatgaattattcctctggaagtgatggggaattggttacatctttcttggccacctgctttgctttctcactaatggtggttcttgctaatccgagttagatgtgtagtttatagtttgagaagggtttttctcctttgaaaatttaagtgctacactcagtaaccaaacattggcatgttaatatatataagcgcagtttaacaaactgacttgagactccaagaatgtagaaagcactcttttatgttgaaagatctgcctagagcggacggttggtggtggttaacgtgtacatatttttctgtctcactaaattgtaagggttttatttatgttcatatcatatatactggcacgcaagaaaatttatcaattgaaattgaattataatctgttggactataaacaaattctttattggaagagctcttctgaaatcttcatattttaatagactaatatgtttactaattggactgtaaaggtatatgttatatactcatatcacacatcagatgcttaaatttggataaaataataaagaatttatattctgaaatttttgaaacttctgtcgtttagacaaatatttctatttttctgaacttgtataggaagggaaagtagtaaaatttatcagtcctttaggtagtaagtagttttgcctgctaaattttgtgaaaagtcataactttatctaagaggtgtaggctatactgaaaacagtttttcttttacactaggttgtagcatcttgaaacagattcccaaattcattatggcaggctctttcccttcctctcttcccttccccttcttttcccacccttcctttcccttttcttcccttctccttctttattctccctccctctccctcctttccccttcttttctctcacttttcttcctctttcctacctttcccctttcttgtatcaagtccagtgcccagcctgatttgtattgataggatacaaaagctggtgatggcttgggttgatataggctttgcatgaacaaagcaagcttaatctttaatcttgaatttggaagtgtgtcagagctcactaggtaacaccagaagcttgcccagagttcggaaagttgtcattcataggaaagtacggcttgggaaccctaagagtgctcaatgataagcagatttgacaaatttgtcttagtgctttctttgctttaggaggtcttttttatttgagtttcccattgctgaagtaggcaccttcaaaggattgcttgtctgttaccattgaagttgtcagaggtcttgggcattaaagcagaatctgtccactaagacattaggaatttacctattccaataaaaaggaattgtattagcccaacttcatagaaaaataatctaatcaagattgttttcaaacctttgactgcctaaaagatgatcaggtaaggtatgtatatattgttttttcttctggcaaatattaattcaactgttatcattgtaatatgggtttgtttttctttattgtaattatttggggagaacgtaactccttaagcctttcattattcagatgggtaagtaaagagtttgccttgcaacatagatgacaccatttaaaaagctgttgttatggtaaatgaagttcatcagttacataactggtatttaagtataaaacaagagctgtaatgtgtttaataaggtattagataagcatacaaatattcttctcttgccttttctttccctattcgttcctcttattccttatcctctttcatcctcctgtatttcatagaccttgcttgtgggatccagaaccccgcagcatatgaattaaatttacttgggggccaaatctgggaacttaaaacacatgtatagcattgtttttttatcagaaaatgttttgaattaccaagagtgaacattagtcagattttagccatacaaattagtatttgtgtttaggaattgaggcctgtttgtgctttcatttttttttttaattttaattttttgtttttgagatggagctttgctcttgccacccaggctggagtgcagtggtgcgatctccagtcactgcaacctccacctcctaggttcaagtgattctccagcctcagcctcccaagtagctgggattacaggcgcccgccaccatgcccagctaattttttattttgtgtttttagtagagacggcgtttcaccatgttggccaggctggtctcaaactcctgacctcaggtgatccgcccacctcagcctcccaaagtgctggggttacaggcatgagccaccgcgcctggctgcgttttcattttgaataaagaccagtccaaaaagatgtgctggatgccagtgttattaccgtcaagggagaatttttaagttgataagtgatacattgattatttttatttatctatgctaatcaatttaacaatattacacagataactttatgctattacattcagagttatttcattttgacttctttgtgaaagataggagactaaatccatattttattctttagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgaggtgaagtatgtatttggtcctgtgcaatattatcatgtgtgtagattctttttttgtttgttttaaatagagatggggtctcactatgttgccaggctggcctcaaactcctgggctcaagtgatcctcccacctcagcctcccaaagtgctgggattaaggcatgagccactgcgcctggccctgtgtgtaaattcatgtgactaccaccacaggcaagacacggaagacttccattacaagcatccccctgtgttgccctctcataatcattgccacctctctccctggccctctccttaatccctgacaaccacttactgttctccatctcagtcattttgttattttgagaatgttatataaatggaatcaatatataccctcttgagactggctttttttcactcagcataattcccttgagatccatccaaggctttggatgtatcactagtttgttcctttttattgttgagcatatagtgcagatatatcacttagttttaacagctaaggtatctatttaaagataccatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgcctcttggtttttgcctattattatttctctgtgagttgttactccttggtttttatatgctcctaacaaagatactttcactgactatcctacattatttgctgcttgccattgaaatttcatttcagtgtggagaaatgaaatactagtttctaagttaaaaaagacacatggtcctttatttttaagaaatagaatatgtaaaaagttttctcttttaatttgaaaaagagatgcatggttggtatttaagtagtatgtcatcatatttgaaatgccttttgtgacatttttgagtatttccttctctgaccaaaacaacttgtccgcctctcatcccatggtttaacgtaagtttaaaagctgttgtgggtggattgcat

SEQ ID NO: 12340 - DNA, 29165 bp, Human
gcgtcaccgacggacagcaccggttccgaatgggagagccgataacgcttaacccccagctcactctcaccaatcgctataaagattgtccggatgtgatttaatgagcagtttatctaaccaattgtcatggatctgatatccggcccttaaagcggaatttctccacccactcttaactgtccgggactacattacccagaatgcagcgggagcagacaagggccacaaagcattaaataaactacctttcccagtatccccaaggacggacttcctcttcttgacccagggatgtggctcccagccagagctgaggcttttggtaaacacacgcatctgttcaggcctgacctgttttcctaatcttcctggtccacagagaggcctaaagctggcctcaggttaaagtttgaccctaggatgacctatgaccccaggctgagaccccagccttaggctaagccttttattccagagtgaggcaattggagccccacccccagattccaggctagaccggactccgggctgaactctgaccccaggtgaactccctctctgcaagttgagtcctaacttcagcctgaaactctgacaccccctcgtcccccacaccacacactgaggcttaatctctggtttaggccaccgatctggactagccctgactccagattggacctgaccccttaccgggttgctaatccttctggttaagcctctggcctctatcccctatccccacggtggtgctgacctggactgaaccccaattccagtttgagtctctgagcagaggtgaactcagaactttgctaggctgagcccccatttgagactagccacagaactcactgggttcaattgcccaactgcaatcagacattttctagctcagaagccaccagcaggtggggccaggtctcagcagagacatcagtcccagtgtgggctcccaaggctctcctcctgggctcagctgtatctctctgttctgggagcctgggtgctctgtgtaaggggaacgtatacccaagggcccccctgcaagacgcccagccttgtctgaggctgcagagaaagcgccaaagcccggagagaatgggagtgggaatccccagtgcctcctctcctctttcattccagcacctcaaagggatttacaaggtgtgaacagacttttatgggagaggtgacagacttcccttctccagggcccagatggcccagatgtctgggggaggggcggagtcggaatctcaggggcagtactgagaatgaaaccaggttaaactggaaaatgggcagatgcaggcgcgaactggaaggcagctggggaaaggcctgggcctggcgccccaaggacggcctgtcttcagtttcccagcggagactctgggggagggaaggcaggatgcggtgcgggagttaatggacctggccttggcgaaggcgcgtcctgggttggatcgaaaccctctcatccgccctgtggccggagggaccagaccattagtgggacgaacctagacgcctggagccgggccggctcgcaagaacggggtgacctcaggttgcccctgcaatggggttgaggaaggacttcttgagtttggggttttagtgtcttggccctttaaggaataattgcggggaaaggggaaaaggagatgggaagaaccgtttggagcggggaaggaagatgagaggacgagagggaccccggggatttggaaaaaatgggtgggggttctttaaggggtcggtccagcggcgtcgagtggcaacgttgctttaaaagggggcggagcgtccgttgggccccgcccccgaatcgcagtgcttgggctccgcgcgggtgggggcgtggcagagcgtgcaggggggcggggaagagtctggggtgggcggggccgggcggggcggggcggggccaggcgcaccgccctcggctgagtctccccggggagggcggcgggcggcgggcggcggggaccgggtgcggtggtggctgcggcggcggcggcgggagcagcatggattggggcactgagctgtgggtaagtccaatcggcccgcctctaagttcccctttgctggggtccaggcaccccccttttgtccccaatgtatcttagagggggctccgcgcctttcccttccaccgacccctgggtccccgccctccaccctccgctctctctcgaagtttatctgggagtctcagcacgctcaggggcgaagggcgactttgccggaccggagtggggaaactgaggcacagggttgcgaatgaggcgggcagaaggaatcctggggccaggccggggcggctgagagaggtcacctattttgggcgccctggccgggcaggcggcttatcttacggcccctgggtccctgcccgtcgtccgcctgtccggctaggaggggggaggggaccctctggtcaccctcatccccacccacgtgggacctagaagtcctgaccgccctttccctcgcctttaatcaacacctaggggctggggacgctcatggaggggaagggggatgctaagctcggcctgatccccctccctggcttccccctgctcaccccaggcccagggcgggaccgccccctggtcgcctataacctcagccctggaagccccagaaatttccccctatcctagccggacctctgacccctccccttgctgggggcggtggaatccctgagttcttagtgcagcgggggtaaccagactgccaccccctcctccaattctgcgatttcttttggatgtgtagtggggtcagtggggtaaattgagtcacccatcgggggatccctggaagcagggagattcagggaacctggtgcctgccccctggccactcaggggcccccagtctgccaggaaccctgcccctctggccttgactcacgccgggccggccggattttccggaatccggggggattaggggagcccgagctgggggagtggccctgtccccttccacgcccctcttggcggtcctatgtcggagacctccatctcccggccggggtggctggggcctgggcgctgttctccggcccttcccgggaaggggagggggttcccgccagtttcctgcctccccccgcgccacgccggggcggcgccgggaagccactccttctaggagcgcagagccttggccctccctgggagtctggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcggtgagaccctggggtggacgctacggaggacgcgcctggggcgacggggagcggtgggagggctgcgggctcagccctcctacctctgtctccccttaggagcctggtgaaaaaatatctgcccaagagacctgccaaggatgatcctgagtccaagtaaggttggagaggggctgcagggctagatttgtggggaaaggcggtgcttgggtctcacttcccctccctcagctgggacaccccaccgctcctctcacttccccttctagaggtgagagcatggatgcaagatgcgggattatctggcttggaatcctgagtccactactatgtagagaaattgacttgggcttgtgactcaggttttctgccactattttccttaactgttaaatacagaggccccagcagttacaaaaccagtaactttgggcagatgacttaaagttttgcgcctctgttttcctcatctgtgaaatggaatgatgacgattcctccagctttgtagggctttcatgaacacgagctgagtgaatgtgtttaaacagtgtgcagtccatatcaaacgccgtaaggagcatttgacttggaattgagtccccaattccaaaatccaaaaaagccctggaaatcaagttgttttggtcacttgtttggcagcaatctctgacctgaactttttgttaattgtagttgttttgttttgtttttgacagagtttcactctgtcccccaggctggagtgcagtggcgccatctcagctcactgcaacttccgcctcccaggttcaagcgattctcctgcctcagcctccctagtagctgggattacagtcacctgccaccatgcccagctaatttttatatttttagtagagacagggtttcaccatgttagccaggctggtaattgtagttttgacttttatcccacttagtgtgaatgttaacacctctcattgtaaaattaaaaaaaaaaaatagggttgggcacagtggctcacacctgtaatcccacacattgggagggtgcgcaggtggatcacttgaggtcaggagttcgagagcagcctggtcaacatggtgaaaccttgtctcttctaaaaatacaaaaattagccaggcgttgtggtgcgcgcctgtaatcccagctactcaggaggctgaggcatgagaatcgcttgaacccgggaggcggaggttgcagtgagccaagatcgcaccactgcactccagcctgggcgacagagtgagactctgtctccaaaacaaatagatacggtgtttgattacaaaatgatgtccccaaccccactaagatgatgcagaaaagatggtataagctttgtacaccatctttaaaaactggaaaattctgtgttccaatatacattcgaggtccagtgcggtggctcacacctgtactcccagcactttgggagggtgaggcgggaagatgcggagttcggggggattggagtttgagacctcatctggaaaaaaaaaattagccaggtgtggtggcgtgtgcctgtggtcccagctatttgggagcctgaggtgggaggatcacttgagcccaggagtttgaggctgcagtgagacgcaatcatgccgctgcactgcagcctgggtgacagcaagaccctgtctcaaaaaaaaaaaaaaaaaatctactcaagggttggggttaaggaatatggaccagaatttgtcatcgcttcaaggattacattcttggggcttaacccttttccacctggaggtgcgtcctggggcatcagcctgctcgggaggaggggcctgactccctgttccccgattctcatccaaccccagattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatggtgaggagccccccgattcaggttttacaaagggcttctgctggaaccctggcgagccttatcactcttctttctgtagcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccctcccccataggcttccagtactcccttgacccctacttactggatgacatcccaataatccctgaaaccttggtttcccaccctgctgtctttgggatggtggctccctcactccggttctgtcccctacacagagtaagcgtaaatttgagcgggactgccgggaggcagagaaggcagcccagactgctgaacggctagaccaggatatcaacgccaccaaggctgatgtggagaaggtgtgtgtggcgggggcgggggggcggtgcggggtctgggacaagcttggggagtccgagtgggacgtgatcggaacctggcagtaccttccacctctgcattcttcaggccaagcagcaagcccaccttcggagtcacatggccgaagaaagcaaaaacgaatatgcggctcaactgcagcgcttcaaccgagaccaagcccacttctatttttcacagatgccccagatattcgatgtgagtgctcccagttctcagacctaccttcccgaaagcctccaaatgttagccaactcctacgcattcatcaaaaccccagctgcaatgtcccagtccctagattgaaagggaatcagaaacctatagtaacagtgagctgtgcttttagtcagctgttcttcctgctgggcatgccttttacttgtttgtttatttacttctatagagagatggggcctggctctgtcacccgggcaggagtgcagtggcataatcacagctcactgcagcctggaacccctgtgctcaagtgacctttctttctttttgaaattcctacttattcttctaagctccacctctaacaacccctctgaaaggtctcgaatttcccctctcctgtttcaatctagcgctccactctctgtcccatccgtggccctgggagtatcagggctggttctgctttttcttcaaatccctgttcccttgtctcctcctttgagaagcctttgctgaccccctaggcacgcgtccccctctgagatccccctggccctgtgtctcttccccaaccacagtgggctggagtctctcttcccgactctgtcttcccctccagactggcttggggctggggccagcgtggagcgcgatcatatttgcagagtgaatcactgtgcttctagtccctctgttagcacccctgagccacccttgtccctgtccttacagaagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgtgggtgcctggtctgggtccactgggctacgggaagggcagagggaggtccccataggctaggcactcgactgctcatccactgtccccctcccccaggactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaaggtgggggccgggacccttgggatggtgggggagaaggacagtgaagtggggacagtggggcccctattgagtcagccccagccgcctgaacgccgagtcccgggcaggaattttcctcttggctgccagcccggactggagggaaggaaggcggccgattggcctgggagtcccccgaggcgaaggcgggggcagggtggggaggtggggaggtccgtggcgtttgtctgctgcttctcgggatgctgggagaaaacctgctggtggaattcagggctggcctgagggctggtgacaccatccctggggactccccgagtttctctctccatcctgctgatgggactctgggagccgccctgcatgtcttgctttcttgggtttttggattttaatataccttagcacccttggtttatacctttgatttatactttgggtccctcttcacttacactctcatacctctccttgacttaacacctgtgatccccgagcttaaacttctgatgcccctaacccctctcattttcctgccttccactccctctcggcttgtggttttatttttgtttatttatttttgtcctctgtggcctcttacctgtctgagaccttgattcctgcatgcgtcttctagactgtcagcccagaaagctaagtggacagagagacatgggcctccctgcctcctggacccatgcttgctcccggacataacattccagagacctaggagataccgggggagtgagagttctggctttcgggcttacagttcaacatcctccccgccaccttccagatttttttgtgtcgctcctgcatgcgttttctctgtgtggttgtgcatcttgagttgtggttttcttaccgttttttttctttctccattttgtttttcctttttcctttttttgcgtccatccgtccatccgtgcgtccatccctccgtccattcgtcctcactctctacatcctcctatgcccccccaccccttcaacctatccccctccccggcccccgccggtagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtggggtaagtgaggcctcggggcaggaggaggtggtggccctagcctgcccagcggcgggtggcgggaccctgggctcgcttcctgccgctggctgggcccctcttccctggttgcccaacccagacctgctttgctctgtgcatggcttcgctgtcaagaaccatggctggggaagggagtgaaatatctcagacgggtgcagagtctggcaggctagactccttgatcccaaattcagccctctacccaccttgcagacagtggtgaccgaggattttagccacttgcccccagagcagcagcgaaaacggcttcaacagcagttggaagaacgcagtcgtgaacttcagaaggaggttgaccagaggtaaggtggtggggtagggaaggacaggcaaggaacatgataaaatagtaaatgaacttcacttatttgtttattattttattttatttattttattatattttattttgtgacagggtcttagtctgtcgtccaggctggagtgcagtgctgtgatcttagctcactgcaatcgccacatcccaggttcaagcaattcttgtgcctcagcctgccgattagctaggaccacaggcatgcaccagctaatttttatatttttagtagaggcggggtttccccatattagccaggctgtcttgaactcctggcctcagttgatctgcctgcctcagcctcccatagtgctgggattataggcatgagccactgcccgggtctgtaaatgaatgacatttaaatggtactcaaagatctccccaataatcccaaggccccgacggttttacaggtgattcctaccacacttagttacttcttggccaggtgcagtggcctgtgcctgcaatcccagcattttgggaggttgaggcaggaggatcatctgagcctaggagtttgagacctgcctgggcaacagagtgagaccccatttctagcaaaaataaaaaaattagctgggtgtggtggtttgtgtctgtagtcccagccacttgggaggctgaggtgggaggatggcttaagcctgggaaatggagactacagtgagctgtgactgcaccacttgcacttcagcctgggtgtcagagtgagaccctgtctcaaaaagaaaaaaagaaacagttacttcttgtcttatacaagtcattccagcaaacagaaaaagtgtgaaagctgtcaacctctttaggctgaagaatcctgattcccaaatctgtggccaagaattcaataagataaaattaagggctcattttaccttatttatgatcatagaggcaaaatcctagccaagcaaatccagtgtttaaaaaataatacatcactttgggaggccaaggagggcagatcacgtgaggtcaggagttcgagaccagcctgaccaacatggtgaaaccccgtctctactaaaaatacaaaaactagctgggcattgtggcacgcgcctgtaattccagctactcgggaggctgaggtgggagaatcgcttgaacctgggaggcggaggttgcagtgagtcaagactgcaccactgcactccagcctgggtaacacagcgagtctctacctcaaataataataataataataatacattagccgagcacagtggctcatgcctataagcccagcactttgggaggctgggtagaaggatcactcacttgagcctaggagttcaaggccagcctgggcaacgtagtaaaaccccatctcttagaagaagaagaagaaaaacccaagtaaatttttttaaaaactaaaaaaaaaaaatccaccattggttgggttttatcccaataatgcaaagatagttcaatatcaaaaaatgtatccatctagttcaccacattaattggctaaaagaaaagcagcatatggttatctatttaatagctcaaacacttaaaatattgacaataaaaaaatctggcagattaaaaaaaaaatctttactcactctttccaggcaacaaaatcctcttcccagttctgttacataataggaatgatgtttgccacttgcaaacaggcagccaaattatattttgccatttgcatgtaacctcttggacagaatggcttttattggtgtaaagttccattcagaactctctagttcctgagtttctacggtggaggggttaagggtgcatgttctagagtcacgacaaactggacttgatttccagcttcatctcaggacttgggcagcctgttttaccttttaattcctcagtttcttcatctgtaaagtggatcaggtattagaactggaatgaagttggcagggtgcagtggtttatgcctgtaatccaagcactttgggaggccgaggcaggcagatggcttgagaccgagtttgagaccagcttggccaacatatggaaatcctgtctctactaaaaatataaaaattagccaggcgtggtggcgtgtgcctgtagtcccagctactccagaggctgaggcacgagaatcacttgatcccgggaggcacaggttgctgtgagccgagattgcgccactgcattccagcctgggcgacagagtgagactgtgtctcaaaaaaagataaaaaataactggaaggaagttgagctcagatctggtcttttccaaaggtccattatagtcgtgactacctgtatatatagacataggggagacagggatgagaaactgatgataatgataacagtatttattagtcacttactgcattctaggcactattcgaaacagtgtacatggatttattcgaattttcaaggtttcctgagagattgtatgcagacttaagatctgtcttgtttagtgttatatttatctttatttattttttcccctgcccccccttctttttttattttttaaaaattattttgattttttactagagacaaagtctcacaccattgcccaggctggtcttgaactcctggcctcaagtgatccttccacctcagcctcccaaaataatgctgggattacagatgtgagccaccacggccagcccagtgttatatttctgatgcttggaataggacctgtatgcagtaggtactcaatatgtatatgagtaatagtgaggacttactaggtatcaggcattgtattaatcctcacagtgacccacatgagatattaggatcattatctccatttccaaaataagcaaacagcagtgggggttcaatgatttaagccaagctcacacagctaggaaatattcaaactgagattcgaacccaggcagtcgggcactagtatttgcatccttaaccattgtcctgccttgctatttgctccttgatgcaaaacccctgttttttgcttgttaaatcacatggagcccggtgctgtggctcatgcctgtaatcccagcactttgggaggctgagccaggaggatcccttgaactcagcctgggcaacatagccagaccccatctctactaaaaatttttgaaaaatcaggcgagtgtggtgatgcgggtctatagtcccagttactcaggaggctgaggcaggagtatcacttgagcccgggaggttaaggttgcagtgagccatgattgcaccactgcacaccagcctggggaaagagtcagaatgagaccctgactcaaacaaaacaaaacaacagcaacaaaaaaactcacacggaagtatgttttcctgtctatcctgtctcccttgtcatagggaagccctaaagaaaatgaaggatgtctatgagaagacacctcagatgggggaccccgccagcttggagccccagatcgctgaaaccctgagcaacattgaacggctgaaattggaagtgcagaagtatgaggtcaggaaagaccctggggaggggcgggagccagcgggcctggctgagtcactgctgggtggggtggggggtcggggacaggggaggtgttcggagcggggggtctccagctgttttccatcacagccttggctgtgcgtgggtgatctcagggaacctctgggtccaaagtgggctgaccccggagctctgccctggaacgattttcctgtcccctcctcccaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagaggtgaggggtgacgtcagagtgggtctgttcccagggtcccaggagggcctgtctttatctgccgaattatccccaaacagctctgaagagcctccctcagaagagagccaggacacccccatttacacggagtttgatgaggatttcgaggaggaacccacatcccccataggtcactgtgtggccatctaccactttgaaggtgagaacggccagagtgggcttggcggggtatgggaggcagtgtctctggctaggttcagtttaaattcgcctaaagcagggctgggcgggtggctcaggcttgtaatcccagcactttgggaagctgaggcaggcagatcacttgaggtcaagaattccataccagcctggcgaacacggtgaaaccccatctctactgaaagtacaaaaattagccaggtgtggtggcgcacgcctgtgatcccagctactcgggaggctgaggcaggagaatcccttgaacctggaggcagaggttgcagggagccaagatccgtgccactgcactccagcctgggcgagagcgaggctctgtctcaaaaataaaaaataaaaataataaattttgcctaaagcagatctgggcccacccccacccccatcacagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagttcaagcaattctgcctcagcctcccaagtagctgggattacaggcacacaccatcatgcccagctaatttttgtattttttgtagagacagggttttgccatgttggccaggctggtcttgaactcctgacctcaagtgatccatctgcctcggcctcctaaagtgctgggattatggcgtgagccaccgcacctggccaggacacccaagtttcatcccttctgaatgcactgcagcttctgagaatgggtagcacttattgaagacctactgtgtgccaggcattctccacctggggtctcattcctggccacaattcttagaaagtacacagcctcaacttttacattttttaaaagttttttatttttcagtttttgtagagatgaggtctcaccatgttgccctggctggtcttgaactcctggcctcaagccttccttccgcctcggcctcccaaagtgctgagattacaggcctgagctgctgtatggctatgattttgttaaaggccgacacagaggtgaagtcaactgctagaaatcacggcttttaagaggtggagtcacatttgaactctggcctctgatgccagatctgcaggtcacatgttcaccatggtccaggtgaccctgactgcggtccccacctcttctgtgaggcacagggcaggattccacctgaggcgcgaggagcctgggacgactcctttggtctcttctggggttcgcaaaaacctgggggtcccgggtgtgaagaagggtgtctgcgctctcagcggtcaggctccaggcgctgcgacaggacgccgaggacgcgctggaacttctcaaagcgttcagcgcgcggagctcccgcgccccggctaccccagagcagcctccgcacgaagccggtggtcagggcctccctcagctccgggttaggccggaatcctggaagcaaggtcaggtgggctgggggcggggcccaggcgcccgcctcgcccctcccaacctcccggcaccttcctttccccagaggactttgacccaacaggggcccgggagggacctgccccacctgcgggatgactaggcggggtcagaggggagggggcttccagctctctgcaggaatgggggtggggtgcctgaggggctctaccgcagtgcaatggggtggcctgttccaggtgccagatcctggaggtcccgccttaggggctgtgcctggacgtggggctgccccgaggacgggatcccaggttgtcggggaaggtggggggatcttgccgggtgggctgccctaggataggacggaggagtcgttttggagggagcagggcgttcttggggatcgagatccctgggggacgggatcgtcttaggtgggaagggggagtggggacccgcggaggtggctctgggggcaggacagcccgttttgaggtggacggccctgttcctatcaataccgctggatgcagcgtttgcttggggtgagaaccttcctggagtggagccgtcccagtttgggtggggctccgggaggcgtggcgagaggctcccctcctgggacaggctgggtttgggggatccggttagaacctgcagggtgctctgaagtctgcagtccagcgcagagggaacgctcacctcgcaggcgctgggctgccaccttgcggaatttgggtgcgtcccggaccatgtgacgcgccccgtgcagggtgcgcaacagccgctcacagctctcgtccagcggccccgcgacttcctcgccctccagtaggcgaaccatgggtgccacgtgcggcagcgccacctcgccggggtcgcagggtcctgcggagggggagggtctgatcagggtttggggctgtagatggggcatagggcagaggtggaacctaggacaaatgcaggggcggggcttaggactgagcgacagcggggtctgtggagaggggccaggaccacacgccccgtatggagggcggggcctatggcgaaggggcgtagcctagggaaaggggctgggaccaaggctggtgggggcgtggcctaggaacaagtctcgtgtggagggcggggcctagggaaagggccaggaccaaccctcatgtggagggcggggcctatggtgaagggaccgggcctagaacagatgcagggactgggcataggactagattgagtcctgttaaatttggtctgggcccccaggggatgctaagccccagaccttcacttaccagcgccctcatccagagcccgcatcagcggcttcagctcctgctcaaaggccagcgcagcctccgtgtggctccttcggagctggcgccacgtgtgctccaaccgggacacctgggagaagagatctgagcacgcctcctctccagtcttcccagtcacccgcactccagcttcctccagtccctgctccccacgaacctggggcatgagcagggcgcccatgactgcagccagcccgggcaggtcccccgccgcccctggccgcagcgccagcgccagctctaccagtcccctcagtgcggctgcgcgctcctccagcggccccgagcagcccagcaccgccagcgccccggccagcgccagtgtctgatgcctgcagaggtggagggcaagggtctgggggaagtggggaggtttgtaatgcaggggtgaggggggacaggaggtggcattgccccatctcccttcttccctggggaaccatgagtggggagctgtttggagatcttgggaagtggggggaattggcctcccccaaccaagattacaagctgctggctcacctctccagcagttccaacctcaagtggtgtccatggggaagagtgagcagctccaggccagatgagactcccatgttgccccgctgatctctggtcactcccaggaggcctgtggcctgcagaagggaatggggaagtcaggtgaagagtgattatgtaggcatggttgggtcttgccctgggcctggggaggagcatcccaggaggtgacccacctggcagtctaccaatagcaggtgaagggcggtgctcccaggatggtgctccaggaacaggccacggagggtatgcaggacttggggttccaggggccgattctgggggcccagcaggcaggagggggcatcatgggggcagaaagagatctcagcctgtggtcttgtaaaacatctattctcttcctcctcatcctcctcggcctcccaccatggggcctctggctctgggcagctttggctcggggatgttccctggacactgggcactcggggcaccagctcgcagtacgtcgggggacgttcagaggcatcaggcagttcgaaggagggtgtccgggggggcttcgttggtgccttggcttgaagctgcccatcggaggccctgagactgtcggcaacagttcccaggggagcaggggccttcagcaacaccgggtcactgctcgttcggggcaaggcagatatgggcatggtggaggcttctagaggtcatacaagaggggtcaatgggaatacacagggaagattgctgaatgggcgggggtgagagcttcatcggctaccacccacctgatccatccactcattccaataatggggtataacaacctatccgggtgcagttttgaatttcaaccacctcgacggtagaaatgctacatgcttacacatggttagaaaactttagcatctctatagttctgtaaattatttttttttaattttattttattttatagagatgggatctcactgtgttgcccaggctggtctggaattcctagtctcaagcaatcctccctcctcggcctcccaaactgctgggatcacaggcatgagccaccttgcctgaccctatgaattctgaatactacattttaaatttgaattctttgtttttgcccctctgactgaaagatggtaagcagtgacccaacgaaattaaaaatttttttaaaaaaaggatgagcgtggtggccgacgcctgtaatctcagcattttgggaggccaaggtgagaggattgcttgaggctagggattccagaccagcctgggcaacataacaagatcttgtttctacaaaaagttagaaaattagctgggcatggtggcatgcacctgtggtcccagctacttgggaggcagaggtgggaggatcacttgagccagaggctgcagtgaggtatgactgcaccactgcactccagcttggatgacagagtaagaccctgtctcaaaaaaaaaaaaaagatatctatctatctacaattaagtgatatatctctctatatcatatctatagagatagatatatattatataaatatataatatatatttaaattaagtatatgttaaataaaattaacattattaaatgtataatgttgccctatatactacatataattacatttatatatgatagatattttactttttttgtgataatatatctctccatagacatatctatataaaatatatacaattaatatagatatctatagagagacaaagtataaaaaattcacaaagctgcgtatggtatgacactcagataagtgtcaaagaaaccaagcttattaaactttcttttcttttttttcttttttatttcttcttaaaaaaaaagatacatgtgcagaatgtgcaggttcagtatctgtgtgccatggtggtttgctgcacctactgacccctcctctaagttccctcccctcatcgtaaactttcaaatgacgtcctttgtaagttggtggcatgttgatctcctggactattagtacttaaaactgtactaagacttttgggagactgtatttaccatgcctttgaataggctcttttctaggaacttgaaatcatccaacagtgcctggctcactctgagttaaggtccaaagtgctcacagtagctgaaaaatcctcacaatctgagccccagggtctctctctctgactctcccctcattccctctgcttcagctacactcgtgtgtccctccttccctccctcccttcgttccttccttccttcctttcttttctttcttgacggagtctcactctgtcaccaggctacagtgcagtggcgccatctcggcttattgcaacctctgcctcccgggttcaagtgattctcctgcttcagcctcccgagtagctgggaccacaggcgccaccacacccagctaatttttgtatttttagtagacacggggtttcaccatgttggccaggatggtcttgatctcttgacctcgtgatccgcccgctttggcctcccaaagtgctgggattacaggcttgtaatttctggactattagtacttaaaactgtactaagacttttgggagactgtatttaccatgcctttgaataggctcaacctgcacattctgcacgtgtatctttttttttttttttttaagaagaaattgagccattgcacccagccctttcttttcttcttctttttttttttttttttaaatttgagtcagggtctcactctgtggcccaggctggagtgcaatggtgcgatcacggctcactgcagccttgactttctgggttcaaggagtcctcctgcttcaacctcccaagtggctaggaccacaggcgtgcaacaccacacccagctacccactcattttttggttgaatgaacagcttaaattcttgttctgacccaagagcctttgcactgcctcttcctcctgcctgcttatcccccagttatccacctgttccctccctcatttccttcaattttatttttttctgcaatggggcctttcctgactaccacttaaaattgcttgcttgggtacaatggctcacgcctgtaatcccagcactttgggaggttgaggtgggtggatcacctgaggtcaggagttcgagaccagcctgaccaacatggggaaaccccatctccactaaaaatacaaaattagcagggcgtggtgcacatgcctgtaatcccagctactcgggaggctgaggcaggagaatcacttgaacccaggaggtggaggttgcagtgagccggtatcacgccattgcactccatcctgggcaacaagagcaaaactctatctcaaaaataaataaataaatagaaataaaataaaattgcaatatacatctccatctttatagtctctatctcccttactctgttttttttgttttgttttgtttttgttttttcggtttttttgagacagtctcactctgtcccaagtagcttggattacaggcatatgccactacacctggctaatttttgtattttattttattttatttttttttagtagagatgggttttcaccatgttggccaggctggtctcgaactcctgacctcaagtgatccgcccaccttggcctcccaaagtgctaggattacagacctgagccacctcacccttcccttactgttttttgtttgtttgtttgttttttgagacagagtctcactctgttgtccaggctggagtgcagtggtgcaatcttggctcacggcaacctctgcctcccgggttcaagcaattctcgtgcctcagcctcccgagtctcccgagtagctgggattacaggtgtgtaccaccacgcccggctaatttttgtagttttagtagagacggggtttcgccatgttggccaggctggtctcgaactcctgactttaggtgatccgcccgccttggccttccaaagtgctgggattacaggcctgagccactgtgcctggccttcccttcctgtgttttaattttcatcttgaagcaaacaaaattgccttatttttgtggttcatggtttgttgtcctctcgtggactgttggctcccatcgggcagggatctttgtctctttctggtttgttgatgtatcctagcactccgtgcagggcctgggatgcagggacggctcatgttgaatggggttgggagaaggatgggaaaaaaggggcatgagggggcattcaggtgagtcctcctttaggtaagaccgtcagactcaactgctttgaggaacttaccctggatggagaggagccactcaggaaaaaattaggggaatgagaatgttcccgtcactggtggaaatgtaaaatgcaaaggccccgaggcgggaataaaagcctgagggttcgaacaactgcaaggagggctgtgtgaccagcatgaggagggtacgtagcagaagttgttagcaaggtaagctgtggtcagaacaggtacagctccttggaataattgtaaacacttttttttttttttgagatggagttttgttctgtcacccagtctggagtgcggtagcgccatctcggctcactgcaacctccacctcccaggttcaagcgattctcctgccgcagcctccagagtagctgggattacaggtgcgtgccaccacgctcggctaattttgtgtttttagtggagatggggtttcaccatgttggcaaggctggtctcgaattcctgacctcaagtgatccaccggcctcggcctcccaaagtgctgggattacaggcatgagccaccgcgctcagccttgtaaacacacattttaagcacccacaaagtccctgcatgttttaagtcatcgtgattgtcatcattttctaaagcaagaaattgaggctcgaagaggtgcctgcacctgaccaagatctcttaggtggtgagtggcagagccaatccctgagccacaggccattctagcagacacttacccatcccagcggggtcttctcttgaccgccccatatgtgccaaatctgcaggctgactgttgctccacttccttgccctgggggacagaagtgggagaaacctgtagtccccacctaagcagtgtcccccaccaatatctgcaaaaccctgtgtccagttactctgtaccagtgagtctcaaccaatcaaggtgacctacgtccaggggactcttagcaacgtgtggagacatctttagttgtcacaactagtagcatctagttggatggagctcaggaatgctgctcagcaccctatgatgcacaggacatctccacctcctcccccacaactaagaatgttcgggcctcaaaagtcaaccaaggccgggtgcggtggctcacacctgtaatcccagcactatgggaggctgaggcgggcggtcacgtgaggtcaaaagttcaagaccagccaggccaacatggtgaaaccctgtctctactaaaaatacaaaaaattagccaggcgtggtggctcatgcctgtaatcccagcactttgggaggccgaggcgggtggatcacttgaggtcaggagtttgagaccagcctggccaacatggtgaaaccccgtctctactaaaaatacaaaaaattagccaggcatggtggtgcacgcctgtaatcccagctactcgggaagctgagacaggagaattgcttgaacccgggaggcggaggttgcagtgggctgagatcgtgccattgcactccagcctgggcaacagagtgagacttcgactccagagaaaaataaaaaataaaaaagtaaaaaaattagctgggcgtggtggtgcactcctgtaatcccagctactctggaggctgaggcaggagaatcgcttgaacctgagaggtggaggttgcagtgagctgaaatcatgccactgcactccagcctgggcaacagagtgagactcagtcaaaaaaaaaaaaagtcaaccattgagttggaaaaccctgcgagtgttgggtgttctcaaggaggcagggagactgtgagtacctgagaggctctatccgagctgggccatccatcagggtgtcctcgctaaagctgcgtcgcagaggcccctgccaagtcacaggcctggagaccacagcccctgtggcctgggacagtgggcgcctgcctgtcatataactgtgaaccagagccggtatgctggggaattgctcatcctccagttgaaagagggctgtgggtcggcctggccggggacgcagggccacacggaacacctcaaaatggagggctgagccccgccagcggcaggagatcacggggttgcccccacgggacccagaggcgcgaaccaggaagtcgccattttgctgaagaagagcttcagccttctgtggatgaagttcagggggcaggggaattaggaatgagtccagggcagtggttaatggtagctccccccaccattgcccccaccacccaagaaaagctaccccagtgaaacttctgtggcaggcaaagacggggaactttcacaccaagttctgtccccctttctcctggcacctacgtagactacatttcccaggttcccttgcggctagggttgtcatgtgatgagaactggccaatgggatgtggggtagaagggctatgggaaatatccagacctggcgcataaaaccctgctgcacaatcttataggttgtgtcccctgtctgtcagctgatatcccccaaagcccagagggatgacagagctacaagatgcacttggctcccaactgatttatggagctttgcatctctgcttctcaaccaccttggactatgacattaacatgttgactgtgtttagctggtgatatcttgggaatgtttgttacagccactagctgatgctgaccaatgcaacatctaatttggtaaatgcactgtgcttgttatgcaaatgtggcttcaagagaagccattagctggatgcttccagattggggccccctcttttataaacatttgcaagcagtcttatgccagctgtggtggctggtgtcaaaatagggtaggaagggtggggcacagtggctcacacctgtaatcccagcactttgggaggctgaggtaggcagatcacttgagatcaggagtttgagaccagcctgggcaacatggcaaaaccctgtctctaccaaaaaatataaaaattagctgagcgtggtggtgtgcacctgtcattccagctactcaggaggctgaggtgggagaatcgcttgaacccaggaggcagaggttgcagtgagccgagatggagccattgcactccagcatgggtgacagagtgagatcatgtctcaaaaacaaaaaaaaaacaaaaaaaaaaacaaaaaaaaggcttggggaggcaggtagaagggccaggaccccagagagaggcaaagtagagctgaacatggggtctggggactaaataatagatgtagcagacacacgtgtgtagcccttactatatgtcaagcactgctttaaatgtaaagggtgttaactcttgtaattcctgtaacaagggtggtaggtattattatacctttttttgttgttgttctttgggacggagtttcactcttgttgctcaggctggagtgcaatggcacaatctcggctcactgcaacctctgcctcctgggttcaagcgattctgctgtctcagcctcccgagtagctgggattacaggtgcatgccaccatgcctggctacttttttgtatttttagtagagagggggtttcatcatataggtcaggctggtctcgaactcctgacttcaggtgatctacccacctcggcctcccaaagtgctaggattacaggcatgagtcaccatgcccggcccatttttttcttccggccttttttttttttttttttttttgagtcaaggtctctctcgattgcccaggctgagtgcagtggagcactcatggctcactcacagccttgacctcctgggcttaagcaatcctcccatctcagcctcctgagtagttgggacaacaggtacatgccacccatgcctggataattttcgcttttttttttttttttgtgtagagacagagttctgctatgttgcccagactggtttggaactcctgacctcaagtgatcctcctgcctcagcctcccaaagtgctgggattacaggcatgagccaacatgcctggcctgctatccctatgttaaagatcgggagactgaggcccagagaggtcaaatgtcctgcccaaggtcacatacaatataaattgtagggtttggatttgaacctagggtgtctgggtctcaattatgggattttaactattaagttctactgcctctcatgatttcatgagatgctcagggtcccagaatttttgggggtgacaactgagtttcagatggaggtgggagcctcagatttatttgtttgtttatttatttatgtttttgacagagtctcgctctgttacccagtctggagtgcagtggcacaattgtggctcactacaacctctgcctcctgggttcaagagattctcctgcctcagcctcccaagtagctgagactacaggcgcataccaccatgtctggctaatttttgtatttttattagagatggggtttcacaatgttggccaggctggtcttgaactcctgacttcaagtgatccgcccacctcggcctttcaaactgttgggattacaggcgtgagccaccatgcctggcttgggagcctcacatttagagggaaataccaggaggtagatggagttcagagggagagacggccagagccaagagtagtttgggggcattaggactctccttaagctccatcaccaatctcatcatcccaaagaaagtgataatttaaatatagtgacagtccccagccagccaaccttcaagacagtccccagccctctgccacctgtcccaatagaccttggcactaagtccctcatccagggacccaggaatcctcagcaagggtgggagaggctccccaccagatggtgctgaggtcctgctgtgggtggtacctggcgggacaggaggccgtggtaccaaggttggccagcaaggtcttctccatcctgtggcacctgcatggagctcttgggaacagagggtgccagggctgagctctgcactttcaacaggcctcagtcttccacatctgtaaaaggggaataattagccctgcttgagtgtctgggtcagctcctttcatcctcttcttaattttggagacagctccatcaaatctttttttttttttttttttttttttgagacagagtctcattctatcacccaggctggagtgcaatggtgcgatcttggctcactgcaacctctgcctcccagattcaagcgattctcctgcctcagcctcccaagtagctgggattacaggcatgcaccaccacacccagctaatgttttttctttttttatatttgtagtagagacagggtttcactgtgttcgccaggctggtcttgaactcctgacctcaggtgatccacctgcctcagcctcccaaagtgctgggattacaggcataagccactgcacgcagacttttttttttacatttaaagagagaggtcttatgtgttgcccaggctggagtgcagtgctattcacaggtgtgatcatagcacactttagccttgaattcctgggctcaaggaatcctctagcctcagcctcccaagtagttgggattacagatgtcaccatcgtgcctgttccaaatataatgcaatcgaagaaaaaaaaaatggctgaagatgacaacatgccaccccatcttgcagaaatgtaattaatgaattcactgaacccctatttattcagcaccttatggggtcccaggctctgttctaggccctagagacatagcattgaacaaaacagatggaaatctctgtccttgggagctgacattctactggggagcagcacctcagaaaagaactagatgatggcatacatgagtgagtgctagacaaaaaaactaaaccatggatgggatataatgaaagtacaggtgctagggtgaacactcttttttttttgagacagagtcttgctttattgcccaggctggactgcagtggtgcaatcacagctcattgcggccttgacctcctgggctcaagtgattctcccacctcatccttctgagtagctgggactatgagcgtgggccactgtacctggctaatttttttttttttttttttttttgagatcaagtctcactctgttgcccaggctggagtgcagtggcatgatctcagttcattgcaacttccgcctgctggtttcaagcaattctcgtgcatcggcctcctcagtagctgggactacaggtgtgtgccaccatgcctggctaatttttaaaatatttttaatagagatggggtttctccatgttggccaggctggtctcgaactcctgacctcaggtgatccaccctcctcagcctcccaaagcactgggattaccagcatgagccactgcgtctggctgtgcctggctaatttttaaatatatatgtagagattgggtcttgccacgttgcccaggctgggtgaacatttttgatcatgtgaccaggaaaggtctcattgagtaaagtctggaaggaattctggggagtgtgccaggtgactctgggtgaaaaaacatcccagtcagggggaatttaacttacaaacatccatggcttctcggcaacctatgcgcacactcagaggttctcaggataggtgcagatctaacccctattctttgctttagaatgcaacgctgggggccaggcgcggtggctcactcttgtaatcctagcactttgggaggcagaggtgggtggatcatctgaggtcaggagtttgagaccagcctggtcaacacagtgaaaccccgtctctactaaaaatacaaaaattagccaggcatggtggcgtgtgcctgtagtcccagctactcaggaggctgaggagagagaatcgcttgaatccaggaggcagaccctgcagtgaaccgagatcacaccactgcactccagcctgggtgacagagcaagactccgtctcaaaaaaaaaaaaaaaaaaaagaatgtaaccccagggttaagatttttaaaaggtcacattttgtagcaatgtcagcaaacagcaatgttgcctttgcagatccttctatttcggagcccatacatgtggttatcatgatgattgaatttggatctcagacattttggtagtttcccgataatctcacaggcctcagggccagtgtgtctcaggtgtctggtgggggagatttctctggatggtccagaagaagataatctgcttcttactctcctgcaagctctccctgcagccctgcaaagtcttctggtggggtctgcagagaaattcctgcctcctgagtcagcaggaagttcccagaccagccctaggtggctttaggggaggagcgctgggcagggagccagctgccagtgccgcatacctgaagccaggtgtgtctttgcaatgcctgcgcacttcctgtttgtcacctggaccagggctagcctcggtcgcagagtttcccaaccccaagttcctgtcttgtgtctcccttagtgagagtgaagttgagtcaatggcaaggttctggttagtttgaggacacagggtggccataggtcagccaaaggccaactaagccatctcctgcctctgagtcctttgggatcatttattcgggcacggaagagaagaaacgggcagaatcaggaatcagaccaagcatagagagaggagagaggggattattcatgttccagttggatcataaacatgtgtccacgtgtggggaggacgtggagggtgggaaccaccagcacaggcaacacaaacacagatgtaggcaggactcgcttttgacgttggacgaccattgctggagcacttgctgtgcaccaggctctgttctaggacctagagatacagtgactaaggagattaaagctcggcaccaccctgccctccagagcttgcagtcggctgcgcaagacagactgcaaacgagcacaagatgaatggagaagacagaccatttctaagagttatcaatgaaagtgataagccagggagatgtgatagaggaggctggacaggacagcctctcctataaagtgacattggaactgagacctcagtacagaaggaggcagttaggcaaagat

SEQ ID NO: 12341 - DNA, 24720 bp, Human
tttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagcacatcctgtccactgtttctttgaagtgagtggggggggggggtcttgttgaaggaattgtcattcactgccaaaatcattccatcctccttcctcagtgtctgtcctcagatggtcagctccccgctcaacagactgtctcccgcctctgtgaccagcctctctttggcaagagggagctagaaggctttacagtcctaatcatttttctgttggaaaaaaaaaaaaaaaaccaaggctcctttccctgtggcgtgtacccagaggttgattacctgagtctgtcctgcctctccccaccccacctccctagccaaacgctgctgccaaagcccacgctattgccctagatggcctgtcttcagcgggctgcccctcgaggtcccaggctctccgcggagccctcaccttcccagcagggatcagaacctgcactcctctatgcgagtcctgggacagcacaaagtggattagggttagggttcccacaaacggaaaaatgttattcaaacaactctgtagggtccgaggaggccctccgtcttaattctcgagactgaccggccctcgctgccccgagcgggagcagttgccccggcaacagccgctccctctcaactggagctgcacccaggctttggctaaaggctgttaaaacgttggccaggtgcggtggctcacgtctgtaatcccagggcggatcacctgaggtcaggagtttgaaaccatcctggccaacatggcgaaatttcgtctctactaaaaatacaaaaattagcggggcgtggtggtgcgcgcctgtaaccccagctgctcgggaggctgaggcaggggaatcgcttgaacccgggaggcggaggttgcagtgatccgagatcgcgccacggcagtccagcctgggcgacagagcgagactccgtctcaaaaaaaaaaaaaaaagttagggtcctttacccgagggccggctttcctcactccccgccacaggtaggggaaaccaggccggagccggcgggcccacccgcccagaaccgggaattcggcgagccccgcccctgccaccccagcgccggccgctcggtaacaaacacttccacttcctgagcgctagtcttcgcccgccgcggggcgccgcgccgagcgcaggccccgccccgcgcgttcccaatggccggcgccgttcacccggccggagcgcccaggcctgcagccccctattggcccgcggaggtccccaccctcagcgcggccccgcccccggggtaaggagccggggcggactctgggacgctcagacgccgcgcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcaggtaagcggggcccgagccgcgcaggctggcatggagtgggaggaggatccggagagacccaggtgccccggccgtccagccccgcgcccgccgtcgtttttctgaaactcgagctgcgagggggagaccgcttccgcccgccgaccaggcgccctgacacatcctaggcaggcctggggctgcgtcccgcgacctcctctccttcccaggctgtgctgggagcttgagcgcctttgccgcctgcacctcttgttccctggcctttgggagggcggcgcaggggaacccagcccccttccctcgggtctgtgggtgtctgctcccgttcctcggaatcccccaatcctgctccttccctggtgccctctcctcgttcaccccagtccgcagatgggccggggagaaagggctctccgccccagaggtgccagcttcgcccgccactcctacttcaaaagctagaggaatagcattactcctcctgtgtggagccccggcgcgaggaggccctctccgcagcccgccggtgtgtgtcctgaacttcagtcctgctggacttcatcctcccggagtcctgtgtgacttctaagggagaggaagccccaccatctcagggcggtgtgggggttgcctggcagggaggaggagccaaggcatctcggagtggtggttctgccacctcagaggatttacgattctcaggaatgtgaagagtaagcgcctagaactgtatctgggagggaaggggaaagaccttggaagaagaaaaagatggccatggggaggagagagagctcctggggctcacggccctgtgtgcgccagcggagctcacggtgagccggtggtcttgccctggccttgccatggtcactctggtgcccacacagccagcaggccggttgctttttgcccatgtttggtgtttgcccatgggatcccagtttggatcagctgcaagaggggcagctggcaaaataggagttgtgctgagcctcctgtccccagagagtggagtggtgcattgtgtagggcagggcgtgagcctcccaggaccccttcagcttgcaccaccagctctccctggtggcagtgtctgatgggagtgtccgtggggctacgaggagcctcctggacagagaaagggcacagttcggcattaaggtagaaggcaaagccctagaggatcaactggtttggtggaagtgaggtcaccagaagccctgtccagccagagctgggtgctgggaatgccagggccaccaggctcccacttcctgcccctgccaagctggcattggcaaggggagggggaagggatctgagcacccggagcaaggaggttgatgccagggagttggggccgatgatctccagtcccaggcagaaatccagtgtgaactttgtgctgagtccatcgatcgatttgacattcttttttttttttttttttggactttggcacccacacaaatacccacccacccccaccccccacaagttgcagtctcgttcagctcctccctttgcccttttggttatgctgctgggtgccagagggcctgggaggcgaacgtggaggcctggcatagcacacgtgcgcaaaggcagcagctttgagcttcctgggtgagcacagactcagattcctgcatgttttggagggacacctacatttgtgtgtactttgttaggccaggagatgagaggagagccaccagcaaatcctggggacaccatcaccagccaagtcccaggacttctgagttctggttctcccatctgtgagatggaggcattgggcgatgtgatgcctgccttctctagaattatagaaatgacgtgaagcacttgagccccttactaaatgctgaactgcactccttcatgcctggcgtttgaatcccagctcctctaaactgactcctagtcaacaccattgagtccttctagcagaaaatcctctcctctcaatcctgtgtgttgagcatacagacacccatgtggttattagaaaaaatgttaacagacattgtaagagttcgtttttctaaaacacacccgtttcctacataaagcatcaaatggaggtttgccaattcgttttagtctgaatttgtgtgcaaggtggggctgttcccttgtcttcattagccctccacttactaagtgatgatatcagtggaaaagtgtggcgcagagagtggttggctgggtggcctctggctgggaagaccagctgtgtccagaaccactcagggcagaggctgaggggtgcctgtaacactggccatccccgctggggagtctaggcctaaggaggtggaagtggctctccagctctgcccaccggctttgctttgtggatggccttccccgcctgccccgtggggagagaggagcagcaagacccgccctgctgttcccctgcttaaagccctcctccccccattcaccaccagtcacaggatgaggcctaaacccttgagtctgggttcagagtgccggccgggcagagccgagccagctcagctgtactagccaggctgtgcgaagccaagttacctcacctctgtaagcctccatttcctcttgtgtaagttgggggttatggcagctacctcggaattgcatgaggctgtgtgtaaagcacgtagctcagtgcctggcactgagtccaggctcagccagcctttgcagttggtattggaatgaatacatatttcatagtgatcattgcacacctatcatggggcagctagcgctgggtcagcctgcctagttgggcaaatgccactgtggccaagcctggcacacagtcagtgcctgatcgatggtcactgtgggttaagaatgatacgttgtggccaggtgtggtggctcacacctgtaatcccagcactttgggaggccaaagtgggaggatcgcctgagcccaggagtttgagaccagcctaggcaacatgacaagaccctgtctctattaaattttttcttttttttttttaagagttatatgctgttccatggcccttctccatctggcagcctgttctcaccactgcctccctacccccaaaaccacacccagggtccgaattcccctctagcctctaagccttcacaccctgacacttctgtcccctcccagggagcctgtccttaatccagtaggcagagttagcatttcctttccttcactttttttgtttttgtttttgtttttgttttttttgagacagattccacccaggctggagtggtgtcgcaacctcgcctcgctgcagcctcgacctccagggctcaatcgatcctcccacctcattctccctagtagctgggactacaggcatgcaccactattcccagctaatttttaaattctttgtagagatggagtttcaccgtgttgcccaggctggtcttgaactcctgggctgaggtgatctgccagcctcggcctccgcctcctctttgtccttacatcttttatcgctctaaacacacaatattttaatcatctgtttgtgacctttttctccactacgtggtaagcccaagggcatcaactgtggcctatttgtgtttctatccccagcgctgtccttggcacatggtagggaggctctcaaaaacagtttttgaattaatgaatgaatatataacaacagtcagggacctttgtcctcattcagctcatcccgccccgcccagagattggaattccagatagaacctacccactcttctttcttgcctgctagcagcttctatttgaaaactagaaagccaaaagtccaggctttggggtcagccagatcagtgtttgaatcccagctctgccgtgtgctggttctgggatcctgggagttcatttttccctgcaaccctcagcctccacctctgtgaaaggcactgcctgcagggttattgggaagatttggtggcatgacaggtttgtaaatgaaagtgctagtttggggtgtttcctgccagccctgaccctgatcccagagtcagagtgcaggcaccccagggagcaaggtgggtggtggggcacagttagctggagggccatcaacctctttcccagggcgggcgggccattttacaccaaccaagttggagctctggtagggcagaacagagcttgagctgctgggtgtttggatttgaaatggacagggtatgtgattgtttgtgtgttgggatctctttctttgctggcaaaacagtgtagcccctggttcttaccttcaagctcctgttaactcagtaattctggagatgattctcttggagatagatgggggcttcctggccgggcgcagtgacttgtgcctgtaatcccatcacttcgggaggctgaggcgggaggatcgcttaagcccaggagtttgagaccagcctgggcaacatagtgagacctcgtctctaccaaaaaaacagggggaggggggtgaatgggggcttccttctcaaggaactccatatgtctagatggggtccttctcccctttcccagatgtcccatctcaatggtccctgggaaagtggggtgggaaattaataagaaactcaggccaggcacggtggctcacgcctgtaatcccagcactttgggaggccgaggcgggtggatcagttgaggtcaggagttgaggtcaggagttcaagaccagcctggccaacatggtaaaaacccatctctactaaaaatacaaaaattagcgaggcgtggtggcaggtgcctgtaatcccagctactcgggagtctgaggcaggagaatggcttgaacctgggaggtggaggtttcagtgagccgagatcgcgccactgcactccagcccgagcagcagagtgagactcatctccaaaataaaaaaaaaagaaagaagaagctcagccgaggtcttgttggtgctgcaggactctttacagggagaaaccagagctctagaccccaataacaaatgttcctctgttttcgttgctctaagatagagtggccctacctggaaggaaacaggtttgtacagtgcctttaggcactctacctatgacataaagatgttgacatgcatttctttctttctttctttctttctttcttttttttttttttttttttcctgagacagtcttgctctgttgcccaggctggagtgcagtggtgtgatctcggctcactgcaacctccgtctctcaagttcaagcaattgtcctgcctcagccttccatgtagctaggattacaaacacccgccaccacaccctgctaatttttgtatttttagtagagacggagtttcaccacggtggccaggctgggtggcacctgtcacaacaccctgctaatttttgtatttttagtagagatggggtttcaccacattggccaggctggtttcaaactcctgacctcaggtaatccacctgcctcggtctcccaaagtgctgggattataggcatgagccaccacacccagccaatatgcatttcattgtcccccagacaaattagctattgttttctctattttgtaggttgacagtaagtgttcaatacatgatagctactatttgtgtctagcactgtgctaagtactaaccttgcctgtctcatttaatccacatgaccaccagtgaggcagatattggccccattctctgcctatggaggctgaggcttgatcagttaaggtggccatggcgggtcccaggactctgagctagcgactcctcccacacagcgcaggggtgtgtcttggaacccaaccctctgactctagtgcctgcacagccatttggccacatgagtaggctgtgcttgaagcctgactctgccaggtgtttctgcccatcatattctgagccacagctggaccatcacagtggtataaattcaggctgcttgaactggcttcctgtaaggatccagggcttccaggtgctcctgtccctagcagggcatccttgcagtgcctcagcccataagtggcaggctcctgtccccatcccttctcacgtgatgtgataggtcaatctggaatctggtaaccaagtatctacccccgccctcactccccagaacctgcacagagagcccccctcaagggtggtcttcactgttgaccgaagccttcccctcatggtaggacaactcaccatgtccccagactcctaggcaatgtttaggtccctaggccctagaaaaggacaagagttacagattccctgaggtccaggtcacctcggggtggtgtgggaacacacagagaatgctggccaggttcaagtcccactcactgctgggtgctgagagctctgaattctccgagacaggctgcagcctctccctgtgctaaggtcaggggaacagcaatggccaggggtatttagaggagtgtgtttggggcagtctcaggcagcacaggtctgtgctgtccgggcagcagccaccagcttcgcgaggctcccgggcactcgagatgtgctggtccacatgcagacgtgctgtgtgtgcaaaatgcacaccagattttgaagccattgtacaaataaaaggatgtacaatagctcaattgttaaaaatggattacacattgaaatgataatattttgggtacattatgttaaataaaatattcaattctactatttttcctgttttttttttttttggaggcagagtctcgctctgttgcccaggctggagtgcagtggtgcgatctcggctcactgcaagctccacctcccaggttcaagcgattctcctgcctcagcctcccaagtagctgtgcaccaccacgcccagctgatttttgtatttttcttttttagtagagatagggtttcaccatgttgaccaggctggtctcaaactcctgtgctcaagtgatccacttgcctcgtcctcccaaaatgctgggattacaggcatgagccaccacacctggcctatttttcttttctttctttctttctttttttttttttttttttttttgagacggagccttgctctatcacccaggctggagtgcagtggcgtgatctcggctcactgcaacctccgcctcctgggttcaagcggttctcgtgcctcagcctctggagtagctgggaccacaggtgtgcaccaccacatatgtctaattttcatatttttagttgagacagggtttcaccatgttggccatgctggtcttgaactcccgacctcaggtgatccacctgccttggcctcccaaaatgctgggattacaagtgtgagccactgcacccggcctatttttcctttttcaaatgtgatgactagaaaatcttacattccacacatggctggcattatatatctactggacagtgctgctctggatctgagctcaaatcctgcctttgcccgtcagccatgtgtacttgagcaactgactccagctttttgaagctgggtttccttttctgtgaaatgctggcaataatactttccttttaggactataattggctcttaagaagaaaacacatgtaaagagctcggtgcctaacacatagtaggtgttcagtaaatagcagctgctatttgttacttcagtgttgagccccaatttcacaagctccttgaaggttcttaatagccccttgggacaacccctgggggttaaatctagagacttctgggaggagggtgagggatgaggaaggatgcagcagggaaggcatggggcggccagccctggatggtgtccagccgggctgcagcccaggtaccagcctgctccatcccaggcttgcccagccctgcagagacctgagccagactctgccccctcttgcccccgtgggtctccatggctggcacagggagaagaggttactagccagaaggagaacctgtttcagacctctgagtcctgggggtgtctgtcagaccagcagacctcactttagtttgtgtctccctcctggttcccaccctaccagactccagggaaagctcttcccactgagaaataggaaggaagagatcaagggctaggagcagtgagtgactttttttaaaatggacacatccaacattcccctgccgcccgcacagacctggagggatgtggagggtggaagggggtcccatagagtaaaatgaggtgacatcagggccactacgcagggggccagtgacagccaagccccctgtacctcacctagggtaaggagaagacaccttctgcctagaggtgtggacactggctgagtgcctggagcccctggtcacttcccagtgcccccaggctgcccgtcacacagcactccaggcagggccagctgtctccatcctggcttccttgaagagctggcaccaggcccagccctgtctccagaatctggggaacaaactgagctgtctcccagagcaaatatggctcttacacccaacatactcctgacacacacaccccagcccctgagaacagccagggttccttcctgcccccgccgtcctgcccccttccatcctcttgttggggctgattttcctgtattgggcatggggcactggtcttctttgcataaacaagagccctgggctgggggaggggcagtcttgagaggtggggttacctctgttgttcccctggacacccaagtggtcttcctactcctccagcccctttcctctggggtcctgagctagctggctcgaaggaagcgggctgggctgtttctgtagggcccatcaccatggcatcagccagggaggggctgggcccaatggggcgttggcccccaggctcccacagccttccctgaagggaggaaggaggagcagggagcggccctgggcctgttccccagagacggtcactgggattagggtatcgactttccccagctttccaggtgactgctggtggcgcctattgaattccgtgcccgccatccgctccctggactgcgtgggtggaggtgatggggcggccacttagggcgcggtgaagctccctgggggaaaggacagatgaagggaggaagcctgagggtggaggaggccccgggagaagggtgtgggggcagctctccgggcagggtcttttctggaaagccagccagcattttgtgaaagtgagagtctccagcctgtccagccctgggtcaccccggcccagctgcgctgcccatcggctgcatggcctcatgttccctcctgttgattctggctctctgccagtctcctctctgagcagatcctgattttgtcttgaacttgggtctcccaggctgtcgtcgtcactggaggtcccactttgccctccggaactcactggggctatgttccttttgagtctcctcctcccaccatgcttcggacccctctgtagctggctcctcctaagatcctgggggccacacaccaagcccaacatgcctggacgtcactcccatttatcccctttccccagaggcagaacccagccctgccccagcttggcggtgagggtccaagagcaatggtggctgagctcggccaggtaccccacacctccccatcttctcctctcagtgctgggcctggagaccacaggccaggccccacagatccccaggggggctgccccaagggactcccctgccagccccagcctccacccaggctgggatgggctggcttgatgggctgactcagcaactggcactgacacctcctggagacagctgggaggctcctgctagggaggggtgaggaggaacaaggctggtctcccttgaagagtgggaaccccccttcccatgtgaggggaggaagtctctagggacttgggaaggaggctctgcaggtgcatcggagctgtctaaatgctggtggggtctaccgggggcttcccatctccttgtccagccaccccctcaggtcctggagccgccacagagccacatctagacagaacagtggagcaggtcccagtgcaggggaaggaaacagagggcacctgagcccctcaggctgggtaccctgtttccccttgaactgcacgacttggtgctggcagagcggagcaaggctcaaagcaggccctggagctttggcaccatatgtcactaggcgaggggcactgggctgaagatcagtaagggaagcccacagcacagagaccagggccagaggatgggcatcccaaaggcagctagcacagccctgccctgccagccggggggggcgcccagagccacctgcccccagtccagccatgcccctgccctgtcacccacaccaggcttcatcccccagctcaggctgcagctccagctgcgagaggccctgagcgcccggaaggaaggctgtggtaggttgtggtttcttcagctcccagcctacctccagcagaggctgcagccgatgccctggagagagcccctgtctgccctctgctgcctgactcctgttgggtcctcacctcccaatgggttgccccattctggacttggatccttaaggagcaccctgcagtgtggtggaaggaggacaggttccaagtcagagaccagggttggagttctggctgtgtgatgtcaggcagtgggctccacatctctgagcctcagtttccccatctcaaaaacagctgacaagccccagtcaggttgttatgggaaggtttttgggagcgcagggacggtggagggaggttggaggaggtcactagagctgccccctgcctgtcctgagatttcaccctccccactttctcagggtgtctggctgaagcagaaagctgcgcctgtcctggtgacggcgactggtcagacttgtttctgctcacctaggcggcccgggggagggcctggctgggagctttgtggagggattagctctaggggagaagagcctcacttactcccggaacaagatcccacagggctgtgggagtgccggggggtgagcctggggcaggtgacagccgaactagctgggagtgggccctgcagtgaggcagggggtgggccagggagaacaaggcaagaggagcttcattcagggttcctgagcctttgtgagccactcacgtttttaccactcacttaaccgtctttgttgttggggtgaggggtcctcgagcctggatttgggtatgaaaacccaggcaagaaagacctgcccaagcctttaaaggaatgcaaagtcatcctctagccacccccagagatcgaaaggctggggattgagtctcctgcagatggtggcggcctcctggggctggcaagttgggacagaggcccataagccctcctgggcgcgccttcccacccctctcggccctctccactcccagctggggatttgggtttcagagcagcctggcacacacacccccaccccaccagaatctcactcccagcttcctatgactattcattagtattcacaacaatgggaaagtctgggtgtgcacagggattttttacagttagaaagtgtttaagtcaatgacctcactgggcctcagcaaccctgggaggcagatggcagtcagaatgatccataaatgacctgccccaggtcacacagctcctaaacaggggagctggaacctggctgggagccttgactatccactgctcattgtctgatgtgctgagtgataacacagggccagcaggctggacagcagccagtggccctgcaccaggcctggaggagggggagagggacagggactcaggcgtagtccttgggcacaggcttcggctgcctacacccatattccctccatcatactgtgtgtccaggcctgcagcttctaagctgagctgcttactttggaccaagcatgttggaaactgttttcagctgagtccaagcactcgaaatctgcgtgtgcccttttagtaggtcacaccctccaggccacagccacactgggctccctttagcccagccctgcttttcccagtcccctccccattcaggctcctctgtttctggggtctctgtgcttccgttgccacctctgcccttgggcagcggtgtcgggggaggaggtcctggaacgcctgaggatggccccgtcttgtccaggtccccttgctgtgctgaacaataagtttttggttatctgctccttctggctcccttttggctgggccattcggcttggtgggggtgagagagagttcgagtatatggaggaaggctttactgtaaacacactgaccagctttcagtaaacacctgcctcttcctcccctgctgcagagaacggggtacaaaggggctgggggtcctcagtcatatgccccaggtccccagccaggctgacgggtgccacactctgccccctctccaggagggccagactgagccaccaatggggagggatagaggcccgatcaacacagcatgtgattcaccttagactgtcagaagggacaggcatgtgagagctaacctggtcctacccctcatttggcagaagaggaaactgaggcttggacagagcagtgttttatccacatcacctaagcagttagctgcggtgctgggtatccacacaagtcttttgagtcctgggccagaaccctctcaaattgctgtgtagggatctaggcaaatttgcatcctcccaaaccttccttggttggggagatggggacaggcagaggacagggaaggcagaacctggggcactgtggaatagccatggaccctcccctgtccctgcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgatgcttctcgctctcttcctatctgactgcccccaccccctgcagatcagcagcacctggggcagccatcataccatcatgggcttgattagcccacgggcatagccaacctggagctgctggatggatgggtggatgggagggagggagggaagggtggtggatggatagacggaaggacagatggactgactgatggactcttctcttacctccactcccctggactcctccttgccaagcagatacagtgggcagcctgtgattcacccatcgatcagggagatgtctggggccatctccagagcttccctgctgccaggcacacagagtggggtggcagtaacaaaacccctctcctgagttaggcctttatttatttagtttttttttttttaaatggagtctcgctttgttgcccaggctgggggagtgcagtggcacaatcccagctcactgcaacctccgcctcctgggttcaagcgattctcctgcctcagcctcctgagtagctgggattacaggtgcccaccaccacgcctggctaatgtttgcatttttagtagagacaggatttcaccatgttggccaggctggtctcaaactcctgacctcaagtgatctgcccgcctcggcctcccaaagtgctgggattccaggcgtgagccacctcacccggccccgagttaggcttttagactcgtgcattcagggctctggtgctgtgctcctgggagaggaaacgtgaaccaaatgctcaggcaggtcccagaatcacagtcttagaaccttagagctagagatcagctctcccaagacttctcattttacacgtgagaaaaccaaggcccagagaaggaagtcggacagcaagtccttacccaggctgggccccaccccggcctcccagctcgctcccatcccatctctcccagctgtgtttgtttagtctcgtctggatattttcgttggcccttcccatgtatcctgcctccccagctgactgtcaatgggaggacccccagcctagttcaggactctgcagaaatggcgggggtcagtatccccaggttgtgaactgcaaactggctgagaaccaaggtggtcacccctgcccccaacccccctccacttacctgccccagaaccaaggcctgtgtccgtaacgcctccccgaccctgccctgcaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtaagccaggtggggccactggccgtcctggggctggagccccccaagtcagggatgtgagccagggctaagactgctgggtcccaggcgaggggtgggcagcttcccggcatgggtgctccctcctcctccttcatgggaggcccagaggtgtgggctgggggagcgggggcctagtgtagggagtggcagtgggtttctgaggacggcttgtgatggggtcagctggcatgaggtcggtgagagagatggacagatcttcttattcccggccaaagctgcagccccaaaggaggcccaagcccccagtcctgtccccaccagcagactttcagggcagtgtcaatgtgaggaaagggttaactccggggaggcctccagcctttgcttggtcagatcagagtccagtgacgggggccggtgcctccccctccctcctctcaggttgtcttggaaactcagccttgctggctctagagagtagtgggtcccccttcaatccctgggcccctgccctccccatcccccaccatcaccctgccaagcctggcgcctccccctgcccaggcccgagccaaacagggcagggctgctgcaccggggcagggaggggttaagcatgctctgctccttggtctggactttctccctgggaagatggctccctggagcgggcaggggtgctcactgggccatactgagggtggaacctcttgggactttgcagtgggtggggcctcctggagactcaaggttgtatgtgtaaaaggagattcacacaaaggtcctgcgactcccatcgccagctgcaagggcccactggggaggccctgtccccttctggcgcaatccaaggcctgaggctcctagaagaggggatggcccctggaagtccctagctggctctgggcatgggaggtggggtaccgccttacccttatctcccaagttcatggaaaccaggtaactcagataatccccttctccactgagggggagactaaggcccagagaagccccagccttcctcctagggatctgatacgaggaagacacagctggaatctggattccactcagctcctgggatactgtcccctgcttcccccaccccttcaccctgcaggtaattggccccctcagacattcctccctcttctgcctgtctctcgggctagaggggctgcagcctctggccaaaggacctgaagagggagaggcctggggacagtcccctccccgcagtccctccaggatggcatcctcaccctttccatagggaggaatgcccccctctccggctgccagggtttcaccctgaccactgtgagctgatggggaggggacagtgagtgaccctgtgtcccagcagcctgtccttgcccggggaaggctgtgggtgtcaaaagggaggagaagatgagagtcaggtatctctggctgtgtcctggactggggacagggaaaagataaccaggaattttaagctaagagttcagaagaagccctacactgaccagtccctggagatggaacagccacccctgaagccatgtgggacccctaccctgagtgagcccagtgaaggtgaccccagacctgtcttctctccctctgacccctccaggtttcccactggctgggggaggggatacccaggacacaccccttgagccttctcgtcccccctcatttcctgattggcaaataggagttgggattattttctctttttttctttttctttttcttttttttgagatggagtcctgctctgtcacccaggctggagtgcagtggtgcgatctcggctcacagcaacatctgcccctagattcaagtgattcttctgcctcagtctcctgagtagccgggactacagccatgcgccaccacgcccagcaaatttttatatttttagtagagatggggtttcactatgttggccaggatggtctcgatctcttgaccttgtgatccgcccacctcggcctcccaaagtactgcgattacaagtgtgagccaccgcgcctggcctttttttttttttttccggacacagtctctgtcacccaggctagagtgcaatggcacaatcttggctcactgcaacctccacctcctgggttcaagcaattctcctgcctcagcctcctgagtagctgggattacaggcgcctgccaccatgcccggctaatttttgtatttttagtagggatagggtttcgccatgttggccaggctggtcttgaactcctgacctcaggtgatccgcctgccacagtctcccaaagtgctggggtcccagtcatgagccaccgagcccagactattttctctttcagttgaggcaggtactaactatagtctggggtgtggttccaattttggtgtcatcatcatcacctgggaagcgtttggaaaatgttgattcttaggcctgcccactaaaccagaatctgtgctgccaaggtccaggaatctgtactttaacaagcttcccacgtaggagttcccaggtaggaattcccaggtaggaattaggcagccatcctcgaatttcatccccatctgagacaatacattttttaaacaccttgtgacccatcagtgcctcataagatcaatttagtagatagagaccagcaggttttttggtttgttttttttgttttgttttgttttgttttgttttgccagagtcttgctgtgttgcccaggctggagtgtagtggcgtgatctcggctcactgcaacctccaccttctgggttcaaacaattttcccacctcagcctcccaagtagctaggattacaggcgtgtgccaccatgcccagctaattttctttttgtcttttttagtagagacggggtttcaccatgttggccaggctggtctcaaactcctaacctcaagtgatccaggtgcctcggcctcccaaagtgctgggattactggtgtgagccactatgcctggcccagacatttttttgttttttttaatgaaatgaaattaaaaatatcaaagaacactgtagtaagggtgttgctttgtgaaacttttatcacacaaaatctttgtgtgtgctgagtcatcaaaatggcaaacgtaggccagacatttgctcacacctgtaatcccaacactttgggaggccaaggtggaaggattgcttggggctaggagtttgagaccatcctgcatgacatggcaaggccccatctctataaaaaaaaaattttttttaaataaataaggcaaatgtattcatggtgggtggtagtcaaaaaagtttgagatgttgacccagggaacaagatctaataatctgcccaaacccaactcctacctcctctccacgctctattccatccccgttctggactcacctctgctctgtcctttgcctaggtcccctgcctgtgcccttcaccaatggggagatacagaaggtaagggcgggtcccctgtctctttggatttcaatccttggggtgcatgagacagatcagaaggtgctgtggttggtaggatagccatctgactaaggccaaaaccccagggtccccagttccagctccttcttcagctccaagctatagaactgccagaaccctcttggcctctgcctggggccaaagctgtcaggagggagcgggctggctgggcccctctgcagcccgccatcctgggtgacaagcccccgcctccaactccccaccatacagaaggggccattcttccccccaagaacagagcttcagtgtctggccacgggcagccgggcccctgctacttctagtctgggttggaagaacaaagcccctcctccccccttccctgggcagaagggaaagggggtgaggcccggggaagagatggtggggctgggcgccagctgaagccatggaggaacccaggaaggggctgggtgccaagctgacgccccagccaaagccttcgctctgggacaggccgactcagtcaggccacagagcaggaactctgcagggtctgcttaaaggttccccttccctaggagctcctgccagggtacttggcaagggggagggcccttggacccagccctcaaccttctttcacctcatctttggatctagaactttccatccaccttcttctttcaaggccctcctttgctgcttcagggttagggtttcaggattcctggggtcaaatcctggcaaacagtcaggtggaccacatgagattcagggagcaccacatgggctccccatgcccccatgtgtccccacattccaagaagcccctccctggtcactggcccaaaaggcaagccagtacctaaaagccacattggagtggcccagggagagggagcggttcagctaatcccatgatggtctgttcccatcccatccctccagcctgagcagtagaaccagcctgccctctgatccccaaaggaatgtaaaaaggagccccagcaggctcaggaggtgggaaccaggggtgggtggccagggcatcagtgctacctcttctcagtctgaggcccctacttccccaggagctccctccctcctcaggaccccctcaccccatcctctgacaacccacaaccctctcctctctgccaggagaacagtcgtgaagccctggcagaggcagccttggagagccccaggccagccctggtgagatccgcctccagtgacaccagcgaggaggtaggccagccatgcggggggtggcaactgggttacaggaagccgattcccaggccccacttgttcctggcacaccagcctgcctttgaggtcacatgctgagccgcattctgttcttgtgacctggcttccctgggcacggccccaacggagccacctcaccaaggctgaggaccagggagcctaatgagggactgactcccaacttcctgcccccacttctctttacagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaacccttcagcctccgtgtgttccttggaagttttgtcctctggccttggaccccttataggtagaaattgagaaatggtaagccaaggtggtctttggctgggagggtggggtacactggagggagggccatcaagggctccctgtgaccccaagcctgggtagctttagctagagggcctagctgcagtcctgtaggaaggaagatgcatgcacccagccgggtattcagcttggtgtggtcagtgtgcctgtgtgctgggctgcaagcaccgattgtgggctggggaccccttgtctaacggggatatttacaaggggaagtgggagctcagaccaacgttctcagaggactctgggaggttcctttaattccagaagcgtggaaagtgtgtcccaggatggagctgggtttggaatgtgaggacttggctttactctttctgcctatagccagtggggtgcagaattcccaggggcaggctgggctggtgccagatcctctatcttatctggccattgtgacctgattggagggcaagtgtccagtgccaggggaaaacaaaccggtccactgagcccggggacatgctgtgtggctagctggggtggaagggactgttcaagggcaaggtgccctgcccccaacaaaagacccaggtccctgatacctttggcacctgaagcctgatctggaggtccaggaaggtggcttgcaagagctaggctgcagagccgggaggttccgggcaggtgctcaggaggaaggtgcccccaggctagtctccacccaacccaaagggacacctctcagaaaataggctcctgggctgaggggaatgagtaaagcaggtagatctggaatcagggagtggacagtgtcccccaggccagtcactatctggccatctcctgctccttgtcagaggaaccatccaaaacccttaccacagcagtgccctgctcagctgacctgcccccaccccacccttgcttctaccctttggcccctgacagattcccctccacaggggtcgtggagggcccctccctatctcacctgctgggtggggaagccctgggggacctttgactcttcattaacctgaagactggtggaaggaatgggtggccccaagggaactctcattgctgaggtacacatggtacgaagggagccacggcaagcaacgcgttcgttttataatgtttgttttatactgaggcatgttttcggttccagttgttcacatgcagtctgctgtgagactccaagatcaagggtgctgggaggccttaggcaagtcaccttacttatctaagactgtttccccacctggaagatgccctacaagcctcctgtggctgtgtttagaaagcatgcccggcctttcttgacagccagccaccccagatgatggcagggcaaggaagactgttaggagtcagagtgctcccctcaggtggaaggaaactgggccaactctactttgtaagccatagggtgccaggtagcccggccaccctgagcctgtgcctccactgcccccgcgtggccagtcaggtgcagctgctcccagagatggagggtgaggaacagacgtgggagcaccagagggacagagctgatggcctgacgctctcttcaggagggcacccccaaggggcctctgcttcctcagtgccccctgagctttatcagcagaggggtgttttccagccacaaggagctgtatctaacactaatgcctttaaactcaagactggctccaggagagaggaggacggacactaggttgaggggccaggccacactcactctggaccacctgttgttcccgggtcaagttcccagggtcacaccagcctgcctctgcaggacaagaggaccaagctgcccttgagtggacactgtgaggctggggcttgtggtagctcttcacacggaccaaacgggaaaatcaggaaagctggtagtgcctggagcttcactcccagccaggg

SEQ ID NO: 12342 - DNA, 6490 bp, Human
ctcaggggattctgtaagactcatggaagaataatggcgcaaacagcaatattttaatgttagaacggtcctctgaaaagtctgcccgaaacgctacaaagataattgtgcagtaacttctaaaaactctactgggacaggaggcaacaaaactccggatcagcgagagctctgtttatccgagggtgctgagcctcaggccccacggagattcccttttcggcacttggaggcctgaactcaggtctaacctttcgtgtgcgcgctctgatactcaaccaccgttcagtctccggaggctgttacaactgtccccattctacagatgaagttgaggctacagcttagtgttcttggggagggagggagttggggggagagagagacgcttttcctcataaccttaaacaaaagtacttaaacctaaagcaactgaaaaatgattttctttcaacaacggtgtttcctttggggtcaagttctttgatctcatctacaaaaccaagaagcgggacaagtatttttctgcaaattagaacggggcgttcccctcccccatcaccccaattccagaggacgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataatattctttttaatatttgcctccattactttggattcacctgtgttacttgtcctcagcttcagatagaatctccttcccctccctcgtttccatttttccagtctctttcctgaaaggcagctaaactgggtgggagcaatttttgcctccttggtaataacctgggggatgttttctcacatgtaaatctcagcctgttaggtgtccaggagtgaaacacatctttgtattctaaaggcagaaaccaaacagggcagtggaagaaaaagcacactactctcttcaactttgaacacaggaagaagcaactccttcaggacttgaaggcatttggtttttcattcctcttcagttaaaatggggaaccttgaagcagagaccaatgttttggtcctgaggctggttcagaaaaaggatttttaaaaaaagtatgtaatttttaaaagttctgatgattagaacacagacctcaggaaagtagcgtgaacatactgctggcgatggtagcagcttcgttggtttagcaaagtgacagaagtatctatttggagtgtttttctgaccctgacacggtatgtggaggtggatgaaagcagcgaagtttcatctgagaaccgtaagggttttcccttttcttacttgcttcccatttaaatcagtgcaagagagaatatgaatttataatgctttacttgggatgcctgtggaatatgttgcttttctttatcatgtttcctaaaagtaaatttgcaaagaaagtaacatgctgcagacagtataaggcttcagccaagagcttcttttagatatgataatgaattgtggtaaagaggaaatgaaaatgaactagtgtgtaggattttgaaatttggtattttccagggagaaaaccgttacattttcctgtagtggttatgatgttgtgtcctgaacccatttggtactgaaacattctgcagaatgttatactatgagaagaaattgtgaagcccaaatgggaacaagagacagtgtagttgtatatgacagtaaatacagtacaagttcactatcatcatggttttatttcactgtgattttttatgagatctctgaaagccaacatgcataggttaaatgctgagaattttattttagggaaaagatgataaaaataatctgtacgtggggaatattttaacacacaatgattcttaagtataattaccattgcaatacaaaatctagctacgctggtaagaattccaaggtaaagaagcataaaggtttaaaaaggggtatatttagaaatggattttataacacaatctagaatgcttatttcttaatttactaaaatagtttttagtattgtgtttctgaagccagattacatctataatacattgatcatgttttccatatttttgtggtagtgcctatgctgaattagcttcaccagcagtagaatatttgtaatagatttaatttaagaatactttaaagttaaatgaacaaaataaatactaatattggatggctatagatgaaacagatttaacaggaaattaagagagcagcattaaaaagcaaccactctgaataaaataaccatttataaacaaattttgtgtggcattagaatcagctcttaacaattgcggtgaaattcatgcctagttgttgagtgaaggattttcaagcagtgaattcattcttctttcagcttatctaaggacttggactgtgttaaagtagaattatgatgttttggatcttgtatttaaaacaatattagatgctagatagagcctttgcagctggcagagcatttgtggcctctgctcagatgaaattttaagctaaacaccaacagatcctctgcttgctctgtttgaacagggtttccgttcgtaatcttgttttgtagcagctgcattctctccactctgccactcctgtgctctgtaatttgaaaaggtgaattgttgctcctggagatttgtacctagctgcc

SEQ ID NO: 12343 - DNA, 113042 bp, Human
ggtcccgacctgcccaggcctgcgacaccccccgcccggcggagaaaccgtcccagcggctgctgccccgggagccctcggaagcccccggactagcaggagcccggaggccggggttgcaggcgccagggcctactcaccgggagctggctaagcgtgggagccgacgtgcgccccggcctgaggagtgggacgcggccacggcgcgcggccctacaccgggacctcgttcggcgcggcgagtcggacgctcactccagccgccgccgccgccgcggctgctgcttcgccaccttggccgccatcttgactcaacccctctccctccccccagcccgcggagccgcggctaaggcggctccagcgccggctcctcctccttccggagagttgggagaccaactccctccgctggccgggcgcctctcctacctcggcggagcttcccgggtcgcgctgcgcccggtctcttcatgtctcctctaggcctggcagcggcggtcctctcggacggatacagggccgagcagcgcccagccggatccagcgctgctgccatcgtgccctgggcttgtgcgccccccgcctgcccgtctgttccgcgcgcccgaggccttcctcaggcgtgggaaaaggaaaaactccaggccgtggaagggaccctgcaaacccctccgcggcgtggtggggcggcggcggcctcctctggccggagctgcgtacagggaagccggtcccctcgtggctgggagctggaggggtgcatttcgacctgcccaagatactttctagggctctggctggaattcgcaccaagccctcactgaaatgctgggcgaggccgatttgtccacgatgttgctccttaaccttaagttacttgcaagaggagcctgtggccctcgcgactgttaagtgcacgctcagcctcaccctgctggggaaacgacggttcctcgtaaccgcacgcatacgttcctttagaaaagccaggcccgaccggacgcagtgggtcacgcttgtaatcccagcacttagggaggccgaggcgggccatcacttaaggtcaggagttcgagaccagcctgacgaacatggagaaaccccgtcactactaaaaatacaaaaattaagcgggcgtggtggcgcgcgccagtaatcccagctactggggagaccgaagtgggagaattgcttgaacgcgggaggctgaggtagcagcgaacctaggtcgcgccactgcactccagcctgggcgacggagccagaccgtttcaaaaaaaaaaaagaaagggccgggcgcggtggctcaggcctgtaatcccagcactttgggaggccgaggcgagcggatcacgaagtcaggagttcgagaccagcctagttaacatggtgaaaccccctctctactaaaaatacaaaaattagctgggcgtggtggcgcgcgcctatagtcccagctactcgggaggctgaggcagaagagtcgcttgaacccgggagacagaggttgcagtgagccgagatcgctccactgcactccagcctgggcgacagagcctctcaaaaaaaaaaaaaaaggtaaagaaagccatccaaaagtgagaaggaataacaaagttggtgtaactggctattttggaaaactgtcatacggataacgggctgtctaaccctataattacgagaaaggcccgagttttaagaaatgaattcgaaaatgaagaggaaggaactcttcctataagtgggagcttatatataagacgcttccttttaaaccgattgtacagtgtggtaggactagggtaggaaactggacggcatggagacttctgtgttaaaacacaagagaacccttaacgttaaaacctcaagcttccggagcatgtcggcgggagggacttaacagcggaacccaacattccccggtgaagttttccagccggagtcagggtcagaggcagcctttcctactgcgcaggctcagtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggtaggaggccataggaggggcgatgggagccggggctttgaaagggatttaagtgctaaccgatctcagtcgccttcttctcgaagttttccgtagggagctaagtgaatacaccgaaggtcttacctctgaacccctcacagcctagggacaggagcggccggcttacctggtgggttgggggacgtcggcagctcgcgtactacgccagcaggattgaggagcagagaaacagttgcagttggttgtattcagtacctgcatttccgttgggaactccacctgtacttgttattctgtggaacttttttttatttgtagaaggagcaagaatattgaccttactatatagcacacgaaacaatctatgctgtatcgtgcctgctcaatccttaaagttaacttctaatgatagtaaaagaccttcctgctgcctttaaaatgcagcttgtgctagtaacatgcatgtgtcaaattgaagaattagacatagatgactagatagaaagtaattttgtaggtaattttagagttcaactccacccagctttcagtgaaggaacctttcaaataatagatttttgcttaccatagagaaaagatcaaatgacaaagcaaatattgaccattaagctggaatatggtgataattgaacagttgtataaatgaagtaattgaattgtacacatacaatgggtgaattttatggcatgtcaaagtatacctcaataaagctatttttttaaattgcccatgacctcttttcccatttgtttgtgtgtctttccaattctttttctatacagcttcttcacagaaatcacattttataaaattttatatcgtttttactcgacattactttttcatttatttaccaaatacttattaaacatttatgtgctaggccttattctatgccctagggatacaaaagtggaaagctagataagagcagtgtcctcatgaaactttaaacatctacctatattaattagatctaaatgtatagcctgttaaatggcttcatcgggataaaccttaatcatcccttattgtttgtacattcagagggttttttcctagtttattgcaaagagcagagaacatctttatgtattttatattatttcatgagtattaatttttaaaattggctgtttttaggctttgcattgcaaaacacattcccaaaaacaaaatgccaacttactctttttttttttttttttttctgagatagtctcgctctgttgcccaggctggagtgccgtggcgtgatctcggctcactgcaacctccaccacccgggttcaagtgattctcctgcgtcagcctgccaagtagctgggtttacaagcgcatgccaccacacctggctaatttttgtatttttagtagagatgaggtttcaccatgttagccaggctggtctcaaactcctgacctctagtgatccacctgccttggcctcccaaagtgcttgggattacaagtgtgagccaccatgcctggcctacctatttacattcttactggcactaatgagagtatctgtcttaatatactactttctgtagcattgactgacattttttataaatttctttttttttttttttttgagacggagtcttgctctatcgcctaggctggagtgcagtggcgcaatctcggctcactgtaagttctgcctcctgggttcacgcccttctttctgggactacaggcgcccgcccgccaccatgcccagctaatttttttatttgtttttagtttttagtagagacggggtttcactgtgttagccaggatggtcttgatctcctgaacttttgatctgcccgcctcagcctcccaaagtgctgggattacaggcgtaagccaccacacctggccattttttataaatttcttaatttgtttagtatcttctcccccaaaaacctttgttaccagtaaaagtaaaccattttacatatttattaagaattggagcccaagcacttttcttctaaaatttatgctctgttaagaatattaattgcaaatagttacaagtaatgccaccattttttcttagcttctaggtttggtggggggttttttgtttagttttctttttgagatggagtctcactctgtcacccaggctggagtgcaggggcgcaatctcagttcactgcaacctacgcctcctgagtttaagcaattctcttacctcagcctctcgagtagctgggactacagtgtgcaccacatgttgggctaatttttgtatttttggtagagctgaggttttgctgggatagccaggctagtctcgaactcctgacaagtgatccacccacctcggcctcccaaagtgctgggattacaggtgtgagccaccacacccggctggccagcttttagttgtatttgtattttatattacaactataggagtcaaattataagcaaatttgttacaaggtcttcaaaagaagcctggattttatttgcaaaacattataggtatagctgtttaataaacttacccttattttcaataggttcataaaaatttgggaccagaattgaaaattttttcaaataaaaaatataggccgggcatggtggctcatgcctgtaatccgagcactttgggaggccgaggcgggcagatcatgaggtcaagagatcaaaaccatcttggccaacatgttgaaaccccgtctctcctacaaatacaaaaattagctggctgtggtggtccacgcctgtagtcccagctactcgggaggctgaggcaggagaatcacttgaacccaggaggcggaggttacagtgagctgagatcgcgccactgcactccagcctggcaacagagggagactccgtctcaaaaaatatatatagagagagagagcatgcacttggcactcaatgtttttattgtatttcattatttcctctgaatccattttgttttttattgtatgttatttattctttatttgtgtttttttaaattgttattttttttttttttttttttttttttgaggcagagtctcaccctgtctctcaggctagagtgcagtggttcgatcttggctcactgcaacatctgcctcccaggttcaagcgattttcctgcctcagcctctggagtagcgggattacaggcattcaccgccacgcccagccaattttgtatttttagtagagacgggctttctccatgttggtcaggctggtctcaaaactcccgacctcaggtgatccgcccaccttggcctcccaaagtgctgggattacaggcgtgagccaccgcgcccagccacgccaggctaatgtttgtattttcagtagagacagggtttcaccatggcggccaaactggtctcgaactcctgacctcaggtgatccacctggcccggcctcccaaagtgctgggattacatgcatgagccactgagcatggcctgtttgtttattttataaaaatggggtcttgttctgtctagagcctttcccctctagactgcactgtcagctctcatatcaggtgacagagcaagaccctgtctttataaaataaaccaaacatgaataacatacaagaaaaaacaaaatgataagttggattcagaggaaataatgaaagacaataaaaacattgagtgccaagtgcatgctctgtattttttatttgaaaaaattttcaattctggtcccaaatttttatgaacctattgaaaataaggatgaatttattaaagagctgtacctgtaatattttgcaaataaaatccaggcttctcttgaaaatcttgaaacaaacttgcttaatttgactcctatagttgcaatataaaatataaataaaactaaaagctgactggatcacagctccctacagcctccaagtcttgggctcaagtgatcctcccgcctcagcctaccaatagttgagactataggcgtgtgccagcacacccaactttttttttttttttttttgagacggagtctcactgtcgcccgggctggagtgcaatggcgcaatcttgggtcactgcaacctctgcctcctggattcaagcaattctcctgcctcagcctcccaagtagctgggactacaggcatgcatcaccatacctggctaatttttgtttttgtttttgttttgttttgagtctagctgtgtctcccaggctggagtgcagtggcacaatctcggctcactgcaacctccgcctcctgggttcaagtgattctcctgcctcagcctcccaagtagctgggattacaggtgcccgccactatgcccagctaattttttgtgtttttagtagagacagggtttcaccatgttggctgggctgctcttgaactcctgacctcgtgattcgcctacctcggcctcccagaatgctgggattacagacgtgagccaccacgcctggccaatttttgcatttttaatggagatagggtttcaccttgttggccaggctggtcttgaactcctcaagtgatccacctgccttggcctcccaaaataataggattacagcatgagccactgctcctggtctaatttttaaaatcccttcttaaattcacaagtcattcaaacgtgtggattaaacattatctattctgctgatttaacattttaatataaaaaacaggaagctattaatttgtaatgtaatgaaagctatgatgttttgatggagaaagtactatggacacaaaatggaaaaaagcattaaatctcttttcaggggtttagattaaggaaatctccaaattggttttcttttgagctggactttaaaaataggagtagatatatatataggaagcaagcagtagtaaaggcatcagtaactcttggatttgcatgaataattcattctaacaagatcttcagtttaagggaaagggagaagcagggaaaaaataataattgctttgttattggtggctcatttcatcctgtcagcaactctgtgaggtaggtactattgttttttccattatacaagtatgggaactgaatcacaaagtttaagtaacaactgaagtgaccagctacagtgtaaagaagccaggaccctgtggtttttctctgttctaaaaccgttacacccaatctgcctctcacattgccttgtatgccttgtcagttgatgaaatatctaaattgattcccagtgtatgttccaaggaacattagttcatcaagctgctattaaaaaaaaaaaaaaagaggccaggcacagtagcttacaccagtaatcccagcactttgggaggccgagacaggtgcatcacgtgaggtcaggagttccagaccagcctggccagcttggtgaaaccccatttctactaaaaatacaaaaattagccaggtgtggtggtgcatgcctgtaatcccagctactctggaggctgagacaggagaatcgcttgaacccagtaggtggagattgcagtgagcagagattgtgccattgcaatccagcctgggcaatagagcaagactctgactcagaaaaaataaataaataaaatgaaaagaatgcctcggtcaagtttggagaatagccagatgtgctatcctctatgtagacgtttacagtctttatgagaatatcaacatctttgagaagcattgctgtaaaaaattttgacttggtttaatccagtattcctccaatttatgtgaccactaaaatacctactaatagatgcatctcttatatagtaggatgtcattgaatatatatggtagagaagtaacataatcagttttgtgttttagaaagctcattcttggccaggcgcagtggctcgtgcctgtaaccccagaactttgggaggccaaggtgggcagatcacaaggtcaggagttcgagaccagcctggcaaacacggcgaaaccccatctctactaaaaatacaaaaattagccgggtgtggtggtggatgcctgtaatcccagctactcaggaggctgaggcagaagaattgcttgaacccaggaggtggaggttgcagtgagccaagatcgctccactgcacttcagcctgagcgacagagctagactctatctcaaaaataaaagctcagtcttggaccgggtgtggtggctcatgcctgtaatcccagtactttgggaggccaaagtgggaggattgcttgaggccaggagttcaagaccaacctggtcaacatagtgagaccccatctatttaaaaaagaaaaaaaaaaaagaaagctcattctggtggcaatggggagaatggtttggaaggaaagattggagtcaggaaaatcaattcagcccagcctttcttctctagactgcactgccagctctcatatatcagatttccatgtaattctggtctatacactttagtcatctcaacaaccctgtcttaattactgtagcttataaaagctacactaggccagaagtgttggttcacgcctgtaatcccagcactttgggagacagagacgggtggatcactagttcaagagagcaggaccatcttggccaacgtggtgaaaccctgtctctactaaaaatacaaaaattagctgggcatggtgatgtgcgcctgtagtcccagctactcaggaggctgaggcaggagaatcacttgaacctgggaggcggaggttgcagtgagccaagattgcgccactgcactccagcctcttgctcttgcgacagagcaagactccgtctcagggggaaaagaaagctacactatattatagaagcgctattatctgatatgaatagtcttctgattgttcttcagggtatgtttgctgtttttgaccctttttccaaataccttttttatgggggaagacagagcctcactgttgcacaatcttggctcactgtagcctccgcctcctggattcaagtgatccccctgcttcagcctcccgagtagctgggactacaggcatgcaccaccacgcccagctaatttttgtatttttagtagagacgggattttgccatgttggccaggctggtctccaactcttgacctcaggtgatccaatccttcttggcctcccaaagtgctgggattacaggatgagccaccatgcccagcccccaaatacattttagaattagcttggtgatgttcaaggaaaaatcttgctgacattttttcccccttgtgacagagtctcactctgacgtccaggctggagtgcagtggcgcagtctcggctcactgcaacctccacctcccaggttcaagcgattctcctgcctcagcctcccaaatagctgggactacgggcatgtgccaccatgcccggctaattttttgtatttttagcagaaatagggtttcaccgtgttagccaggatggtctcgatctcctgacctcgtgatccgcccacctcagcctcccaaagtgctgggattacaggcgtgagccacagtgcgtggcccttgctggcatttttattggaatttcactgactctactgattaatataaggagaactgacatttccaatataaagcctttctgtctctgatactatggtatgcttccatttattatatgttggccttctttactatctgttaatagttttataattaaggtcttaaatgtgtattgagatgattatgtcattgtgtccattaatctgttcttatgtgtagacattccttttgcaaatatagtctgttactttctcatacttcagtatcctctttaatttctttaaatatattaaacatttatatctgcttctaataattccagtttctgcagtctgtatatctgattctgttctttgttctagtaattcattcggggtgactcggttccatgtgtattttgtgatttttttaaatgtaagcacgtttctttttttttttttttttttttttgatacggagtctagctctgttgcccaggctgaagtgcagtggcacaatctcagctcactgcaagctccgcctcctgggttcacgccattctcctgcctcagcctcctgagtagctgggactacagtcacctgccaccatgcccggctaattttttttttttttttcagtagagatggggtttcacacctgggattacaggcgtgagccaccgtgcctggccttttgttttcttttgttgttgttgttgttttgttttttgcacgtgtttcttagaaccatatttgtggtaatattttggtgatttactttagcttcagccaggtagctaagggcactacctacctctcatcactctaaaattttagattgagatttttcaggccatagaggtcatataaattcagggatcaaacccaagagcattcactgtggaatgctgtgaaacaaattgtctcaagaccttgtagcttaaaaccataattaaatctttccagcctgtgtgctggcacacacctataatcctggcactttctgaggccgaagcaggaggatcacttaacccaagagttcagcctgggcaacatagccagaccaggaaaaaaaaaaaaaaaaagttagccaggcttggtggcagctgcatgtagtctcagctacttgggaggctgaggtggaagaacacttgagcccaggagtttgcgactagagtaagctatgatgatcatgccttatagactaagcccatgtctcaaaaacaaacaacaacaagaaaaaccaatcaccttttttttcatggtttcagacaaagtatacttgtctctgcctcacaatgtttagtacctcatttggaggacccaaagactaggggctggaatcacctgaatactcatgcacttacgtatctggctgtcagctggggactttgctacagatgtcagccagaacatccacatatggtatatccatgtgacctgggcttcctcacaacctggtggctgggttcttgggcaagtgtcctaagaaagagcctgtgctagggataaccatatttccttttatgacctatccttaaaaatcttgcagtatcataagccacatccaggtttaaggagagaattagattccacctcctaaaggggaatgtagacattctacaagtgcatatgggactagaaatattgctgtagctacttttggaaaatacagtctatcacaccaagtaaaggagagtatgtgattagcaattcttagggggtgacattttttcttattttcccttctgctagaaccaagcctacagataggatgtagccccaccatatctgtctagggcaagtttttttctggttcatccagtgaaggtattgccttttgaaggtcctgtctttatgtggaggtctccttatctgtgtccaagctttatctgctgctcccttgactttaggccaccaaggatatgtagatgttctcaaagtgctctgggtcagccgcataatacctctcaggatttatgtctacctattgttttagtccttcaagtatatcccttactttcctgctagttaaaccatgcattctagaacatgtttgccttttatctcacatgttcaggtattcatcctgagggtttctctgcatatctgatttaccatattgcctaaatagaacttattaggggttatttttaatactgcttttttgggttttttcttttttttttttgagacggagtctccctctgtcacccaggctggagtgcagtggcacgatctcggctcactgcaacctccacctctcgggttcaagtgactctcctgcctcagcttcccaagtagctgggattacaggcgcgtgccaccatcatgaccagctaattttggtatttttgtagagccagggtttcaccatgttggccaggctagtctcaaactcctgacctcaagtaatccgcctgccttggcctcccaaagtgctgggattacaggcgtgagccacctcacccagtgaaaggtagcaatttcattagtaagagtcgatatgaatgcaatccttttgggaataatgagaaatgacactactcgcaagtatggctatattggctgataatatagcatgtgacaatgtttcttgatctgcagagatatgagctcatttttctttttaattttcttttctttttttttttttttttttgagatggagtttcactcttgttgcccaggctggagtacaatggcatgatctcggctcactgcaacctctgcctcccaggttcaagcgattttcctgcctcagcctcccaagtagctgtgattacaggcatgtgccaccatgcccggctaattttgtatttttagtaaagactgggtttctccatgttggtcaggctggtctcgaactcccgacctcaggtgatccacccaccttggccccccaaagtttgggattacaggcatgagccactgcacccagcctttttaatttttttctcttagtgatcttttaaagacaacttctgttttatagggataacgcctataatcccagcaatttcataattgaaagattttattcattgaaaatccagtttttaatattatttaaattgtggtaagacatacataacaagaacttaccattttaaacttttttttttttttttttgagatggagtttcactcttgttgcccacactagagtgcaatggcatgatctcggctcactgcaacctccgcctcccaggttcaagcaattctcctacctcagccccctgaatagctgggattacaggcacccaccaccaccatgcccggctaatttttttatatttttattagagaatggagtttcaccatgttggccaggcttgtcttgaactcctgacctgaggtgatccaccttcctcggcctcccaaagtgctaggattacaggcgtgagccactgcgcccagcgattttattttattttatttctttatttattttattttatttttttgagacggagtcttgctctgtcgcccaggctggagtgcagtggcgcgatgtacgctcactgcaagctccgcctcccgggtttacttacaccattctcctgcctcagcctcccgagtagctgggactacaggctcccgccaccacgcccggctaattttttgtatttttagtagagacggggtttcaccgtgttagccaggatggtctcgatctcctgacctcgtgatccgcccgccttggcctcccaaagtggtgggattacaggcgtaagccaccacgcccggcgattttaaacatttttaagtgttcaattccatggcagtaagcactttcatagtattatgtaaccatcaccactatttcatcatcccaaatagaaactctatacctgtttagcattccttttcccctcctctcccaagcctctggtaaccaccattctttctatctctatgaatttgtctattctaggtaactcgaataagtggaatcatacaataattgttattttatgcctggcttatgctaattagcatactgttttcaaagttcatccatattgtggcatgtatcagaacttcatttctggttgagctcagtggctcacacctgtaatcccagcactttgggaggctgaagtggaaggatcccttgagaccaggagttcaagaccagtctggacaacatagtgagatttcgtctttacaaaaaataaaaataaaaaaattagccagtctgggtggcgagtgcctatagtcccagctacttgggaggctgaagtgggagaatcccttgaatccaggaggtcaaggctgcagtaagctctgatcagtctgctgcattccggcctgggtgacagagcaagtccctgtctcaaaaaaaaacttcatttctttttatggctttattaatattccattgtgtatatatacatacatatatatatgtatgtatatataccacattttgtttatcattcatctaatgataggcacttgggttatttccaatttggggctattatgaataatgcttctatgaacattggtgtacaagtatttatttgagtaccggttttccttttttttttttttttttttgagtataattgctgagacatatggtaattctgtatttaaattttttgagaattgacaaactgttttctgcagcaactgtacagttttacgttgccaccagcaatgaactatggttccagtttctccacatctttgtcagcatttgtaattttccattttttggactatagccatcctagtaagtgtgcagtgatgatgtcacattgtggttttgattttcatttccctaatgactaaggatgatgagcatcttgcatcttttcacatgcttattggccatctatatatcttctttagagaatacctattcaagtcctttgcccattttctgattctagtttcattttaaagtcatgatttttttttttttttttttttttttgagacggagtctcgctctgtcaccaggctggagtgcagtggcacgatctcagctcactgcaacctccacctcctaggttcaagagattctcctgccttaacctcccgagtagctgggactacaggcgtgtgcccaccatgcccagctaattattgtatttttagtagagatggggtttcactatgttggccaggatggtctcaatctcttgacctcgtgatccacctgcctcggcctctcaaagtgctgggattacaggcatgaggcactgtgcctggccaagtcatgatttcttagactgggttctgtggacacatcctaatagaagaggatctagctctcttagtttcagcttcctttgggaacccaggcctctgggctccagtaacactgcctccttcctttaccttgccaaccgagggttggtagtcacttcttgctatctctaaactctgggttacttcactgttccttttgtcccttagatcctccctcagttatgcgtcaaaatctttgcattaaattcttgctgttgtaactatttgatgtggtttctgttaccccgaatagatcttgacatagcatctaaattccctcattttataggggaagaaacttgtaccattttgtcttccaaatacattttagaattacttggtcatgttaaaggaaaaacattgcagctattccttcccataacatacttctcagtcgtaactagcaatctagcagtcataatcacttttttttttttttgagatggagtctcactctgttaccaggctggagtgcagtggcacagtctcagctcactgcaacttctacttcctgggttcaagcttttctcctgcctcagcctcccaagtaattacaggctaggattacaggcctgagccaccgtggccagcctcataatcacatttaatacaaaataaagtcacgttgtaaagactcaaatttatacatcacaatgtataaaggtaaaaattttatttttaaagaataaaattacaaaaattaaagaatttctccaaattcatatagttagtaaaaagacagatagtgttgggaccatgatgccttcatgcccagtccatttcttgttctaacaaattaaaacttcccgggttggagtgggagaggagcttttttcctttatatggttttttttttggttttggtttttcttttttttttttttttttttttggtagagagaggtcttgctatattccccagcctggtcttgaattcctggccttaaacagtgtgcccgccttccaaagtgctaggagctgggattacaggcatgagccaccacacccagcttcttactgatttattttcttttcttttttttttttttttttgagacacagggtctcacattgtcacccaggctgtagtgcagtggtgtggtcatggttcactatagcctcaaaatcccaggctcaagcgttcctcccacttcagcctcccgagtcagtgggactacaggcgtgagccaccatgcccagctaatttttaaaatttttcttttgtgaaaacagggtctcactatgttgaccaggctggttttgaactcctggcctcaagtgatcctcttgccacagccttccaaagtgctgggaatacagacatgagccactatgcccagctttgatttttttttaaccatataaatctattacctatttagaataaactaattttaaattttttaagtaaaataaaatgtttacccttataaattatgatgtataaatttgagtctttacaaaatgtctttactttgtattaaatgtgattatgattgctagttatgactgagaagtatgttatgggaagactactaagcatacaattgtgcatgagcttatacacaaacacacacataatgtagttctacatctagaaattacattaattttattattttctgtttcctagaataatggtctcaaactctttggtcacattttcctatcagtaaaaaatgttgagtttttttatttatttacaatatatcataagtatatggactaatgtgtacattaaaaacattaacaaaaacttacatttataaaaaacaaggtaaacaaattagggggagatggctgagcactgtggctcactcctgtaatcccttcactttgggaggcagaggtgggtggatcacctgaggtcaggagttcaagaccagcctggccaacataatgaaatcccgtctctactaaaaatacaaaaattagccaggcgtggtggtgggcacctgtaaacccagctacttaggaggctgaggcaagagaatcgcttgcacctgagaggcggaggttgcagtgaactgagatcacaccactgcactccagcctgggcaacaagagcaaaactctgtctcagaaaaaaggaaagaaaagaaaattagggggagacatcctaatgctttttctccaccaccccaaaagattattttgtgcatcctagggtgcacctgtcttagttggacattgttctagaatgtatcagttaaaagctgctgaaagatctcagacatgtgttctgttaagtgcctacaggttcaccaaacttattgaaaatagttaaaatggtccttgacttcagcttccagaactgttgtaagttccttagttcaaacacaaagcaataaaactggccccaataaaacacattagcctcaattctaagcagtttctgataaccataatcatagactaatgtgcacagcctttgaacttagcaattgcaacactaatgtacatgagactatttatcaccaaaaatcaagtaatctagggagaaaaaatgggagagggtatgtgtagagatttgagggaaacccaaaatatacacaaaatagtttatgacttaaaaaaaaaaaaaacgcaaaaaaaggtatgatgaggacaatacaaaactaaacctgtaaactaaacctgtttgctgggcgcagtggctcacacttgtaatcccagcactttgggaggctgaggcggatggatcacaaggtcaggagttcaagaccagcctgtccaacatggtgaaaccccatctcaaataaaaatacaaaaattagccgggtgtggtggcgggtgcctgtaatcctaactactgagctgaggcaggagaatcgcttgaactctggaggcagaggttgcagtgagccaagatcgcgctgctgtactccagccagggcgacagagcaagactcttaaaaaaaaaaaaaaatggccattatctccacttaactggtgaagaaactgtggctcaagaaagttaagtaacttgcacaaatcagacctgcaattatttattggagagttgaagtaacaggtgcattagctggacagttgctcaaaatgagtccaacttaagtgataccaaaatgtcactgtattattatttgtaaggttacagaggagttttatttaccagaactatttttagggaatatagtatatgttttgggaaaataaagaatatataagttgtttggggtgccaatgggatcaagatccccttggggtatgctggatagctggctatgaaactcttcaaaagaggaagctttcctaaatggtatctacacattttcctgtaatactcaggagtagcaacctctattttctttttctataccaacaagaatgagcttggaaagcttcatccttaaatcaatgttaaacaggatttgaggactgtcaatgaagagggggccccagttgttctgagtggtcgtacatggtgtgatcctaaatctgcttaacttcaaagttagtacccttggctgtgtaccatgctgcctctagcatgtgactgaaatgcagacagacagataggtatatagatacaaagatgggaaagaattgtgaatggtgattctaaagattgtgctactggtagtcttctcacaggagtatcttggtgtcgtgttttcttaaactttgtatcataatcacacattttcaggcagcttaaatcctttaaggaacaaaaacaggataagaatgagtgaatagataggtctccactgttaaaaaaaaaaaatctaccactgtatatttgttaccctcaggaaattactacaatcaaggagagactcgtaagaaagaacttttgcagagctgtgatgttttggggattccactctccagtgtaatgattattgacaacaggtaatatatcttttaacaatgtagaaatttattggcaataaatatgcagtgatatactcaaaagacacacaaaaaactaatgtgagtggctgagaacatcttgtatgaaaagtctagggctcggtgccatggttcacgcttgtaatcccagtactttgggaggccgaggtgggcggtctcaggagtttgagaccagcctggccaacatggtaaaaccgcatctctactaaaaatacaaaaattagctgggcattgtggtccagctactaaagaggctgaggcaggagaatcacttgaacccaggagttggaggttgcagtgagctgagatcaagccattgcactccatcctgggcgacagtgagacttcatctcaaaaaagaaaagaaaagtctacataaaataacttcacagcggggcacagtggcttacgcctgtaatcccagcactttgggaggccgaggtgggcagatcacctcaggtcaggagttcaagaccaacctggccaaacatggtaaaaccccgcatctactaaaactacaaaaattagccgggcgtattggcctacgcctgtaatctcagctacttgggaagctgaggcaggagaatcgcttgaacctgggaggcagaggttgcagtgagccaagatcacaccattgcacttcagcctggatgagagagcaagactccgtctcaaaaataataataataataacttcacatttgtttttaaatgacagcgtgattgaaataaattttttaacttctgttcggattttttttcctgacatgggtacttctctttacatctatagctttaaaaagttttattataaatttcaaaaacatacaaaagtataaagaatagtatcataaacccccatttgcctattacctaaacccactgattatcgagactttactatacagtgcttgtttcttcacctatccctaacttaacatcttttgtgtatatgaaacattttaaagaaaactccaaccaccaggttttttaccccaaggtacttaggtctgcatctcttaagaagatgggacacttttcatctagctacagacagccattatcattacatctaacaatattaacaataacagtaattctttggtgtccaccaacacccagtccatatcagaatttcttcaggtagctcaaagatttccttttacaattggtttactcaaatcaggatttcgacaaggaccacacattatagttggttgatattctgcatttaattacccttttctccaaatcagtggatttgttgaagaaactgaattatgttgtcatacagaatgtcctgcattctggatttatctgtttgtttcctgtatgtctacgttcttttttttttttttttttttttttttgagacggagtctcactctgttcccgcccagcctggagtgcagtggtgccatctcggctcactgcaacctccacctcctggattcaagcggttctcccccctcagtctcccaagtagttgagattacaggcatccaccaccacacctggctaattttttgtatttttagtagagatggggtttcaccatattggccaggccaggctgatcttgaactcccgacctcaggtgatccacctgcctcggcctcccaaagtgctgtgattatagccatgaaccactgtgtccggtctttttttttttttttttttgcacacggcaaatcagatttgggtctaactttttggggggcaagaatatttcataggctgtaccatgtactttgcatcatatcaggagacacgtactatctgttagacctatagtgaatctacagttgatcagtgagttcagatggcaatgactccctttattttaaagacccccatcaaactttcatatgttctcatgcctattgcctgaatcattaattacctagaagttgcaaaatgcttagtttccaatagtctcacatattctatgtgtactatctataattcttttgtaaaacagaatcttcactattaattaaggctacttagttaccctgctatgtataataatttgaaacaaaaaaacaggataggtgcttaattttttccccttaattgacatttttcagaataaagagttgatacgccgtacacctacagtcgtgatctattgtttgtttcttgaatgggaggacacctaactttcattaggaaattacgcgtttttatgtattcggtgtttcaggttcagtcatatgttctttaatactaaattgtcttatgtttggccagagagtctctccatgttggcttatatgtccttttcatatgacctctgtcttttatgatttccttcctttctttcaagtacaatgagattttccagtactatcttgtatactttcctgctccaattctgaaatcagccatttctccaaagagcctttgtttgtcttagtagggaatggtatttagagtccataaccagcatagtaggagtgttcattgcaatagtgttatttatttatttttttagacagagtcttgctctgttgcccaggctggagtgcagtggtgcgatcttggctcactgtagcctctgcctccctggttccagcgagtctcctgcctcagcctcctgggtagctgggattacaggtacacgccaccatgcccagctaatttttatatttttagtagagacaggggtttcaccatgttggtcaggctggtctcgaactcctgacctcaggtgacctgcctgcctcagcctcccaaagtgttgggattacaggcatgagccaccacgcctggccgctatagtgttattatttctcattgctacttgacctttatagtggacagagctaagatgtatgttttttatgtgcttttgtattttttagagacaggatctcactgttacccagggtggagtgaactggcgtgatcacacttcactgtagccttgaactcctgggttcaggcaatcctcctgtgtcagcctcccgagtaactgggactacaggcactcaccaccacacctggctttttttttttttttttttttttgagatggagtcttgctgtgtcgcccaggctggagtgcagtggtgccatctcagctcactgcaacgtccgccacctgagctaaagtgattctcctgcctcagcctcctgagtagctgggattacaggcacacaccactacacctggctaatttttgtatctttagtagagaaggggtttcgccatgttggccaggctggtcttgaacttttgacctcaagtgatccgccctcctcggcctcccaaagtgctgggattacagacgtgagccactgcgcctggcctatttttttttttaaaggaaaaaaatcagaaatatatacagatgattacaattcaaagttaatatttcaggggttttgtttaacgtcattgatatttacaatggaatctctggttgggtgtggtggctcctacctgtaatccaagcactttgggaggccgaggtggacagatcgcttgagcctaggaatttgagaccagcctgggcaacgtggtgaaaccccgtctctactaaaaatacaaaaattagctgggcatggtggcatgcccgaaatcccaactacttgggtgactgaggtgagaggatcacctgaacccagaaggtggaggctgcagtgagccaagatcatgcccactgaactccagcccggataacagagtgagatcctgtctcaaaagcaaaaaaaaaaaaaaaaaaaattgaatctcttttctgtcacactgaaagtcctttccaagaacatgaacataattacttattttcttctttaatcttttcaagaatttcagggccgggcgcattggctcacgcctgtaatcccagcacttggggaggccgaggtgggtggatcacgaggtcaggagttcgagaccagcctggccaacatggtgaaactccatctctactaaaaatacaaaaattagtggggtgtggaggcacgcgcctgtaatcccagatactcgggaggctgaggcaggagaattgcttgaacccaggagatggaggttgcagtgagccgagatcgcgccattgcactccagcctgggtgacaggatgagactccgtctcaaaaaaaaaaaaaaaaaagaatttaataaaacatgaaagaaggggctggtattatggtattatgtatactcaaaacagtaaatactcaaaactaatactaaatacaatatgactgattatgatgcctgcaatttactttaagataattcagaaaaaaataaatacctatatagattaaccccaaatgacaaaatataacaatttaaaccttagtggaaggtactggagtgtttctttttttcttttttttttttttttgagacggggtcttgctctgtcacccaggctgcagtgcagtggtgtgatctcagctcactgcaacctcctcctcctgtgttcaagccattctcctgcctcagcctcccgagtagctgggattacaggcgcccaccaccatgcccagctaatttttgtatttttagtaagacagggttgccaggcgccgtgactcacacctgtaatcccagcactttgggaggccgaggcaggaggatcatgaggtcaggagttcgagaccatcctgaccaaaatggtgaaaccccgtctctactaaaaataaaaaaattagccagatgtggtggtacgtgcctgtaatcccagctactcatgaggctgaggcaggagaactgcttgaacacaggaggtgaaggttgcagtgagctgagatcacgccgctgcactccagcctggtgcgacagagtgagaccccgtctcaaaaaaaaaaaaaaaaaaagacggggtttcgccatgttggccaggttggtcttgaactcctgacctcagatgatccatccgccttggcctcccgaagtgctgggattacaggccggagccaccttgcccgacctgaaaatttagctaggtgtggtggcacgcaccctgtagtcctggatactcaggaggctgaggtaggaggattgcttgaggccagaagttcaaagccagcctaggcaacatggcagaaccctgtctctaaaaattaaaatgaaaaataaaaatgaattttgggccagccgggtggctcacgcctgtaatcccagcactttgggaggccgaggcaggcggatcaggaggtcaagggttcaagaccagcctggccaacatggtgaaaccccgtctctactaaagatacaaaaaattagccaggcgtggtggcatacacctgtaatcccagctacgcaggaagctaaggcaggagaatcgcttgaacccaggaggcggaggttgcagtgagctgagatcgcaccactgcactccagcctgggtgacagagtgagactctgtctcaaaaaaataaaaaagaaaaaaaaaagaaaaagaaaaggcagtaaagtttaggtgagctgtgaacaaattagctttggcaaaacatatatctctttctgttgaaccttcatgatatcatacagaaatgtaaactgtgaatagtggagagagatgatgagttttgtgcttcagaatgattactctaatgaaagtatggattgaagagatcaagattgtagatgagtctattgtctttgtcccagtggagggaggatatctcaaattagggtagcagcaactgagatggagatgatgggatgaattcaactctttttttttttagagacaaggtgtcacgctgacacccaggctgtttaggcagtggtgcaatcttagctcactgcagccttgaactcctgagtagctgggactacaggtgtgggccaccatgcctggcttattttttaacttttcgtagagatgggttctccctgaattactcagtgatatgatttcgatctgtgtccccaccaaaatctcatgtggaactgtaatcctaacattggaggtggggcgttggatcagtaggaggtgattggatcatggaggcagatttctcatgaatagtttagcactatcctccttggtactgtccttgtcagtgagttctggcaagatctgcttgtttagaagtgtatagtacttcctccctctctctcttgctcctgcctctgccatgtaggatgcttgctccccctttgccttctgccatgattggaagcttcctgaggcctcctcaaaagtggaaactgctatgcttcctttatagcctgcagagccatgagccaattaaacctcttttccttataaattacccagtctcaggtatttctttatagcaatgtgagaaggaactaatgaacccaggctggtttggaactcctaggctcaagcaatcctcccacctcagcccctcaaagtgctgagattatggatgtgagccaccacgcgcagccccagccccaaggttttgttttcttttgtttttttcattttatttgagacagagttttgctctgtcacccaggatgaatgcagtgacacaatcacggctcactgcagcctaactcccgggtgcaagggatccttccacctcagcctcccgagtaactgggaccacaggcatgcaccaccttgccagctaccttttttttttttcggtagagatggagtcttgctagcttgcccaagcaggtcttgaactcctggactcaagcagtctcccactttggcctcccaaaatgctgagattagaggcgtgagccagcgcacctggcctccagtattatttaagaggtagaaataggccgggcatggtggctcacgcctctaatcccagcactttgggaggccgagggggtggggggcagatcacctgaggtcgggagttcgagaccagcctgaccaacatggagaaacccggtctctactaaaaatacaaaattagccgggtgtggtggcacatccctgtaatcccagctacttgggaggctgaggcaggagaatggcttgaacccaggaggcagaggttgcagtgagccgaaatcacgccattgcacttcagcctgggcaacaaaaacgaaactccctctcaaaaaaaaaaaaaaaaaaaaaagaagtggcaggaattcaacgaacaaaagaaatttgggataatggaaacccacctagatatctaggtggataaagattagcgagggtagtttgcaaaggaggagaattgggtatgaagagataataaattaggcatctttagcatatgggaggatgaaagtctttggggtgggctgggtgcagtggctcaggcctgtaattccagcactttgggaggctgaggtgggcggatcacctgaggtcaggagtttgagaccagcctgaccaacgtggagaaaccccatctctactaaaaatacaaaattagccgtgtgtggtggtgcatggaggctgaggcaggagaatcacttgaacctgggaggaggacggtgcagtgagccgagatcacaccactgcactccagaatgggcaacaagagtgaaactctgtcttaaaaaaaaaaaagaaaatctttggggtgaatgaaattgcccatggattaactggagtgataagaactggggatcagttagaggaaaataaaaccacaaactataatgaggagaattggaagcattgagatgtaaggtgggaatacttgagaaaattataaggaaaatgagaattatctgctcagtattaaacaaaattagcatcaaatggtataagaaatttggtaccctgctttttttactagagagtatttttagcatttttctatgtcattaaataatcattaaaagtctttaatgattgtaaagatttaatcgtgaagatgtaccataacatttaacattctcctactattgaatatttaaatctttctaatatttaagcacttacaatttttttagcaaatctctttgaagttctgactctttccataaatgaatttctagatattgaattactgggtcagagtataggactttttctttggggtttttttttgtttgtttttggagacaaggtctctgccatcaggctaaagtgcaatgacatgatcctgtctcactgcaaactctaacttctgggctcaagcaatcttcccacctcagcctcctaagtagctaggactacaggtgtgcaccaccatgcccagctaattttaaaaattattttagatccagagtcttgccatgtcacccaggctggtctccaacccttgggctcaagtgatctgcctcagcttcccaaagtgctgatattacagcatgagccaccattcccagtctatatagaactttttatagttttcttcatctaggtactaaacaattcttgttaaagttattttgattcttttttattattattgctgtgaaaaagattttttggttaagaatttactgctagtatgtagctttattgattttttaatgtatttattttatattcatcactttgaaacttctgtaaaaagcctaccagttttaacttgattccctaaagttttgtaggtaaatcatctgcaaataatgctaatacaatctttcatgttttcaacatatgcctcttatttctgattccttttttttttttttttttttttttttgagacagagtctcgcttgtaacacaatctctgcctcctgggttcaagtgattcttctgtctcagcctcctgagtagctgagattacaggcatacaccaccatacccggctaattttttgtttttttagtaaagatggggtttcaccatgttggtcaggctggtcttgaactcctgaccacaaatgatccacttcccaaagtgctgggattacaggcatgagccactgcgctcagccctgatccatttcttatttctttgagtggatttccttaatctatgttaaacaaaaaagggaaagcaggcaactttatccgtatttatgatttgattgacaacatatccagtgtttaaccattaactgtgttgttactggtgtgtgtttgtttgtttgtttatgagacggagtcttgctctgttacccaggctggaatgcagtggtgcaatcttggctcacagcaacctccacctctcgggttcaagcaattctcctgcctcagcctcccaagtagctaggatcacaggcgtgtgccacccacccagctaatttttatatttttagtagagatagggtttcaccatgttggccaggctggtctcgaactgctgacctcaggggatccacctgcctcgaactcccaaagtgttgggattacaggcgtgagccaccgtttccggcctgctgattattctttataatattaggcattggtgggaattgatgttcactgtatttgatttggggtggggatcccattcatttcagtatgctacaaagagatgaaggaaaaagtttagatttattcttgatcttacttgcttcatggtaaactactggggtcaccacgggagaatttcttctgtttataccagtggatttatagagccagactgcccagactgaaacccaagtttaaagtttttaattgcgtaacctaggcaagttactgaattctgttcctaaatttcttcctccgtaaacctcgaaagatacatggttttgagttaatttgtgaaaggagttatgggttcctttgttttcaaagatgatatcccaccctcttactctgtgagtgttgtgatttgttttttcacattaatattgtaaccgcccaaggggttcaccttgcccactgcctagacagagccaatttatccagatggagagctgcaatggtgaaagagtaattcacgcagagctgcgggagaccagagttttactgttactcaaatctgtctccctgagcattcaggcagcagagtttttaagcataatgtggtgggtggggcgaagccagtgagctgattggtcagagacgaaatcatggggagtcgaaggtctcttcttgggctgagtcagttcctgggtgggggactacaagatcagatgagccagtttattgatctgggtgatccatcaagtgcagggtctgcaaaatatctcaagcactgatcttagcagtttagggagggttagaatcttgtgtcctccagctgcatgactcctaaaccataatttataatcttgggcctaactcgttagtcctacaaaggcaatctagtccccaggcaaggaggtctgctttgggaaagggctgttaccgtctttgtttaaactatgatctataaattaagtttctcccaaagttagttcatcctatgcccaggaatgaacaaggacagcttggaggttagaagcaagatggagtcagttaagttagatctctttcactgtctcagtcataattttgcaaaggcaatttcaatattagtaatcgtgttttttctcaggcactccatttgcacaatgtcctgcctgtgcagtgtctgctttggcccagtaatgcaaatgttttcggggacaaatctgttttggagatcttggttattaagatctttactctgatagaaagcaatgtgcattcagtacactcctcaacttgggatggggttacatttggataaacacctcctaagttgaaggtataaagcggggagtttttggtttttgttttttgcttttgagacagggtctcactctgtcacccaggttagagtgcagtggcaggatcatggcttactgcagcctccacctcccgggctcaagtgaccctcctgcctcagtctcccgagtagctgggactacaggcacacgtcaccacatctagctaatttttttggtaattattttagagacagggttttgccacgttgcataggctggttttgagctcctgagctcaagcaacccacccacctcagccttccaaagtgctgggattacaggtgtgagccatcacacccagactagagtgtgttttttgttgttcttgtttttttgagacggagtttcgctcttgttgcccaggctggagtgtaatggtgcaatctcggctcactgcaacctccacctcctggattcaagcaattttcctgcctcagcctcccaggaagctaggattacaggtgcccaccaccacgcccagctaatttttgtatttttagtagagacgaggtttcaccacgttggccaggatggtctcaatctcttgacctcgtgatccacccgcctcggcctctcaagaagctgggattacaggcgcctgccactatgcccagctaaatttttgtatttttagtagagacgggattttgccgtgttggccaggctggtcttgaagtcctgaactcagatgatccacctgcctcggccttccaaagtgctgggattacaagcatgagccactacacccggcctagagtgtgttttttacttatgatattttcaatttaggatgggtttattgggacgtagccagattgtaagccagggagtatatatatatatatatttgagatggagtcttgctctatcgccaggctggagtgcagtggctaattttttgtatttttagtagagacggggtttcaccatgttggccaggatggtctcgatctcttgacctcatgatctgcccgcctcagccctccaaaatgctgagattacaggtgtgagccactatgcctggcctatatatatatacacacatatatatatacacacacacatatatatacacacacatatatatatacatacacacacacatatatatatatatacacacacacacatatatatatatatatttttttttgagacggagtctcggagtctccctctgtcacccaggctggagtgcagtggcacaatctcagctcgcttcaagctctgcctcctgggttcacaccattctcccacctcagcctcccaagtagctgggactacaggcacccgccaccttgaccagctatttttatttttgtgtttttagtagagacggggtttcaccatgttagccaggatggtcttgatctactgaccttgtgatccacccgcctcggcctcccaaagtgctgggattacaggcgtgagccactgcgcccggtcatggcacctatattttttatatatcacatgaagaccatgtagcttcagcatcactcccctactcgtgaaatgctatagtagagggatagtaagcctattaaaagtaagtacttcaggccgggtgcggtggctcacacctgtaatcccagcactttgggaggcaggtggatcacgaggtcaagagatcgagaccatcctggccaacacggtgaaaccccgtctctactaaaaatacaaaaattagctgggcatggtggtgcacacctgtagtcccagctacttgggaggctgacgcaggagaatcgcttgaacccgggaagcggaggttgcactgagccgagattgcaccactgcactctagcctggcaacagagtgagactccgtctcaaaaaaaaaaagtaaatacttaaagaagccagtttgaagattcaagaaaaatgcatcttagtctgcttgggctcccttaacaaaataccgtagacagtgtggcttaaacaatagaaatttattttcccacatttctgcaggctagaagtccagatcaaggtcttttttttttttttttttttttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttttgtatttttttagtagagacggggtttcaccttgttagccaggatggtctcgatctcctgacctcatgatccacccgcctcggcctcccaaagtgctgggattacaggcgtgagccaccgcgcccggcccagatcaaggtcttgcagggtcactttcttatgaggactctcttcctggcttgcagatgaccttctcgctatgttctcacatgctggaaagagattctctcactctctccttcttccctccctcttcttaaaaggctacaagttttattggattaaagccccactcgtatgacctcatgtgatcttagttacctcctaaaaccctatctcaaaatagttacaattagtggttagggcttcagcacatgaatttgttgaggacactattcagttcatagtattccatcccagactcccacattcatgtccttatttcatgcaaaatacattcatcccatcctaacagcctccaaagtcttaactcattccagcattaactcgaaagtccaaagtctcatctaaatagcctcaccagctgtgaacctgtgaaaacagacaagttatatatttacaaaatataaggaatggagaggcataggatagatattttcattccaaaagggagaaatgggtgacaggccccaggcaaggccaaaacctaggaaggtaaactccattagatcttgaggcttgagaacaatcctctttgggcggatattcggccctccaagccctctggagcctgtggtgggaatggtagtccttctgatctctggataacttttgaggtcattcttcccttttcttgaaggacgacgcatgtttgcagccagatagctctgttgtctggtcctgtagactcttaagtccagcaggcttctttcgtcccacccgattttttctttctcctggctgttattgaggtggttgattacatgtgtggttcacacccatgctaatcacctcatcaaatggttgttcagtcacaccagagtgctctcttcagaacaagctttctctcttttttttttcttttggagatggagtctcactctgtcgcccaggctggagtacagtggcacgatctcagctcactgcaacctctgcctcctgggttcaagcgattctcctgcctcagcctcccaagtagccgggattacaggcgcgcaccaccacacctggctaatttttgtgtttttagtagagacggggtttcagcatgttggtcaggctggtcctgaactcctgacctcgtgatccaccagccttggcctcccaaagtgctgggattacaggcttgagccactgcgcccagcctcaagctttctcatttttttacaatatggacaggctgaaaattttccaaaacctttacgttctggttccttttaaacgtagcaatttcttctttatctctcaactcttacattttactataaacagtcaagaggacccaggccacaccttcaaaattttacttagaattcgcctcagctaaatatctaatttcatccttcagaagttctatcttccacaaaacactagaacacaatacaggcaggttctttgcttctttataatagtgatcaccttttctccattttccaatgtcttatctcatttttctctgagaccccatcagaatggccttaaagaccatatttccactgacattctgttcatgattgtttatgtattctctgagaagatggaggttttctctccagtctccttttcctttcctgagtcctcaccagaatcacctttaatgtccatatttctaccaaccattccttcctggcagtctaggatttttctagcattcacctcaaaactcctccaacctctacccattatctagttccaaagccacttgcacatttttatgtatctgttacttcacagtactaaaatctgtcttagtcagcttgggctgccaaaacaaaataccatagactgggtggcttaaacaacacaaatttattttctcagagtcctgcagactagaagtcccagatcaaggtctggcagggttggtttctggtaagggtcctcagcctgacttgcacatggctgccttctcactgtgcctcatgtggtggagggacagagggagacagatctcttccttttcttatagcaccaccagttctatcagattagggccccacatttatggatttatataacctcaattgcagtagtcctcccttatccacagttttgctttctgtggtttcggttacctgcagtcaactgtggtctaaaaatattaaatggaaattccagaaataaacaatttatacatttaaaatgtacaccattctggctgggcacagtgcactcacgcctgtaatcccagcaatttgggaggccgaggcaggtggatcacctgaggtcaggagttcaagaccagcctggtcaacatggtgaaaccctgtctctactaaaaatacaaaaattagctgggcatggtggcgcacgcctgtagtcccagctactcgggaggctgagacacaagaatcgcttgaatctggtaggaaacaagttgcagtgagccaagatcatgccgtcacactccagcctgggcaacagagcgacacaaagacaagaacaaaaacaaaacaaaacaaaacaaataggattatagatatatgagaggggatttattaggggagttggcccgtgattatggaggctgagaagtcccacaacaggccatctgcaagctggatgccagaagtatggctcagtccaaggccgagggcctgagaaacaagcaggccactggtataagccctagaatctaaaagccaaagagtctggagttctgatgtccaaagacaggagaagaagaatgtatcccagcttcaggagagaggaaatcacctttttgctccatgtgggtcccccactgattgtattgtgcctacctacattgatggcatgtcttcccctgtcagttccctgaatcacaggccagtatcctctggaaaccccctcataaaaatgcccagaaataatcctttaccagttctctagataatccttaatccagtcaagttgatacctaaattattattatttttgtgtgtgtgatggagtttcactcttgttgcccaggctggagtgcagtgacatgattttggctcactgcaacctccacctcttggattcaaatgattctgctgcctcagcctcccaagtcgctgggattaccgacatatgccaccatgtccggctaatttttgtatttttagtagagtcagggtttccccatgttggtcaggctggtctcgaactcctgacctcaggtgatccacctgcctcctttgtcttgcgaagtgctgggattacaggcatgagccaccatgcctggctgatacttaaaattaaccagcacacttactgtgtctaatttataaattaaacttcatcatagttaacatgtgtataagaaaaaacatagtatatatagggttcagtaccatctgctatttcaggtatccactggggatcttggaacatatcatccacaggtaaaaggaggctgctgtacctcctaaaaacctgcctccaaatacagtcacattttgggtttagggcttcaacctaacatgaatttggagggatcacagtttaatccatagcaacacgcaacagtcagtctttcagcctctcatctcctaacccagaaaaagcagagctttggaatcttactttagattatttagataagtcaaagagaagaatgaagaggaagaagagaaagagaagttttatagaggacctgtactcgtaacaataacagtaaatataaaactactactgtcagtgccaaaaaaataaatatatgatctttcttaatcctcaaaatagtctaattatttttcccatcttacagagacacagtgggaggttgagtaatttgctcaaggtcatccagctaataactggtagagctggcatttgagctgatgcaatctgggtgtacagtatatgcttcaaccactattttccacctactccatgcctgacacatgctttcacaaaggcagtctcatttaattcttagactaactgcacaagataggttttattttctttttttgtttcacaggaagaaactaaagctcagagagattaagagaatctttgtggtcacacgtttaataaatgacaatgtgaggattcaaaaacagaaagggagatggaatagattctgactttcttcagggaagcagatcaccactttgttactgtatttgaaagacgagctgggcacggtggcttgtgcatgtaatcctagcactttgggaggccgaggtgggaggatcacttgagcccaggatttcaagaccagcctgggcaacatagtgagaccccatctctacaaaaaataaaactaacctggtatggtggcgtgtgcctgtggtcccagctccttgggaggttgagatgggagaatcgcttggggtcaagaggtcaaggttgcagtgagccttgatcacgccattgcaccccagcctgggcaatggaacaagactctgtctcaaaaaaaaaaaaaaagaccaacgtgggtttatgagtacatttaattgacatcgtatagaatcagctctattttccccttgttctgaacttcactgcaaaacatttagccagaggagctcacccaagtaaatccctcaactaatcagttaaagaggggggaaaaaatctagttctcaagaaaagaaggcataatctcagttgtaagaccactatatggggacttttggcaactttacccagtaccttaacatctagtatgatgttaaaatgcatgctgcacagatgttaacagatacctattcagtacctagaatgacactgtgctagatgctgaagaaagagaaaagcagtgaaaggtataggaaatgaataataggttttgccatgacagtcattgctgttgcatttgtggacagctatttcattatgcatgtattgaaggtcaggcctagagaggagattagagaccctttccagaatacttgggaacggtatgtgattgagaaatgcagccaacagatttggtattcatttgttgcttttgtgcttcttaacatattatgaagaatctatagaattattttatttatatttagaaaaacaaaaacacgaatttctctatgcgcagataatttttttttcctttttttttttttctttttttttgttgagacagagtctcgctctgtcgccaggctggagtgcagtggtgcaatctcggctcactgcgacctccacctcccaggttcaagcgatgctcctgcctcagcctcccgagtaggtgggattacaggcacatgccaacacgcctagctaatttttgtatttttattagagacggtgtttcaccatgttggccaggatggtctcgatctcttgacctcgtggtccacccgccttggcctcccaaactgttgggattacaggtgtgagccaccccacccggcctcttttccttttttaaatagaactaagacaagacttaggtagtatgcacagataatttctaaaaggatagataccaaactctttaacagtagctgctacttagttggagccagggaagagagataatcactttctaattccacatgaatctgtgtaggttttttttagtaagcctttattactttaaaagttatatacatataattatataattatatgtatataatttttaaaacatatatataatttaaaagactatcctacacaactaataaaactttcctccctctctactcaacttctagccatccaagtgaatgctagattacaaataattctgtgtacattttgataatattttatttgataagttcaaagcatagaacagagttcctttaaaagataacaatgcatttaaacctttttataaacactgtagtcttctcatgggcttctttctggaggatgaatggggagtaacccagggacaccactcctaagtgcttagactagaaatggtggggagtcagaaaagaactgtttatggtggaataaaacaaagaaggctgggcgtggtggcttattcctgtaatcccagcactttgggaggccgaggtgggcggatgacctgaagtcaggagttcaaggccagcctgaccaacatagagaaaccgcatttctactaaaaatacaaaattagcttggggtgatggcgcatgcctggctgaggcgggtggatcacaaggtcaggatgcgccatcacgcccagttacccgggaggctgaggcaagagaatagcttgaacccgggaggcggaggttgcagtgagccgagatcacaccattgcactccagcctggacaacacgagggaaactccgtctcaaaaaaacaaacaaacaacaacaacaacaaaaacgtaaaacaaacaagatccctccaattaaaacccatgcctattaaagtgcatgggggcccaatgacctactgtttggcaaaacttgaaggtctaaaagctgttcatggtcaaagaaacaatttatagttgaggtgatggatatgataaatagcctgatttgatcaacctacaatgtatacttacatcaaaatatcacattgtaccccataaatatatacaattattacttttttaaaagattttttaaaactttttaaaaatacacacaaaaagcagtttgtggtctaatttctttttccttgctcagcctcatcttttagcacctgtttatacacatatcacctctattcttgtaacaaaaataggtagaactggccagacacagtggctcatgcctgtaatcccagcactttgggagaccaagatgggaggctcaatagtttgagcccaggaattcaagaccagccagggcaacacaccagaccctatccctactaaaaattaaaaattagccaggcatgctgcacaccagtagttctaggaacttaggaggctgaggcaggaggatcatttgagcccaggagttcaaggctgcaattagtgatgatcatgccactgtactcccacttaggtgacaaaacgagactttgtctaagtaaaaaaaaaaaaataggacgtcccagtaccccaatctatgtctctcctctccatctcccagtccatatttaagctgtgcctcaaatataccatgctgtctaatgcatccacacctttgcatgtgctagtccctcctctaacacacttccacattttccaacgcccttcatcttgtccctctagcaaccttctgtttattcttcaaaagaattatcttagatcccatggcatcatccctaatttgccccaggttttcttggacacttttgttacattcccattgttccactgtattctagcatatacaccaatttttttttctttttttcttttcttttttgagatagagtttcgttcttattgcctaggctagagtgcaatggcgtgatctcagctcaatgcaacctctgcctcccgggttcaagcgattctcctacctcagcctcccgagtagctgggattacaggcatgcgccaccacacctggctaattttgtatttttagtagagatgaggtttctccatgttgttaaggctggtctcgaactcgcgacctcaggtaatccgcccacctcggcctcccaaagtactgggattacaggcgtgagccaccgcacctggcatatacatgaatttttttgtttgtttggttggttgtttttttgtttgttttttttgagatagagtcttgctctgtcacccaggctggaatgcagtggcgctatctcgactcactgcaagcttcgcctcccaggttcacgccattctcctgcctcagcctcctgagtagctgggactacaggcgcccaccaccacgtccggctaattttttgtatttttagtagaaacggtttcactgtgttagccaggatggtctcaatctcctgacctcatgatccacccgcctcggcctctcaaagtgctgggattacaggcttgagccaccatgcctggcccatatacactagttttttactgtaggccgtaaggccctttgaaccctcgatatataatacttgctcaattatgtttgtttagtaaaggaatgattccatttgcaccataaactctcttcctgtgaccagcatatgaatgtgtgtgtggtctctaagaactcgaatgatgcctaagctatccaacccactttcctcagtttttatttacgcagaaattgaaattaacaaactaatttctgagtcttaagtgaaattgttttcgttttatttaaagttacccttgacttacatagttttaaccttctggaaagttcttcttttttctctctctcttcctgttcctgattgccacactggatagaaagttctaaatgaatacttaggtttgaaagtatttttctacatctatttattttgccattctacagatttggctccattgtcctaaggtttcagcacaataaaaatctcgtttctcccagtgcttgtcttgacatcaatgtagcattaaaaagtccaagacttttacagactaatttaagctgaacaaggaaatatcatctggtacctactaagaaacataaatgggcctgggttgctagcagttcctggaagtcactgtgttttccaataaatccatgcaaatcgtaacagggaaagagaagccacaaagcagaggctgggactgttgggatcatgttagtaattaaactctctctcctcttgagactcagtgagagccttccccttacaaaaaaacaaaaaagaccatagcttgctgccaaagcggatctgaccacgcgtcctctcactctaagagattaaaataaagcctcctgcagtccttttctccaaatacacaaagaagtggctgggctgaggctcaagggcacagttccagtccctgttggcaagagaagggcagggctctggttctcccaaagggtgcaaaggacaagaatgtttcctagaaaagaaaccagggaaggagaccaaagtagacctagctgatatggagctgttatgtgaaaactgaaagctgcttcgatactacttcaaagccagattattctgggaactgaagggagactgagccttcaagtaatatgactagggaagtcaagtacaaaaaaaaaagtgagaccaggaaggaacaaagcatgcatttggagctaataccactcattggaagaggttgtttggaaaaggtttgcaaataccacaaaaatgggattcaaagtgtctttatgtattgtgatattcattgcagcactatttataatagcaaaaaactggtagcaactgaaacatctagcagtaggtgaactgttttatagccatggtctagaacattaaaccacaatttaaagttttctgtgcatatttaataacccaagaagatgttcataatataatattgagggtttttttgttgtttgtttgtttgtttgtttgagacggagtctcacactgtcacctgggctagagtgcaatggcatgatctcggctcactgcaacctccacctcccgattcctctgcctcagcttcaagcgattcctctgcctcagcctcccgagtagctgggactacagttgcatgccaccacgcccggctaattgtgtattttttagtagagatgcggtttcactatgttggccaggctggtctcaaactcctgatctcgtgatctgcctgcctcagcctcccaaagtgctaggattacaggcgtgagccaccgcgcccagccgtttttcaccctttatagttgttttttgtttgttttgttttttgtgtgtttgtttgtttgtttgtttgtttttgagacagggtatcactctgtcactggagtgcagtggtgcagccttgactcactgcagcctctgcctcctgggctcaagtgatcctcagcctcccaagtagctgggactataggcatgctctaccacactagggtaatttttgtgtttttagtagagatgagttttgccatgttgcctaggctggtcttgaactctttgggctcaaatgatctgcccacttcagcctcctaaagtgctaggattgcaggcgtgagccaccatgccagccagtctctttttaagaccctcttcctgatcatttgagcccaggaagtcgaggccgcaatgagccatgcactccactgccactgcactctagcctggacaacagagatcctgtctcaaaaaaaattaatgtccttaaaaaacaaacaacagaccaggcacggtggctcacgcctgtaatcccagcactttgggagactgaggcaggttgatcacctgaggtcaggagttcgagactagcctggccaacatggtgaaaccccgtctctactaaaaatacaaaaattagccaggcctggcggcgggcgcctgtaatcccagctactcaggaggctgaggcaggagaatcgcttgaacccaggaggcggaggttgcagtgagttgagatcacaccattgcactccagcttgggcgacaagagtaaaactccatctaaaaaaaaagaaaaacccaaacaaaaagaacactagttgcctctgaagatggtgagcctctgaagatgcctctgaggctcaattttgagggaattctatatcctgttaaaagtccaaggtgcagcatgtaccagatggctgtatgccctcctctttctggggcagggttgacagtaataggcaggaatgtatcatatatatgtatcatatattttgtggttttcagcagtgggttttttttttcctttcttaatagaaattgatgctatttaatttttataccttttgttgttgtttttaatggggtttgagagaagagagtaaagtgaaaatgtcactagtcctttaattagaagtccatatttccaccgggcacggtggcttatgcctgtaatcccagcactttgggaggccaaggcgggcggatcacttgaggtcaggaatttgagagcagcctggccaacatggtgaaaccccatctctactaaaaatacaaattaactgggtgttgtggcgggcacctgtaatcccagctacttgggaggttgaggtgggagaatcgcttgaacctgggaggctgaggttgcagtgagttgagatagcgccactgcactccagcctgggccacaggagcaaaactttgtcagaaagaaagagagagagagagagagagagagagagagagaaagagagagagagagagagagaaagagagagagagaaagagagagagagagagagaaaactcggaagtagactttttttttcttttttttttttttagatggagtcttgctctgtcgcccaggctggagtgcagtggcgtgatcttggctcactgcaacctctgcctcccaggttcaagcaattcttctgcctctgcctcccaagtagctgggactacaggtgcctgccaccacacctggctaatttttgtatttttagtagagacggcattttgcgatatcggccaggctggtctcgaactcctgacctcctgatctgcccgcctcggcctcccaaagtgctgggattacaggtgtgagccacctcacctggcctcttttatttttatttttatttatttatttatttatttattttgagacagagttttgctgctgttgcccaggctggagtgcaatggtgcaatctcagctcactgcaacctccgcctcccgggcccaagcgattctcctgcctcagcctccggagtagctaggattacaggcatgcaccaccatgcccagctaattttatttttagtagagatgggatttctccatgttggtcaggctggtctcgtactcctgacctcaggtgattgacctgccttggcttcccaaagtgctaggattaaaggtgtgagccaccacgtccagcctggaagtagacatttttttattaaccaaaatgaatttagttagctcaccattgcctctacaaaaattgtactgggaccaaaaactttgtatatgagacaacaaattttctaaaatgcaaatcttaaagacaaataatgttagtgtccagaagaaaggttattgggtcagtctttcagattatttccccataacaccaagttccaaaaaacaatttctagtcatttgtgggatgctccagagagcccttgggacaagtaaagttgcagctgtttgtgtgtgttgtaattcaagatgatgtgttgctacatctactagtttggtacaactgttatgatcagatagacctagttccttaaggctgagacacaacagtctggtttctgtaatggaaggatgagtaggctttattctgttttgttgctttttttctttctttcttttaaataatacattctaagcctcgatcctggactttgcaggaaaaaaaaaaaaaagaataatacattctaccctcacatatagtcaattgattttcaacaatggtgccaagacaattcatggggaaagaatactcttttcaacaaatggtgatggaacatccacatgcaaaataatgaagttgactttgggaggccgaggcaggaggatcatttgaacctagggagtttgagaacagccaaggcaacagagtgagaccctgtctctattcaaaaaaacaaaaagaaagaaagaaaaaagaatgaagctggactcctccctcacaccacacacaaaaattatctcaaaaaaaaatctaaatataaagactaaaactataaaattcttaaaagaaaatataggaatcttcttgagcttggatttgctgatgattttgatggcagcagcggcctgtttggagtggtggctactgccatgacaccagcattgaggggactggtgggggagtgggcatggctggggctgcacactccatggagccaacggaagccaagaacaggcgggagccctactcccttctgagttggcagggccagtgcagctgcagccaaccagctgtagctgtggacccaggcatccctgcactcttgactcaggaagccccctgcccccacaggctcaaaaatgcctgctcccactgcctggcctcttcctgttcctggtgcccgctccaattttggagcaaagttgaggctgagcccaggcactgtcgcaacctgccacagtgcacgcatgctcagggcagcactgatacaccagccccctgccaacttggccctctctgggctttgggcagagatgagcacaagtgggaggccgagggggtgctgagggcagctcaccatgggcctgcaggcaccccttggcacaaacagccttggtgccatggacacttggatggcagattgatggcagcaggaggcagacaggctcgtggactgaaaggggcaggtgcccgatgaagccccaccttcaagccagtgacagcctgaagcctgtgggctgggctgccagttccatggactggagtgagaacttatggtgctttttctggacctgcccatggcaaaccatggaccaattcagcactcatttcctcccctctgaagcccataaaaacctcagtctcagccagattcaggcagacaacaggaagacctgcctgctgttaggagctactcactccatgtctcttctccactaagggctgcagagatgatgggatgatttgcctgcgaataggagctacccactccaggtctcctgtctgctgagggctgcacagacattgggatgacctgcctgtggaagggagctactcactgcaggtctcttctcctctgacagctggatactcgttgggatgacctgcttgcagaaaggagctacccactttgggtctcctgagaatggttctgcctctcagtgaagctcctctctatcttgctcaccctctagttgtccgtgtacttcattcttcctggacagggaacaaaaactcaggacctgccaaatagcggctaaaagagctgtaatacagccggtcacagtggctcacacctgtaatcccagcactttgggaggctgaggtgggcagatcaggaggtcaggagtttgagaccagcctgaccaacatggtgaaacccccgtctctactaaaaatacaaaaattagctgggcatggtggcacatgcctgtaatctcagctgctcaggagtctgaggcaggagaattgcttgaacccaggaggcagaggttgcagtgagccaagatcatgctactgcacttcagcctgggcaacagagtgggactctatctcaaaaaaaaaaaaaaaaagagctgtaatacaaatagggctgaaacatatccctctgcttgccacattcccagcaacaagaagaaaagaactgcagccctttggagagcccggcccaggctgttgcgttgcctgctgggctgagtgggcagaacaaacccagtgggtgcaagcaatactcaggcagaaggcatcactggccacagaggtttctagctggcgaagcaacaccccaaggatcctgtgacaatttattgaatatgacaccaaaacagtaatcaacaaaagaaaaaatagataaattggacttcgtcaaaattaaaaacttttatgcatcaaaggacactatcaagagtgaaaagacaatctaaagaatgggagaaaatgtttacaagccacatagctcatcagggattgatattcagaatatataaagaagtcttacaacaaaaagacaaaaaatagggtgggcacagtggttcacacctgtaatcccaatactctggaggcagagagaataataatacattattattattgcttgaagccaggagtttgagacccgcctggaatttgagacagggatgatccctccacctcagtgcctcccaagtagctgagactacaagtgcgcaccaccatgcctggctaatttttttgtattttttgtagatatgaggtttcaccatgttgcccaggctggtctcgacctctgaggctcaagtgatctgcctgcctcagcctcccaaaatgctaggattataggtgtcagctaccaagtatggctcaaaaagtaatttaaaaattattaaaattgccactgtggccaggcatggtggctcatgcctgtaatcccagcactttgggaggccaaggcaggcagatcacttgaagccaggagttcaagaccagcctggtcgacatggtgaaattccatctctactaaaaatacaaaaattagccgggtgtggtggtgcgcacctgtaatcccatctactcaagaggctgaggcgggagaatcacttgaacccgggaagcagaggttgcagtgaggcaagatcacaccactgcactgcagtctgggcaacagagtgacaccctgtctcaagagaaaaaagacaatccaattgaaaaacaggcgaaggacttgagtaggcatttctccaaagaaggtatcaaatgggccaaatggccccaaatcacatgaaaacatgttcaacatcataagtcattagtggaatgcaaatccaaaccacagtgagatgccactcacacctacataaattttttaaaggaaaaataaaagtgttcgtgtgaatgctgagatattggaaccctaatacattgctggtaggcaagaaaaatgatgcagccaccacagaaaacagttcggcggttcctcaaaaacttaaaaataaacaccaaatacaaatggtttgtgtctgtaaccccagctacttgggagactgaggcaggaggattatttgaggctagttcaagaccagcctcagcaacatagtgaaaccccatctctaaaaaaaataaaaattaaaaataaacatagaattaccacatgactagcaattctctttctaggtaaatgcctaaaagaattgaaaataataattcaaacaaaaacttgtatatgaatgttcatagcaacactattcacactagccaacaggtagaaacaaccaaaatgtttgtcactgatgagtggataaacaaaatgtagtatgttaatacaattagaatattatttagccataaaaaggaagaaaatactgattgatgctgtagcatggatgaacctggaaaacattatgctaagtgaaataaattagacacaaaaagctacataggattccatttatattaaatgcccagaagaagcaaatccatagaaacagagtatataagtgtttgccaggggttgggaggagggaaaaatggggtttattataatatggtttatttggggggggggatgaaaatgttctagatttgataattgattgtggtaatggctgcacagctctgtgaacttactaaaaaattgaattgtacagtttcttttatttcattgagataggatctcgctcccaggctggagtgcagtggcttagtcacagctcatggcagcctcaaactcctgggctaaagtgatcctcctgcctcagcctacagagtagctgggactacaggcacacactaccatgcctggctaattatttttatttttagtagatatgaggtctcactatgttgtccagtctggtctcaaactcatgactgcaagcgatccttatgccttggcctcccaaattacagttgtgagccaccacaactggccaaattatacactttgttttattggtttttttttgtttgttttgtttaggtttttttttgttttttgttttcttaaacgaagtctcgctctgttgcccaggctggagtgcagtggcgtgatctcggctcaatgcaacctctgctttccggattcaagcaattctcctgctcagcctcccaagtagctgggactacagtgtgcaccaccacgcccagctaatttttgtatttttagtagaggcagggtttcaccatattggccaggatggtcttgatctcctgacctcatgatctgcccatctcggcctcccagagtgctgggattacaggtgtgagccaccacacccagcctgtaaatgttgactttttttttttttttttttttttttgagacagagtttcactcttgttgcccaggctggagtgcaatggcaaggtatcagctcactgcaacctctgcctcctgagttcaagcgattctcctgcctcagcctcccgagtagctgggattacaggtgcccccaccaccactcctggctgatttttttttttttttttttttgagacagtctcattctgttgcccaggctggagtgcaatggcgtgatcttggctcactgcaacctctgcttcctgggtttaagcaattattctgcctcagcctcccaagtagctgggattacaggtgcctgctatcacacccagctaatttttatatttttagtagagatggggtttcaccatgttggccaggctggtcttgaactcctgacctcaagtgatccatccgcctcagcctcccaaagtgctgggattacaggcatgagtctctgggtatggccttaatcttttgtatttttagtagagacgaggtttcaccatgttggccaggctggtctcgaactcctgacctcaggtgatccacccacctcggcctcccaaagttctgagattacaggtgtgaaccaccacacatggcctatataaattgactcttaataccagaaacagattagctgctctagaaaataactgcctagctctttgaaatgcctcacctagaatgtcctcacaaggagttttgtgtatgccatgtaacctttaagtcaaactagtcttcccaaacacatcgtcattattattattattattattattattattattttgagacagagtctcactcttgcccaggctggagtgcagtggcgtgatctcagctcactgcaggttactcactgcaacctctgcctccctggttcaagtgattctcctgcctcagcctcccaagtagctgggattacaggtgcccaccaccacgtctggctaatgggggtttcaccgtgttggccaggctggtctggaactcctgacctcaggtgacccgccctcctctgcctcccaaagtgctgggattacaggcgtgagccaccgcgcctggctactttccatattattgaaatgtgatgtagtcattttcacatgacaatgtgaataaagagacaaacttagttttataatgtttcacatcaatttatataatgcttatagtccttctaagagggtaaaggcctttgtgaggaatcagccaactggctgcagagtagtggtattatttttttctgtatgagaagggaagtgacactgtgtcattgtgaggtaacagaaagggatttggagaagaacacctaggaataaagggaatagtgttaccttaagactaacacttagggatatatggtaaggtaactaacggtgaccttaagggtgctgattaggtcacattcataaatgggtggggagtgatgccaaagggcacatagtgagcaagttgtggtcacgaggtgattaggacagatgatttagggctggagactcctgtgggtgttaacatgatgactgcataggtgctcaagactgcccatggtggagtattagtccccacaacctaactggcatcaagaatcagggaaaccagaccaggcgtggtggctcatgcctgtaatcccagcactttgggaggctgaggtgggcagatcatgaggtgaggagttcgagaccaacctggccaacatagtgaaacccctctctactaaaaatacaaaaattagctgggaatcgtggcacgtgcctgtagtcccagctacttgggaggctgaggcaggagaatcgcttgaacccaggaggcagaggttgcaatgagccaagatcacaccactgcactcgtagcatgggcaacagagcgagactccgtattaaaaaaaaaaaaatcaaggaaactttcttagaaacagctgggtcttaatagtctcaacaagttaaggagagtttctgggcttcagaccccgcatttccccccatgccctgaagagcattatagaccctgtactttaagaagagtaaaagtcctgagtatcctgttaggaatcatcccatccctgggcagcttctcctcagtactaaccatgaggaaggggaactgagggccctttcacccagagaggactcttcatcctgaagagaagtgagaggacatgtctgaaaaacacaccaagataaagtatctggctgtcatgactctttctagaaaaatctcagtgctgttttacataacctcattcatctccagaattagaatgagtatcttctggcctggtgtggtggctcacacctgtaatcccggcactttgggaggctgaggcaggcggatcacctgaagtcagtggttcaagagcagcctggccaacatggtgaaaacccatctctacaaaaatacaaaaattagccctgcatgatgggggaggctaaggcggaagaatcgcttgaacctgagagagggagcttgcagtgagccgagatcgcgccattgcactccagactgggcaacagagcgagactccatctcaaaaaaaaaaaaaaaaaaaagaatgaatatcttctattacttcatttattgtgccaggtactcttactcttgggcaactgaaatcatggcttcatatctatgaattgagtgaggtggtactcacatcaccagcctcttatgttgaccgaatcaagacctttaactgcctagtagactgacttacaagtggagctgctcaacagataatagtttctttttttttctagacgggagtctcgctctgttgcccaaggtggagtgcagtggcgctatctcggctcactgcaagctccgcgtcccaggttcatgccattctcctgcctcagcctcctgagtagctgggaatacaggcgcccgccaccatgcccagctaattttttttgtatttttagtagagacggggtttcaccgtgttagccaggatggtctcgatctcctgacctcgtgatttgcctgcctcagcctcccaaagtgctgggattacaggcgtgagccaccacgccttgctctttttttttggggggggggggttgtcgtggaaattaagtttatgaatctccttgatctctgaattattccaaacagcaccatcccagcaattccttttaattgtttttagaactacagttgacctttgaacaatgagagggttagggtgccaactcccaccaatgcagctgaaaatctacataaaagattagattccccaaaccactagtagcctattgaccagaagccttcttgataacctaaacaattaacacatattttgtatctttatcatatactgtatttttacaataaagtaagctagagaaaagaaatgttattaagaaaatcataaggaagagtaagtgtatttactattcatgaagtggaaatggatcatcatgaaggtcttcatccctgtcttcacattgagtaggctatcttgctgtctcaggggtggcagaggcggaagaggtggaggaagtggatggggaggcggaagaggtggaggaagtggatgggaaggcgggagaggcaggcacacttggtgtaacttttgttgaaaaaatatctttgtataagtggacccacgcagttcaaacgtgttgttcaagggtcaactgtggtcatattgtcggggttctttagccattaggtctcagaaattagcctgaatttagccagacatagtagcacacgcctatagttccagctgcttgagaggctgaggcgggaagatcacttgaacccagactgcagtgggctatgatggtgtcactgcactccagcctgggtaacacagtgagactccatatcaaaaaaaagaaaaaaagaaaaaaaaaagaaaaggaaagaaattaacccgaatttgtggtttctaacttggcaattagtctttctttgaccccaagtttagactcaatatcttcactaagagccagcccagggggtgcaacttggagcaccagaatgtttgtgtaatactagccatggtaaagaaggtgtcccaggctctcctggtggaggcaggctctgctctacttaactctactccaggcaagagcagacaaagagcagactctttagactggtaagcagaacagactcgtccctcaaggagctcccagaccagggaggggaggagactgtaaatattcaccatgccgtggtaacagcagagatggagcacaaggggaagttcagagaaagatctcagaagagaggtactttgtctaacctgagatttagggaaagttctcctgaagatgatgactggtctacatgacctgagccgagatgggaatgagttgaaaggtaggcttgtgaagaagcaggagaagagcattatagatagaaaactcaaaggcatcagaggccccaagctgcatgctatgatattgggataatagtagtacaaacatagtgcaagacagtggtgtaaagtgagatatttgcttctgagccatttcccttctgttgccacttcctcttcctcttttaagtgaaacattactagcagcctaataattatcatagctgacatatattaggtgttttttgttttgttttgtttgttttgtttttcttgagatgaagtctcgctcttgttgcccagactggactgcaatggtgccatcttggttcactgcaacctctgccccctgggttcaagcgattctcctaccttagcctcctgagtagctgggattacaggcgcctgccaccatgcctgactagttttttgtatttttagtagagatggggtttcaccatgttggccaggctggtctcgaactcctgacctcaagtgatccacccacctcagcctcccaaagtgctgaaattacaggcatgagccactgcgcctggcgtttttttgttgttcttgttatttgtttttttagatgggagtcttgttctgtcgcccaggctggagtgcagtggcgcaatttcggctcactgtagcctctgcctccaggattcaagcaattctcctgcctcagcctcctgagtagctgggactacaggcgcgtgccaccacgcctggctatttttttgtatttttagtagagacagggttttaccatgttggccaagatggtcttgatctcctgacctaatgatctgcccgcctcagcctcccaaagtgctgggattacatgcgtaagcaaccatgcccagccaggtttttactctgtccaactctattctacatcccttaaatttattaacttgttaaattctctaggagtaaatgctgtcattactcccattttacagatgaggaaactgagtcgggggagattaagtaacttctcaaaggtacacatagggccatgtggtctgtcatctctgctttagctgacacatatggcctctatagcctaggctttacatggccagtctccatccagactgactagagtggtgttttgtaaaatatagaggttgatctgcagcctaggtgcaatagaattacctggggcaggccaggcactgtggctcatgcctgcaatcccagcactttgggaggctgaggcaggtggatcatctgcagtcgggagttcgagaccagcctggccaacatggtgaaaccccgtctctactaaaaatacaaaaaaaattagctgggtgtgttggcatgtgccggtaatcccagctactcgggaggctgaggtaggagaattgcttaaatccaggaggctagggttgcagtgagcctagatcacccactgcactccagcctggtaacacagcgagactccgtctcaaaaaaaaaaaaaaaaaattagaattacctggggcatttgataaaacacagatacctaggctccactgtactctgcatgaatctaatggggtgggtgattaagaacctgaatttttttttttgaactccccagatgatcctaaggcacagtaatgtttgggaacctctgggctggagtctctgggttgaaatccaagttttgttctgttttttttaagaatgagtcattgcatctttcaagtattcaaccaagattgtcttcataatcttacacttcattcatctgtctttacaaagttacagagctgaagccatatcctgtttcttcagcactcatctatactttaaaaattctaggccaggcatggtgggtcacgcctgtaatctcagcactttgggaggccgaggcgggcagatcacctgaggtcaggagttcgagaccagcctgcccaacatctgcgaaatgctgtctctactaaaaatacaaaaaattagctgggcatggtggtgggcacctgtaatcccagctactcaggaggctgaggcaggagaattgcttgaacccaggaggcggaggttgcagtgagccgagcttgcaccactgcactccagcctgggtgacaagagcgaaactccatgtcaaaaaaaaaaaaaaattctaatcagatgccagtctcactgtcattctccaatcttcccactataacatatttagttcattgtcctgcccgtgttctaattttgcagttttcctagactgatcctctgtgatccaacaattaattataaattattaattataaattaattaattataaattaataaaaattgtgatcccacaattaatttcaaatttattaaatagaacctgagaaaaaattatgcagtatttttttcattagatgattgtcagcctcctaccaacaagcatatgctagatgttacccatgaaaacttaagtagtcaggccaggcacagtggctcacgcctgtaatcccagcactttaggagattgaggtaggcggatcacctgaggctaggagtttgagaccagcctggccgacatggtgaaaccccatctctactaaaaatacaaaaattagccgggtgtggtggcgggcacctgtaatcccagctactcgggaggctgaggagaatcacttgaacccgggaggcagaggttgcagtgagccgagatcgcgcaactgcattccagcctgtgcgacagagcgagactgtctcaaaaaaaaaaaagagaaaaggaaaagtagtcatgatccctcccttggactcatttccagtgtaaaggttattaacctttttgtaattgggatgtattatgaatgactgctcaattcaacaatgtacctttttcctcagtaattcctaaagaagtcatagaatgtatgtatttctttattgaataaagtctattaaaattattgtgattctaaggcatcttagggaatttcattatgtctcctaaagctagactcaaaaatagaattaggaattattcttctttagcaaccttcattatgtgtcttaaagctagactcaaaaatataattaggaattattcttctgtagcaacctcaagcagtccaggatcagtcctcagctccaccttttgtgacagtgggcaggcacattcatgctctgaccctcaggcttctcttcatcaaataggagccttgtgttagattatctctgaggttttttcacaactagcattttgtggttcaataaacagaataattgtcctgcaaataggtacgtaccctaaatagggttacagataaaatacaaagtgcctaactaaattttagtttcagataaacaataattttttaatgttaagtgtgtcccaaatttcacatagaacactttttttttttttgagatggagttttgctctgtcgcccatgctggagtgcagtggtgcaatcttggcttaccgcaacctccacctcctgggttcaagcaattcttctgcctcagcctcctgagtagctgggactacaggcgcacaccaccacacccagctaatttttgtatttttagtagagatggggtttcaccatattggccaggctggtctcaaactcctgacctcatggtctgcccgcctcagcctcccaaagtgctgggattacaggcgtgaaccactgtgcccggccagaacataattatactaaaaaattattcacttgtttatctgaaattcaaattttattttattttattttcattattttttgagacatagtttcctctgtctcccaggctggtttcaaactcctggcctcaagcaatcttcccaccttggcccccgcaaagcactgtgattataagtatgagcctccatccatgcccagcttaaaatcaaattttaactggcatctgctattggcaaccctaaccccaaagccattgctttttatcccattttgtgaaagtcagtgtcactatttccctactgtgagcttgcttatttctgccttttatccttagcctgaaacaagttgtgaatatcaaatttccactcactccattgctttacctatgaaataaattcccagaacttagaatagttaacagcaatctgtttcctagaactagctgccaggactacacctggacatctgttatttacagcctcattattgacattttgtcaatagttctgacctatgccatgtaatctgttatagtcatagcatgccttcctggaaattttcatttgcctctattcctattgtattatttgggttctttccatatttgtttgttcaagattctctcatcattaaaaacaaataaacaaaaacctctacttaaccctcctcatcccattactgctctacttctcttccttcataaccaagtattatctacatgcattgtcttcacatcctgttattaattccccaatgcattaaattctggctcatcgtcctactacttctcgctgccattgaagctcctctttccagagtcactggttacttcctatttgtgaaatcagtaggaagcttttcagtcccagtcctactggacctctcagcagctctggccaatgctgaccactcccccaatccagaaaccactcttggcttctgtaacagtccctggctccagctgtcctcctacctccttacttccctggccacttgggtcggtcaccttcagccattcttgtcatctgcctggtcctctatgattctcagtgttcgatgcacactctgtagttgtgattgaggtatttacaaaaaactggtgccccactgagccaggttcacgtggaagttgggatgaaacaggattctgagaggacatgggaggaacatgggtttcactttgtttctttattaatctttgaaatgtgtttgtttattcatttagcactcattttttgagcatatactatatctcaaatatcaggtcctaggagtacaaaatggcaagtcaagtccttgccctcaaggagcttgcagtctaggaaaagccaacaaaccaactaatgatgtgaggacagcacacaaaggtaccatggactcagatgcaggagccaggaaagacactagagacaggttgcctgtgatctgagctttaagagacaagtaggaattagccaggtgcattccatatgagttcttccagatagctggagtccacatgcctgagggaatatgacagaagatcaagtgagggagccaggcaaatgccagatcacaaagaccatgtgtcaggtgaaggttatggaattgaaatgtcttaaaactataaggagctttgaagtacgtcaaaatgggcaataaattgatctgattttcattttagaaagacttcttttgacaacactgtggaaagcagcttgggaagggggctccagacttggtgcagtggaaccaataggcatggtcacgtgagaaatcagagtcagaaaaaaaagcagtggcaggggaaattgagagaaggagatagtttctagtgctgctacagaggtagctattctaaggcttgatgaccaattggttgtcaaagataagagggaggaaaaaaaacaaagggtctcccagatgtgtgcatttagtgactgcataatgcatcacctccactaaatgattcatctgttcttcatccctgttagtctggacaccaaaaatatcactctgcctaaaggggggaaacatttctttgagggaaaacccttttgccctatagctaaactaagccattggaaactttttagggcagaaatgtcagaggcatgaacagggcttctggaggagggtgaggtctccaggttctcctggctagtgaagaggctcatgttctcattagcaaactgatggcctccatcgatggccgtgatactcacagggcgtggttcaaagccccagatcatcagggcttctagagtgtacttaatcaggacaggcatttatttaaagtgctctgaagctaactgtcacaaatagggaaccttagtactggtcagttgggaaccaaggttattaccaagaagatagtgtcaggtgtcaagtgtggaagtcaggacaaggccagatgtaggagataagagtgaaaccagacgtgagaaggttggagcgtgtaaaggaaatgggtcacaggacaagcagttcagacctgaggccaagaagaggaaggcaagagttctcttgcggatctcagctagaaaacattgctgtagaacataggtcactttgtttgtttgtttatttatttatttattttaagcaaaagcaagtttattaaggaagtaaaggaggccgggtgcggtgactcacacctgtaatcccagcactttgggaggccgaggcgggtggatcacctgaggtcaggagttcgagatcagcctggccaacatggtgaaacctcgtctctactaaaaatactaaaattagccgggcgtggtggcagccgcctgtaatctcagctacttgggaggctgaggcaggagaatcgcttgaacccgggaggcagaggttgcattgagctgagatagccccatggcactctagcctgggggacaagagcaagactacgtctcaaaaaaaaaaagaaagtaaagggataggccgggcactatggctcactcctgtaatatcagcgctttaggaggccgaggggggcggatcacctaaggtcaggagtttgagaccagcctggccaacatggcaaaaccccgtctctactaaatatacaaaaattagccgagtgtggtggcttgcgcctgtaatcctagctactcaggaggctggggcaggagaatggctggaacccgggaggcagaggctgcagtgagctgagatcacaccactgcaccccagcctgggcaacagagcaagactccgtctcaaaaaaaaaaaaagaaaagaaagaaagtaaaggaataaagaatggctgttccaccggccagcaaagtgggatgctccactaaggacacttacagtcattttctgattatactctaaacaagggctggcttattgagttttctgggaaagaggtgggcaattcccagaactgagggttcctcccattttagaccatagagcgtaacttcctgacgttgctatggcatttgtaaactgtcagtggcactggtgggagtgtcttttagcatgctgatgcattataattagcgtataatgagcaatgagaaccaccagaggtcactttcattgccatcttggttttggtgggattttggtgggatttttattgcaggttgttttatcagtaaggtctttatgacgtgtattttgtgctgacctcctatctcatcctataagtaagaatgctaacctcctgggaatgcaacccagtaggtctctgccttattttagccagcccctattcaagatggaattgctgtggttcaaatgcctctgacatatttcaccccttccttttataagagaacccttaatcctaagggctgtagagggatgaagatccatcttctgtgacttcttcaggctgaataggggcaatgatattactgcctattagggtctcttgtatttggggtagagaggagctctgtcagaaagtgtcagtatggaggctgggtgcagtggcttacacctataatcccagtgctttgggaggccaaggcaggcagatcacttgacatcaggagctcaagaccagcctgggcaacatggtgaaaccctgtctctactacaaatataaaaattagccaggtgtggtggtgggtgcctgtaatcacagctactcaagaggctgcggcaggagaatcatttgaacccaggaggtggagtttgcagtgagccgagatcaggccactgcactccagtctgggtgacagagtgagactctgtctcaaaaaaagagaaagaaagcgtcattatggtgagggccatttataactctgacaaaaggtgatatctgaaagattaataagtgttcaatttaagaaaacattcagtaagcttatcctgcattcctacacaaagagtacaacagcaacacattccacaatggtaaagcaaaataagtaaaattattcaaagtaaactaaataagaagtctttccatgaactgggcaattgttgaaaccaagttgatatggggtcactagcttattccaatatgtgcccagaattagaatattgatccagatttttacattatctatccctcttgtttcttctaagtagcagccagagatcactggttggttctcaggaataagcagtcagtttaaattgcagaaaaaaaacttaaaaactactgataagactagactctggccgggtgtggtggctcacacctataatcccagcactttgggaggccaaggcgggtggatcacctgaggtcaagagtttgagaccagcctagccaacatggcgaaactctgtctctatgaaaagtacaaaaattaactgggcaggcgtggtggcgggcacctgtaatcccagatactcaggaggctgaggcaggagaatcacttgaacctgggaggtggaggttgcagtaaggcacaattgtgccactgcactccagcctgggtgacaagagtgagactccatctcaaaaaataaaataaaataaaatgactagactctgataacatgcgtaccatagtttttgaaacataacgtttttctctccagtctcccatttttactaaagacaaatcatggtaactgatttgctttgttatacttggcctcattatttgtataaagtgcagcaacaataattatttttcacataggcttttaaaatcagctttgatggaattttgttccttagaaggaatctcagataagacttttttaaagctgagcccagccatgggtctgtaccctcaaatatctatatgagttgggtaaatttctctcttcttgagatcccaagataacttggggctcctggacttgtcataaagtgacattctttacttaccacaggtcaagaaccctgtacagggactacgtagacaatgtatgaggccagttttcctaaggggcttttattggcactgtaagtcaagtttgattccttaaaggaaagagtgtcattccagtcaaagccttggtgaaaaaaaagtttctccaattgtgttctgatacaaaagaaaacattcttattgcatttatgcaaataattatattgccataagttaaaaatgctcacaaatggtttctgaattttggagaaattgggcagagagaaacaaatatgcttcaaattttgttcacaggagtatactttactcaattgttaaaagctgttaatagctcaaaagaaaaatttccttggctctgaaaaacaaaagaaaggatcagcaacgttttaagccaaaagttaaaaaaagattgcttcagtcttctgtaggtcaatccatgcagttaactcctgttttgcttgatattcatgaacatttcagctcttcatgagtcctgaaagttttttcctctattttaatgtcacaatttacaaagttattagaaacctacattcaataacacctgttagagttctataattgattataaaaccaccttctaaagaggacaaagacaagacaacaattgtccgtgggtgacaaaacaccttaggatagcctctattaaagccacagttgactaagaattttggttacttctgtggcatacaacaatttttacataacaattataatgattaacaacatacactaagtcatatcagaattgtaggagtttcctgtgattttggaacatataccaataacatatttatacaaatacagcccaaagaaagccaagcgccatttcatatttgacagtgcttcctgtatgatttttataccaaacaagccaaacttcaccattgaattagtgcattattgatgtcaaactcaattctttttttttttttttgagacagaatctcactcttttgctcaggctggaatgcagtgacgtgatcccagctcaccgcaacctctgcctcccaggttcaagcaattcttctgcctcagtctaccgagtaactgggattacaagtgtgagccaccacgcctggctaatttttgtatttttagtagaaacagggtttcgccatgttggccaggcacagggacctcaacagcacatgccagtgaggatgggtctcaaactcctgaactcaggtgatccacctgccttggcctcccaaagtgctgggattacaagcatgagccactgtgcccaggatcaaacccgattcttaataaaactttatagataaatctatccaattttaatgtctgaccataaggtaaggttcttataaacctcttaaaaccctttacaatttttgttaaagagcagattagtgttctaagaaaactctgttgtgcttttattccagtcttcaatttatggataaactgaataatacccctttaattttagctaatatgttcacacacagaatttcttttacaagattaatttttcacaaaccttccacaacttgttcaaacttcaactttttcctatctaacctaaaacaatcctttaactcttaaatctaggcaaaaaaaaaaaatccacattcacatgcctttttataatcttttaccaaaaacacatttcactttccttgcatgtaaaactgatttacttaagtctcatgaactaaaaggcatttatactttttacttttctgacaatatttgatttaagcacctattatttttaaaccagttaatcaaaatgctttcatatcacacacacaacccatataaatacacagacaggcagaataatattcagtagttgttaagatttttcatttgccagtttcttaaatggattatgggtttcagggtagagcgcttggaggaacaggcccaggaaagcacacagtttctagggcatcataagcaggtacagccaaagttggccaattggtgctgcagtctatttcctttgggccagagtttcctcagtattgtcccttcagggttcacctggaagatgttaccgggaaggagtcccaatccagaccccaagagggagttcttggatcttgcccaagaaagaattcaaggcaaatccaaagagtaaagtgaaagcaagtttattaagtaaaggaaacaaaagaatggcaactccataggcagagcagccggtcactttaaattcatttctacaacctaatttttgacatattttagatgccagttcatttactgtaaggcataagattagacttgttggcatcaaaggactgtgacttctaaatgaatgcatataataaagagatattttgcctgcaaggccaatgagacccacttaggatggtcttaggctcagcattatccttgaacagatttatgcatatttctaacttttaaattttcatttacatttgtttattttattatacttcccaagagaagattttctatagaagttttattaaattcttcctattgtacctaaactctgtccccattgtccttctcttgctccagattgtcatatctcagactgatgtgtctatcagaggcacagggacctcaacagcacacgccagtgagtcagtcatcagattatagtagcctgggaatggggtgaatacaggcttgaagtggactagtatctatttccaaggaggcccaatctattgggtaagccattgcagcaagtgtttctagctaacaagatggtcagagtcaggcaggggggccttgctgtgattctgggttgaccttgtttggagctagatgactatagccagcatctaggagagaaaactggttcaagtcactaggcttggaaatgtcatcttgccagaccctcttatggtcttgactaactgggctgggtttattaccagtagaggaacagacaactacatcagggcagaagcccaggcacatggacatggaaaaacatatgcatcactgaggaagagcctagagcttgatgtacacacagatgcttgaggttcaccctggtccattggatactgggtctaaaatatgttttcacattggtaattctaggccttatctgctcctgggggcagaggtcccaccaaatggtgcctgcatgggtccatactgactgtacttgagagaggctaagggtcctataagactggagaaagagggttgatggaaatagattagccttgattgcctggagaatgccagctggttttcagcccccaatactttggagcagaattagttaactttgagtgatgggtggatctttcttttcttctaatttaactttctgttcatgtttagcttacatacagtattgggtcattttttgcataacttttttttatttctaacagactttattttttagagcagttttaagttcacagcaaaattgagcagaagttatagcccttgccccacgcatgcacagcctctctggttatcagcatccccaacccaaatggtacatttgttacacttgattagcccacattgattgacacatagttatcacctggaatccataatttacattaggcattagggttcactcagtgttttttttgttttgttttgttttgtttgagatagagtctcactctgtcacccaggctggagtgcagtggcacgatcttggctcactgcaacctctatctcccgggttcaaccaattctctgcctcagcctcctgagtagctgggattacagatgcctgccactacgcctggctaatttttgtagttttagtagagatggggtttcactatcttggccaggctggtcttgaactcctgaccttgtgatccacccacctcggcctcccaaggtgctgggattacaggcatgagccaccatgcctggctcactaggtgtttttaaaaggaaaaaaaatctcacttactttgagaagactcttgtgctttcacatgtataaatataagcactaaaatcacatgaacatacattcatttgaagttttcaaggaaataatcatgaaatgtttcagattattatttaagtaaaaaatttttctaggaatgcatggacccctgagaatttagccacagactctcagggatttgtggacctcaattggaaaacattgctgtagaacagtagttcattttgaactcatttttgcaagctaaattttgacatgttttagatgctaattcgaggaatgttctcccttttctaagaaaagtccaagcattttttacctgctctaaaagaatatcaacggcttttatgtttcagagactggatgcaagagattgtttaacaaatcccatcccatccctgagaatgtgtctaggcatttgctctttgcaaagccagatgcaacattcataataactaaggctatcttctggccagcactgcaagtgtatcttttgtctacattcttaagtaaccacatcaaatagcatcaacccacttggaaataattttgaagtgatttggatctctcttgtatattttccctataaatccctagcctggtaggcgtgtatattttctgctgcaatatttaatgcttagttccttgcctacatctaagaaatattaattttagaaggaattggatactgatattggcaaatttttatgagactggctaaaggagaaagaagaaggggacctgtgatagaatcttccatgacaagggggaaatactggcctcagtctcctgcagaagcaggagctctggtacacaggtggggtgcccactggtacagctcccatctgacatgaagcaggcaagccaaaggggagcaagagcaatgcaacctggaagacccatcctcagacattctgctattgcccccagacaatggaaggggggcgacagctgtccatgggggcactgctaagagggtgttgatcagcagatcaggactgtaactcaccatagtggtggactgccctgatctggagaccactgcctttcgagaataattcaccctacagaagctatctgagcatcaccagacagggtcttcctgggaattagcacatatcccaaatttccttcagctttgcctgcccacagtcccctgaaagccctccctttttctgggtgtgagaggaatggctgggcatcccttggcttatcctccttcttgcccaccatagccagcatctcagagtgaacatgcacgagggaggtagaaagactccatatccttgttctttacaacttagaaaagcctaagttataggagagagatagcacaatggaatgctgaattagaggtaaataattggtctgtttttttttcaccagtctagttactactattatgtaaaatatctaattttacataccctaaacacccatacccaaacaccttgacaaaggaatcattttacctcccaaacatagtcagtgttgatttcacaaaatatccctagaattactctttctgaggctaacaggactacttagatggttcctaaagtcccttctaactcctgcattctctggttaatgaatcagcattagtcatgtggaaggaaggtatcctcctcaaactctttttaagaatgatctcaaggaatccagagtgctcattaagttggtgaaagagtcagtgcagaatgcagctcatacatatatcctgatgtgatgttggcacctctcaaaaagctgggaaagatgtccaggctggtcataggactcagcccctattatgggtccagcagccagtaatagtaagcaatgtctacttcaaaagatatctctggccaggtgcagtggctcaatcccagcactttgggaagctgaagcgggagcatcacttgagcccaggagtacaagaccagcctgggcaacatggcgagaccccatgtctaccaaaaaagaatttttttttttttttagacagattctcactctgttgcccatgttggagtgcaatggcatgatcttggctcactgcaacttctgcctcctgggtttaagcgattctcctgcctcagcctcccgagtagctgggattacagtcacacatcaccatgcccagctaatttttgtatttttagtagaggtgggatttcaccatgttggccaggatggtgtctaacttctgacctcaggtgatctgccagtctcagcctcccaaagtgctgggattacaggcgtgagccactgtgcctggccaaaacaattgttttaattagctggccgtggttgtgcatgcctgtagtcccagctactcaagaggctgaggaaggaggattgcctgatcctaggaggttgaggctgcagtgagctgtgtttgcaccactgcactccagcctggatgacagagcaagaccctatttcaaaaaaaaaaagatatttctgaggagccatgcttattcaagactcactgctcttagaagaggtgttaatctggccaggtgccgtggctcacacctgtaatctgagcactttgggagggtgaggtgggaggatcatctgagacctggagttcaaggtcagcctaagcaacagactgagaccctgtctcttaaaaaaaataagagagagatgttaatctatattaaacaattgaatagtgtgaagattttgtaaaactttttaaatcaccgattatacaaaagctcttattgaattattaaggagttagcaattactattaatgctgttgaatatgagtaagaacccacttaacttcaatcagaatccatcgatcaagcttaaagccttatctcatagttcccttcctggtctgtcagcattgcctcatagagagggaaatacatcccgcatctgcctcatcatgaacttgggtggccaccaggatattgctcatgaaagctgcttttctttctttttttttttttgagacggagtttcactcttgttgcccaggttggagtgcaacggtgcgatctcggctcactgcaacctccgcttcccaggttcaagcgattctcctgcctcagcctcctgagtagccgggattacaggcgcccgccaccacacccaggtaattttttgcatttttagtagagacgtagtctcaccatgttggccaggctggtcttgaactcctgacctcaggtgatctacccgccttggcctcccaaagtgctgggattacaggcatcagccactgcgcctagcccaaaagttgcttttataaacaggttcaaggccgggaaatccattctcctccacctcccaaagtgctgggattacagatgtgagccaccgcacccagccagttcatagtttaaaacaaagatgatagcagccccttctcaaaacaaatctccttcttgcctggggactagactgcctttgtaggactaacgaattaggcacaaaattaaacattatattttaggagtcatgcagctgggggctacaagattctgaccctccctaaactgctcctaagatcagtgcttgagatattttgcaggcctgcacttgatggatcagctgacaccacccagatcaattaactggctcatctgatcttgtggcccccacccaggaactgacttagcacacgaggacagcttcaattccctatgatttcatctcctacttaaccaatcagcactcctcactaactggcttcccccaacctaccaagttgtccttaaaaactctgattccagaatgctacgggagactgatttgagtaataataatactccggtctccattacagctggctctgcatgaattaattacagccggctctgcatgaattaattactctttctctattgcaattcccgtgtattgataaatcgactctgtctaggcagcaggcaaggtgaacccactgggtggttacaacattagatagcaaattggcaattaaagaatatatctgtagagacaggatcttactaatgttgcccagctggtcttaaactcctggcctcaagcagccctcccaccacctcagcctcccaaaaggctgagattacaggggtgaaacaccacacctggccaaattggcaatttttgaagaaagatttctcacaaggactttgcaagctttatgtactttatttgttgcaataatatgaaatgcatctttctgggaaggagaacacaggtaactgatttcagtgtaatacctagcactcatggcttgctaatcctttttatatcctatgagaaaggaaaaatccaggccgggcgcggtggctcaagcctgtaatcccagcactttgggaggccaaggcaggtggatcacgaggtcaggagttcaagaccagcctggccaagatggtgaaaccccatttctactaaaactacaaaaattagccaggcgcggtggcaggtgcctgtaatcccagctactggggatgctgaagcaggagaatcacctgaacccgggcggcagaggttgcgccactgctctccagcctgggcgacagagtgaggctctgtctccaaaaaaaaaaaaatccattttatggttagatttgggggcttcaagccgtatgtggaaaaggctctcttagggcatttggtctgtctgggctcctaagctgcttagaaatgaggtccttatcacagcagatacttaataaaagtgcactgatctttatatacctcttttttcagtcctttttctttttctcagatcgccttttccttctcttacttatcttttcccctatttcttttctctgcgtatggcttaggttagtccttggcggtgcagagacaccccccagaagttgttggaccctgctgcaacctccctgcagcttagacttcatttcttcacactcctgtatttggagcagcgacgctagtgccaggccctcagaccaggagacagttgctgcctcccacagtggcccttggggggcgatattggcagtcccaggttaggcttccacgtccttggctagccttaaggttagctctgaactctactgacctttgctcgctttggatgacaaaggaaatgatcgagtttagagatgggccagaggtgggtggaggggtggctgaaccttccggcttgcgctgtacaagccacaagaccaaataagggcgtgtgagccgcctccgtctgtattaaagttcagagtgcagtgtgcaaaagtgggactcggttttcagagataagctgttacccaaccctgcttgagttccagcagcggaggctgcgaagtctcctgctctgagcagggctgggtctgggggagaaagacctgggcccctgggcttgcttagctggggagaggaaagaaggggggcttccctcaccagcacctggtgactgaacggacccacaaccccacagattttcacaaagggtttccatgactctcccgactaaaatgtgccggccagtgtgactcattagaatgtgtaggaaaggtcactgtttgaggatattcagccagtgggggaaaaaaccacaacgttattttaatgaacgcttttagcctggcttgtttcctgaacattaaggtctagggcgggacttcgagtttggggccttttccagaggtattaacactgtgtttgctaaatacaccccagggaaggagtcgtcgggcttctacgagtcacacttaaaagactggcaagagttggcttcttctgttgtgttcttagcttccaaaatagtagtctctcctcagagccagacgcgcaatgccatcatgttaatgaggtgcctcatgtgcttcaatagccactgactgatggtaccccgaacctgcctggattcctcacctcttcccctgcccatctctccttcccgcagcaaactgctcatcctgcagcagtccgaacctctgcctcattggccctaagcttcctaagggaagggaccatgacttgtattcatgtttatatccctaaaactcagccctctgtttggcacatagtgtgtgcttagtccagatcacttaaatgtacaatgatttcattctctcggagccccgctctggtggtgtgggtccctgcggacccctccagatgcctttctccagccatggctgcgcaggcaccgagaagccgcaggctggttccagctcacagcctctcgcctcaggcccacactgctcctcctgctgtctgccccagggcttgcgattgcccgggggtccccaagcgggctcaactctgaaagattagagagctaacagcctatggagataaatacttccttctttatcttcctgggaagatggacagttgtaagatgattttcttacaactttcagacagtcctgtgggaacacacagccagtgcccataagtagggccacatcagtagagcatccctgcttccctgccttctccatctgtcagtggcttctgctcctggggtcacagtccccaataaagtacacactaagccttcttcctaggggagctgagactcgaatacattcagagccctttaagaagttctctcacagacttatttttgttttcaaaattcaattcctctaaatatatttctgttcctctttcgtctaagtctcattctttttgactgagaagtcagaagcaaaattaaagtttagtgactagggtttttttgtcctgttatacgttgacattccttaccgtgggtgtatctgtgctttctttgctcttactctgaacatgcccaaaaaaactcttgtgttatctttagcatatttcataagccacaattcaggaagttagagaaattgctccctggtgcagagcaacagaactgccgacctctttccactccaattgcggtgaaagtgatatctctctgcctgagctgacgttggcctttaggcttctctaattatttccttaggttagatttctagaaacacagggtcaaagggcacagatattcacatataggcaagttaccttcttcttgagatgtagcaatttaaactcataacagcagtacataacagtgcccctttctctgtgtctttctccaacacagacatcttgctttaattttgcatttatttgattctttctgagaagcagaaggaatatatgttggccgtttgcatttcttcttttctaaattacctgttttctttccttccttccttccttcctttctttctctttctttctttcgagacgaagtctcactcttgttgcccaggttggagtacagtggctcagtctcggctcactgcagcccccacctcccaggttgaggctattctcctgcctcagcctcccgagtagctgggattacaggtgcctgccaccacgcccagctaatttttgtatttttagtagagatggggtttctccgtgttggccagactggtcttgaactcctgacctcgtgatccacccgccttggcctcccaaagtgctgggattacaggcgtgagccactgcgtccagcctattactattattctttttttcttttcttttttttctttttcttttttttttgaaaccggagtttcgctcttgttgcccaggctggagtgcaatggcgcgatcttggctcaccgcaacctctgcctcctaggttcaagcaatcctcctgcctcagcctcctgagtagctgggattacaggcacgcaccactgtgcccggctaattttgtagttttagtagacacagggtttctccatgttggtcaggctggcctcaaactcctgacctcaggtgatccgcccacctcagcctcccaaagtgctgggattacaggcgtgagccaccacacctagctaaaaattctttaataggtctctttaatgttttaagtagtcctagatttcccctgtgaaccatcttgaaagttttgccttttattctcagttctcttttgctggcttcttatcaggaaacaccacctgactgatttgagatgtaaagtgatggagtgcaaagaccacaggtctctgtattcaaaggtctaggtgcaaggtacaaccttaccggatatttcagagcttgtcttttataatttttgagctgagaaggtcaggtgagataaactgtatggactggaattctgatttgagatgtaaagtgatggagtgcaaagaccacaggtctctgtattcgaaggtttaggtgcaaggtacaaccttaccagatatttcacagcttgccttttatcatttctgagctgagagggccaggtgagataaaccctatggactagaattctgaaaggagagcagtatgtcaacaaaggaggattcagcaactgcctgatgcaatctctagttatcttcgtcctgcaccagcagtatatgatgctatctcatccaactccattcttcagatttgtcatctctcctttacttggataaaacctggctggaaacttggcttcagtcctccatatccatctgttttaggcagacttaactcagctttacatctttgcaaacttacccacgcacatcagcatccgagaaatttccatactctttgattaaaattgcagtaaaagtcacaaaggaccttgcttaaaatgaaaggaagtttctaggaactctaagctcagtaactttatgaccattccctgtagagctgcaaaggtctggatttgaaaagtcataagtagcaagggaattgcgccagaatacctgtcttttgctggagcaaatccattgcctggttcatgcctatgtcacataggcagggcaatgccagacttttcttttctttttttaaagacagagtttcgctcttgttgtccaggctggagtgcagtggcacgatcttggctcactgcaacctccacctcctgggttaaagcgattctcctgcctcaccctcccaagtagctgggattacaggcgcccaccactaagcccggctaattttgtgtttttagtagagatggggtttctccatgttggtcaggctggtctcaaactctcaacctcaggtgatccgcccaccttggcctcccaaagtgctgggattacaggtgtgagctacagcacccggccttcttttttttctcttttttttaattttttttttttgagacggagacttgctctattgcccaggctggaatgcagttgctcactgcaacctccgcctcctgggttcaagggattctcctgcctcagcctcccgagtagctgggactacaggcatgcgccaccacacccggctaattattgtatttttattagaaatggggtttccacatgttggccaggctggtctcgagctcttgacctcaagtgatccaccctcctgggattacaagagtgatctgtcccctcccctcccctcatctccccttcctcccctcctcttcccttctctctcttttgagacagggtctcattctgctgcccaggctgcaggtgcagtggtgtggttatggttcactgcagtcttgatctcccaggctcaagtgatccttatgcctcagcctcccaagtagttaggactacaggtgcatgccactgacctggctaattttttaaatttattttttgtagagatgtagctcagaatggtcttgaagccctggcccaagcaattctccctccttggcctcccaaagtcctaggattacaggcatgagctactgcgcccagcccagacttttttgttgttgttgttgttgctgtttctcacccaggttgcagtacagtggtgcgatcacagctcactggagccttaacctctggggctctggcaatcctcctgcctcagcctcccaagtagctgggaccacacacatgccaccactctcagctaattttttttttaatttgttgagacagggtctcactatgttgcccaggctggtcttgaactcctgtgctcaagtgatcctcccactttggcctcccagagtgctgagattacaggtgtgagccaccacacgtggcccccagatattctttaagtgtaaagcttgactactatttgaggcttgacttctgctttcaaattgattttgaattacatacaagtaatttccaaggagagtcagttaacaagataaaattgtggtctttaccatatgtgcattcttttatattctcagccccattagtgcttgtataagtccatgtgtactaagtaaatctcttttaaccagttctttccaactgtgaaaagaagtaaattatatggggctgggcgtggtggctcgcgcctgtaatcccagcactttggaggctgaggcgggcggatcacttgaggtcgggagtttgagaacagcctggccaacatggtgaaaccccattttcattaaaaatacaaaaattagtcgagcgtggtggcgggcacctgtagtcccagctactcaggaggctgaagtaggagaatcgcttgaactcaggagatgaagtttgcagtgagctgagattgtgccactgcactatagcctgggcaacagagcgagactctggctcaaaaaaaaaaaaaaaaagaaagaaagaaattatatggatttttcagggagcttacaaggataagaaaataggacttggctgggcgcagtggctcacacctgtaatcccagcactttgggaggcagaggagggcgggtcacctgaggtcaggagttcgagaccagcctggccaacatggtgaaaccccttctctacgaaagtacaaaaattagccgggcatgatggcgggtgcctgtaatcccagctactcgggaggctgaagcagaagaatcacttgaatctgggaggcggaggttgcagtgagctgagattgtgccactgtactccagcctgggcaagagagtgagactcaatctcaaaaaaaaaagaaaaaagaaaatagggctgaggcaggaggatcacttgataccaggagtttaagactagcctgggcaacatagcaagaccccatggctataaaattaaaaaaggattaaaaagtagataatattaaaacaccttagatttttcaaagtaatggagctcttttttttttttttttttttgagatggagccttgctctgtcacccaggctggagtacagtgacatgatctcggctcactgcaacctccatctcccaggttcaagcgatcttcctgcctcagcctcctgagtagctgggattacaggcacgcaccaccacacccagctaattttttgatttttagtagagatgtgcttcaccgtgttggccaggctggtctcgatttcctgatgtcaggtgatccacccgcctcagcctcctaaagtgccagcaccaatgtgcccggctggaatggagctcttaatataaattgtacttattagtttttcgtttcagcctataaaatgtacaaatctttctctttaaaaaaaaaaaaacactcctttgatgctgtatgccttgcaagttaacacactttccatctactcttcatagcagagttcttacaagagagatccacgcatgtgcttttcatttcaccattgactcagaagttacatttatgattttatcacaaagaaatattgagagaggcatacagagttatggataaggatgctcattacaacctttttacaatactaaaaaattggaaacaacctaaataattgatgatagggaggctttaaaaaattatggcatctataaatgagaatttggctttgctgcaaatagcagatgacccacaataactgtggtaggaggagggatgctatctgggaccgtgtgatggctcactccccagagtccttgcagcttggtttcctcctttttcattactctactctgtctggcttcatacctaagattacttcacagaccaagagggcttctcctgttctagttatcagcaagagggactagacaaagaaaactggggcaactatcattcaccaactgtctcttaaggaagcatccaaaaactgacctacatgtttatctagggtagaattgttactatattagagaagacagaaactatgcttggacccaggccttgagctgattagggttgaactttaggcaaagaacaactcagatagttagtctaaaaggagttttttctacatttatctgtttgaaatttcccagcatcaaattttatattttcctatattgaggggaaggggccccattaggatattttgcccttttgcccaatgtatacactttttaacccataatctgttttataaaattgcaatctttcggcctggcgcagtggctcacgcctgtaatcccagcactttggaaggccaaggtgggtggatcacgaggtcaggagatccagtccatcctggctaacacggtgaaaccccgtctctactaaaaatccaaaaacaaacttagccgggtgtggtggcgggcgcctgtagtcccagctactcgggtggctgaggcaggagaatggcgtgaagccaggaggcggaggttgcagtgagccgagatcgcaccactgcactccagcctgggtgacagaaggagactccgtctcaaaaaagaaaaaaaaattgcaatctttcaaacatcttgcttacatgcatcagcccccagtggctggtataattccctttggttcatccaaatatagagtacttctgtcaagcaactagtgcttgttaaaccccctaacacacttccttgcatagggtagaagcacaattacttattgtttatttattttaaaaaattgttcattgacttgagttgtaccatgtaccacctaagaaatagaagaataaggcacaggcctagtcttatattttaagtttagctaaagagacacacaaaacaacagaaaataatagaatactattcaaatcaggtacgaagtggggtagtctaagctatagttggtagaggagttcagtgaaggtttctaaatacaaggaaggtgtgtagtaaagaatttggccttgtccaatgagagatctggtctctcattggcttttgggaggttatctgtgtcatacctgatagcagtgtctttgctctgtgagggaagctcacttggagaaaggctcacaggaacaggtgttgctccacgcctttcttttagtggctccaccccctgatagtgggtgagatcaatcatttgcttatgacacagtcctagacttaagagttggaaggactctcaggcagtcatcaggtgcatcccagaattattttatctttactgatgatgcagctcctgccaggtcacatggaaagcaggggagctagaactcgggttctgtgtcatcctaccccatgttctctctgccacatcacattgcctgctcgtgacactggaccactgtaatcatggacggtactctgtccctgagcttctggggtgaaactggctattaacccttgccatgtctcccttccctgagccttgaatcctgcttgccctgtggtgcccccatgtcccccagtacggttctccccgctgccctctataaccaagcacctggcaggttattgcttttccataaagctggaaaactcttagacagtgagaggcaggtggccagactgctgctgtcctttgaaggtttagggccaagactgagcagcaattgaaagtatccattgaacacctgctgtgagtaagacatcgcctctatcttaagcctttgctctattccaatggaaactacagtttccaggctcccatgtccattggcttctggaggggtttgaccagtagatggcaatgatggatgactaggaggtagcagagggaagaaccaggtatttcccccatcctccaccctaagtggcatgtccatcagcaggttggtgttttccctgacatctagctagttctcctgacatctagttcccaccactgctccccttccatggctctgctgtcccctatcttagaggtggtggtgcccttctgctgtggccagtctctgcgttgtttcactgtttcctgtttggcctctcagctcttcccatacagtgggtaaacaggtctctatattaaattccttctgaaatacctggtggtctccattttcttggttagaccttgactgattaatggctcatgtaacatccgtccatcgggggacttatgataggttggagagtcaagaattaaatatatgcagcctgtaatcccagcactttgggaggctgaggcgggcggatcatctgaggtcaggagttctagaccagcctggccaacatggtgaaaccctgtctgtactgaaaatacaaaaactagccaggcatggtggcgcacgcctgtaatcccgattactgacaggctgaggcaggagaatcgcttgaacccaggtggcggaggttgcagtgagctgagatcatgccactgcactccaacctaggtgacagagcaagactccgtctcaaaaaaaaaaaaaaaagtatatatatatatgtatgtaaaatactagtaaaataaaatgtagagattccatacatgtactaaaaatcactgagttattagctgggcttggtggctcacacctgtaatctcagctacttgggaggctgaggtgggaggatcacttgagcctggaagtcaaggctccagtgagctgtgattgtaccaccgcattccagcctgggtgacagagcaagactctgtctcaaaaaaataaattattagccaggtgtggtggctcacgcctgtactcccagcactttgggaggccaaggtgggtggatcacgaggtcaggagtttgagaccagcctggccaatatggtgaaaccctgtctctactaaaaatacaaaattagctgggcatggtggcacatgcctgtaatcccagctactcgggaagctgaggcaagagaatcacttgaaccggggaggcagaggttgcagtgagctaggatggtgccattgcattccagcctaggcaacaagaccgaaacaccatctcaaaaataaataaataaaataaaatattcaggagaaaaaatgaaaaatgaagagtgagtagattagactagtgatctccaaacatttttatcacactcccctaatggcaagaaacaacatttgagcttgcacctccatatttatgtacttatttattcaaactgtgtacatgttaaaccctgttggtatatgatgccttataaaatagctacaaaatataaatgtaaacagaaaaacaggtaaatagaagtcctggtgattcattgctttacctcaatgagtcatcttacacatctcctgtggtgcctaccccactttgaaatcataaaccgcttgtagaagtggccatcaaagagctctgcaagggactgcaagaaagaaggactgggggccaggtgcagtggctcacacctgtaatcccagcactttgggagactgaggtgggcggatcacaaggtcaggagtttgagaccagcctggccaatatggtgaaaccccgtctttactaaaaatacaaaaattagctgagcatggtggcaggtgtctgtagtcccagctactggggaggctgaggcaggagaatcccttgaacctgggaggcggaggttgcagtgagctgagattgctccactgcactccagcctgggcaacagagtgagactccatctcaaaaaaaaaaaagaaaaaagaaagaaagactggggagttctttcttttttttttaaaggagggtttaaattaggctaatgcagcaataacagccacacttttgatgtttacacatttctttacagttcttgaagtctcgctctgttgcccaggctggagtgcagtggcacggtctcggctgactgcaagctccacctcccaggttcacaccactctcctgcctcagcctcccaagtagctgggactacaggcgcccgccaccacgcccggctaattttttttttgtatttttagtagagatggggtttcaccgtgttagccaggatggtctcaatctcctgacctcgtgatccgcccgcctcggcctcccaaagtgctgggattacaggcgtgagccaccgttccggccctttttacagttcttaaatgctttctgacctgtgttatctcattgactctttcaaataatgagaaaggaagtgaatcaaaataggagatagattggggaaaacttgaacgtgtgaccaagaggagtttggacttgatcataaaagtaatgatgctttatcagatgtgtcacatcacagagcagatatttacagtccaaagtccctccctaaatgattggcctcacccacaatgactgggtggagccaccgaaagaaaggcatggagcaacacttcttcctgcatcgcccctcaaaagagcagatcccagttctctgaagataaatggaaggcagccatgaacttccccctctttgaggtttatctttcagcaccttagcacctcagaacaacagagaattagtaggcttagcctactatcctcctatcctttctctcgtgtgctaaagttccatacaatattactggtgtattccctctccaaaatgatgccttaatacatttatgtgaacctctcagccaggagtatgtatgtagctattgtcattccaagacattttctctgttcccattgtccatttctccttcagctgcgtgagctcaggggcttatgttttacacactatattcagctccatttccaggaaacaaaactgaactttgtcctgatcccgctttatccctttctcctgatcctgtccctcacctgctgagctgtctgtcctgctcactgcaggagcactatgagaaccacgtggagtggccgacaggatagggctttgaaaagtacaaagctgccctctgtagaaaacaccctaaagcagaggttcccaacccccaggctgcagaccagtacaggtccgtggcctgttaggaaccaggcagcacagcaggaggtgagtgacgggcaagcaagcattactgcctgagctctgcctcctgtcagatcagcagtggaattagattctcataggactgcaaaccttattttgaactccgcgtgcgagggatctaggttgcacgcccctatgaggatctaatgccccccacccctgtccatggaaaaactatcttccatgaaactggtccctggtgccagaaaggttggggaccactgccataaggggttggcagatgaaccagctgaagcaaaggaaacaattacattatttattgctgaggctcatgttgtttttgtgctgaaaaacctccagtgactctcctttgcccaaagtccgaaagggggccagttaatgacctttgtccatagggaggtgataacagcctgcctggtagggagcagagcccatgtcctctcagtagcattatgggtgttgctgtaggacctgacccaaagagagataggtatcagtttataagattatgaataatattttcaaaaaagggggccaagatgaggccttagtctcatatcaggtgacaccatagatcaaagcacagaaaagagacaggaaggatttcagcaggttggagaaggagataggcctgtgatgtggccaggtggagacacagataagttgaagtttattctggtaaagacctttgtacctgacatgcagcaagtcccagtcctgatggagggaggatgcagccagctccctagtgctaaagcattttggctttgcaggcaaaaacctgcattcaaaatctaactataacagccttgcaaacaagctacttaacttcatcggtaaaggctctgtcaaaggccaggtgcagtggctcacgcctgtaatcccagcactttgggaggctgaggtgggcagatcacctgaggtcaggagttcaagaccagcctggccaacttggtgacaccctgtctctactaaaaatacaaaaattagctgggtgtggtggcgggtgcctgtaatcccagctacttgggaggctgagcaggagaaccattcgaacccaggagatggaggttacagtgagctgagatcatgccattacattccagcctgggtgacagagcgagactctgactcgggaaaaatacataaataaataaatacaaaaattagctgggtgtggtggcacgtacctgtaatcccagctactcaggagactgaggtgggagaattgcttgaacccgggaggtggaggttgcggtgagccgagattgtgccactgtactccagcctaggcgacagagcagtaatcccagcactttgggaggccaaggttgggccaatcacctgaggtcaggagttcaagaccaggctggccaacatggcgaaaccccatctctactaaaaatacaaaaattagctgggcgtggtggtgggtgcctgtaatcccagctactcaggaggctgaggcaggaaccccggaggcaaaggttgtagtgagccgagatctcaccattgcactccagcctgggtgacagagggagactccatctcaaaaagaaaaaaacaaaacaaaacaaaaaaaacctctgtcaaaagatgttcatgaggttaatgaagtaacatatctttgtactttttattaaagtactattactaatattctcataaagtgcatatcatcatgccttgtgctcaagttcatttttaacacatttgtctccccaacttgtggacagagccttgtctcattgatgttgtttcttaccctcagcaacaagcataaagctccaaaagtgtgttgtgtggaattatgcattaatttctagttgtttcatgtttgtaaatctcaccttaactgaaatctgctgaagcttaagggcagggacccttacccccaatgtaactatcataaaactgggcatgcacctactggagcttagggagaaggttgtgcctgattagaaaaggtgttcaagttgtgcttctctcttgtagggatttcccagatgacccaggcatgcagtgggacacagagcacgtggccagagtcctccttcagcacatagaagtgaatggcatcaatctggtaagggggcagctccctgaatggaaaacctgaggtcttggtcccattcacaccaggtggtttctgtaattttttctgtggccaccctcccacttccagtccttctccagggccactctctaaggaggccagaacttccaatgctcaccattaaacctactgaagaacaaacacaccttttgatatctttacgatcttgtgtgagactgaataactaaattatcagtgctcagatagaggcagaagttttttctaaactgtgtcctccttaacaccctcaagcccccgcctttgtcctgccatctaaaaattcaggtcccccagagcctgcccagtgattctcatttatacagaacttgacctcaccttttaccaagcattttcacagagtatcattttaactttaaaagtaaaatttgtgactgggtgtggtggctcatgcctgtaatcccagcacatcgggaggccgagttggacggatcacctgaagtcaggagttccagaccagcctggccagcatgatgaaaccccatctctattaaaaatacaaaaattagccgggcgtggtggcatgtgcctgtatcccagctacttgggaggctgaggctcgagaatcgcttgaacttgggaggcagaggttgcaatgcgcaaagattgtgttactgcactccagcctgggtggcagagtgagactctgtctcagaaaaaaaaaaaaaaagtaaaattatcagtttacattgaagaaactgaggttttgcagaggccaagcagcttgtccaaggtaaacaagtggtggtgaagccaggatttttaagcattgatttcttcattccaaaaaacatgagaatgcattcatacccactaaggaagaaaatttttgatgcaattagagcaatagcagagatttgtatttactgcaatggtggacaagcctagcaacaccagtctcagctcttctaggatcagcaggactgcttagcccatagtcaattttaaagctgccaaggaggcttactgtctaccactcaaaaaatatataataatccttcatgaggtaatatctaaaattccacatttaaagcctcaccatttggcttaagttttgattaagttctcatgaaaacatgaatcctgctggcagagaaacatattaggcttttttttttaattttttttttttaagacacaggttctccctctgttgcccaagctggagtgcagtggctgcctcagcctcccaagtagctagaactataggcacatgccatcatgtctggctaatttcttttttcttttttttttctgagacagagtttccctccatcgcccaggctggagtgcagtggcgggatctcggctcactgcaacctccgcctgccgggttcaagtgattctcctgcctcagcctcctgagtagctgggactacagacacgtgccaccacgccaggctaatttttgtatttttagtagagatggagtttcaccatgttgatcaggctggtctcaaactcctgacctcgtgatctgcctgcctcggcctcccaagtactgggattacaggcatgagctaccacacccagccaatttttaatttttttttttttttttgagacagagtctcgctctgttgcccaggctggagtgcagtggtgtgatcgccgctcactgcaagctccgcctcccgggttcacgccattctcctgcctcagcctcccaagtagctgggactacaggcgcccaccaccacacccagctaattttttgtatttttaatagagatggggttcccctatgttagccaggagtctccatctcctgacctcatgatccacccacctcggcctcccaaagtgctgggattacaggcgtgagccaccacgcccagcctaattttttttttttagagacaggatcttgctgtgttggccaggctggtcaccatctcctgggctcaagctgtcctccctcattggcctcccaaagcactgggattacagatgtgagccactgcatcaggccctgagagcagattttcattgatatattcattggactgtttctgttctctaatgacagaaatacaactgaaatttagtacacacaggccaaaacaggcacctaatttgctcaccctgagtcacctaaaagctgagctgcagatgggcctcaggtaccctgaccctaccacgactcatctccatctttctctgcatgttggttttattccttttcctggctggaaaaatggtcaccagcagcttgcaggccccacactccctgcctacccttcccagaggatctgagcatgaaagcggtaatgttagatccatgggcttaggaataatgcctagctgtgctgactggggcttgccttggttctcttactcctcctcttcagcccacacagtttgaagttctcagagcctccacagcctcgatatgtagacagagctgaggttggaggttgtcatggccagcctgaagtactccctggcacctcattttccatgctagtgccttcccagtccctaaatactctctgtcctcccctacttcagtgcacgagaactactggtcttccaaattgctcctgctgtagggtactcttatctttttttctttttcttttttttctgtgagacagagtctcgctctgtcaccaggctggaatgcagtggcgcgatctcagctcactgcagcatccaactccctggttcaagtgattctcctgcctcagccttctgagtagctgggactacaggtgcgcgccaccacgcccagataatttttgtatttctggtagagatggggtttcaccatgttggccaggatggtcttggtctcctgacctcgtgatccgccttccccggacttccaaaatgctgggattacaggtgtgagccaccgcacccaggctactctcatctttttaaacttggaatccaaaatcctctataatctgacccttactgaagtcctgaacactggtgaacaacgttggtctttgccgaggggccagatttctttttcagaccatgttgcagctgaccttgaccctgagtatctgagggaggagctttggggcacaggcagctctgtgtgccattcttgctttcagaagagtctcccatgtttgggtcccagaaaagtgatctgtggtccaggcacccctccagaccttcttctcaaagaagagctaactttgatgagccctttttgaggctccggcagtatttgctgtgtgtactgcaacatatgttgctgtttattcttaaaagtgcagaccacgtcttgcaaactagactaaggcctgtgaaggccaaggctgtgcctggtatctttatatctccaagaactagagcaggcccctggacagtgctccttaccaaactgctgcagctgttaactgccacctccctgcctggaagtctttcctgtggtgctgagctgctcacacttactcaagtgagtcgacttttattgtcaagagaatcttcaattgatttaattgctataaacaaggaaatcgtataaaacagctccttactaataaatttctccttttttttttttcctgaaatgaagtctcgctctgttgcctaggctggagtgcagtggcatgacctcggctcactgcaacctccgcctcccgggttcaagcgattctcctgactcagcctcctgagtagctgggactacaggtgcatgccaccacgcccagctcatttttgtattttttttttctttttttgagacagagtcttgctctgtcgcccaggctggagtgcagtggcgtgatctcagctcactgcaaactctgcctcccgggttcacgccattctcccgcctcagcctcctgagtagctgggactacaggcgcccgccaccatgcttggctaattttttgtatttttagtagagacggggtttcgccgtgttagccaggatggtctcgatctcctgacctcatgatccgcccgcctcggcctcccaaagtgctgggattacaggtgtaagccactgcgcccggcctactaacaaatttcttgtgacacacttgctattaataaggaaactcaagttgacagtacagttgggaataatttctctggcctgcacttagtgccatagtagaagtataggatcatgctaacaccgttgctagtgtagctataactggccatcattcgagctgagcatgggtttccattcagcccagaagtttcaactgcacacaagagatgatgaagcagcaacacagaagcacagacagaggtgtggagcacagtctaagccatggggagagattttctcacctgggctgcaccaggatgagagcataagctctccaccatcatccaaagcaaagctggctctgcagccatcaatgcaggaaactgggttctgtctggtcccagctctgtagtactgcaggaacatcataaagaccataaggaatggcagacaggacagagttttgaaaagtacaaagctgggtgggtgcaatggctcatgcctataatcctagcactttgggaggctgaggtgggaggatcacttgaggccaggagtttatgaccagcctgggcaatatatcgagactccatctctattttttaaaaaataaaataaaataaatgttaaaaagaaaagtacaaagctaccatccttggaaagcagcctaggggggtagtagtgtcttctctgggtgttaagcaggctaggtcctgggcctcaacccctctacctcaactttcattcagtaagtatttattaagtacccaatatgggacatttgctttaggtggtgaactgggaatacaacagtgagccagaagcacttagtccctgctcccatagagcaggatgtgtcagtacagcactattgcgcatttgagactggataatttgttgtgggggttggccttgtgcattgaaggatgtttagctgcatccctggccactacccactagatgtcagtagcaatccccctcctcagttgtcacaatcaaaacgtctctaggccgcaagcagtggctcacacctgtaattccaacactttgggaggctcaagcagggggtggattgcttgagaccagcctgggcaacacagtgagaccctgcctctacaaaaaaatttaaaaattagctaggtgtggtagcatgcacttataatcccagctactcaggaggctgaggctgaggtgggagaatcacttgagcctgggaggttgaggctgcagtgagcatgatcacgtcacgtcactgcactgcactgcagcctaggtgacagaatgagagcctgtctcaaaaaaacaaacaaaaaaaacctccagaagttaccaaatgaccctggggcaaaactatcctaggtgagaaccagtgtcttagaaaccagagcagccccacagttacctatttattggggtctgggtaagattttatttgaacaaatacttttgcactttaggaaaaaataaaagtggatggagttttgtaaagaatgacaggtgccattgtcatgtacaaatctgcaaagttcagagagctgaatacaatttagcttaaccctacttgcaacagaaagggggaaactacaaggtacaggatgagagaaaaaacaaagactggagaatttcaaaagtgatggagctgaatttcatgtgaccccaaatccactaaccaagggactgcctgccctccagcacccttctgatatccatccagccagagtgctagccagctccacctgatggcaacagcctgggagttgagatactctagggttttctgctgtacagttttcttttttgtagcaagatggggttcttgttcttgtcgcctaggctggaatgcagtggtgctatcatagcccactattacatcaaactcctgggctcaaatgatcctcctgcctcaacctcctgagtagctggggctacaggtgcacgctagcaagcccagctaattttgttgttgttttttgagatagagtctcactctgtcaccaggctggagtacagtggcacgatctcggctgacttcaacctccgcctcccgggttcaagcaaatctcctgcctcagcctcccgagtagctgggactacaggcacgcgccaccatgcccagctagtttttttgtatttttagtagacacggggtttcaccaacctggccaggctgatcttgaactcctgacctcgagatccacccaccttggcctcccaaagtgtcgggattacagacgtgagccaccgcgcccagcctcgctgtacagtttttaaacactatttcttcacttaaacctagcaaggaaagtagagctggcattacttttcctgatcttacacatgaggaaaccaagacattccatgttgaaataacttccagtagtaaagttttctgacttgcccaaggtgctgtaattaactagagttagagataaaagtagactttgatctcccccaaccaccaccccaccacccaccttgttctgcatggaagggtgggatcagaaccaggtgtttgagttatacgatctttttttttttttttttttttcttgagatagagtttccctcttgttggccaggatggagtgcaatggcgcgatctcagctcaactgcaacctctgcctcctgggttcaagtgattctcctgcctcagcctgccaagtagctgggattacaggcatgcgccaccaggcccagctaattttgtatttttagtagagacggggtttctccatattgatcaggctggtctcgaacccccgacctcaggtgatctgcctgcctctgcctcccaaagtgctgtgattacaggcgtgagccaccgcacccggctggcttttaaacaatatcaacaccgaaggggtgagattcttagagtgacagttcagagacagtcaggagagtaggggagatggaaacacctgctactaatggtaaggctcggctgcgactgcccagccctgggaaagcctttctctgcagagcacttgatcccacggaaacttggcagtaagagctttaaaaggaaagggagagggaaatgaaagcgagagggttctgtcagggagctgctcggttttaacaaaggaggccattcccatggcacaacccttctttctgttatcaggagaccatgttgacattaccctgaattcacctaaactggtgctgactcttcatgaggttcccaatgattcctgaatctcatgatggccagaagccggtctcctcatggccatggcactctgagaggatgtttggtgactggaccttgtgttttgtggttgtttccactgtctccacttcttagatttggtcctcttgctaggccatagggtgtgccagtgcagtaaagtccagggcaccttggcctaggtgctaactccttcaaagtttctgctttgtttccacagctgcatgtttccagcctgtgctgtgcacgctgggtgggagagggcaacttgaatgcaataactacacctagcacagttggcaagactctttctttactatcatgaaggaaaccacatttaaaaatgtgtccccttatgtatcctctgggcattgcatatagttctgtcatcaaaggtaagaatgattttaaccccagtgcctggtacagagtaagtgctcagtaatgtcattagctgttattacagctattaccacaacctcaaaaaaaaaagtttggctgagcacagtgtcttatgcctggaatcccagcatttcaggaggctgaagtaggaggatcgcttgaccccaggagtttgagaccagcctgggcaacatgacaagaccttgtctttacagaaagaaatttttttaagtagctgggcccggtggcacgtgcctatagtctcagctacttgggagaggaagacaggatttcaaggagcccaggggttcaaggttacagtgagccatgatcacaccattccagcctgggcaacagagggagaccttgtctcaaaaaaaaaaaaaaaaagcctggatgcagtggctcactatttttaaaaagtaaaataaaataaaataaattttaaaaagaaaagcacaaggctgggtgcagtggctcatgcctgtaatcccagcactttgggaggctgaggcaggtgcatcacgaggtcaggagtttgagcccagcctggccaagatggtgaaaccccatctctactaaaaatacaaaaattagccgggtgtggtggcagatgcctgtaatcccagctactcaggaggctgaggcagggaactgcttgaacccgggaggaggaggttgcggtgagccgagattgtgccactgcactccagtctgggtgacagggtgaaactccgtctcaaaaaaaaagaaaattacaaagctgccatccttggaaagcagcccagggggatagtagtgtcttctctgggtgtcaagcaggctaggtcctgggcctcaaaccctctatctcaactttcattcaataaatatttattgagtacccaatatgggacattcactataggtggtgaactgggaatacaacagtgagccagaagcacttagtccctgctcccatagagcaggatgtgtcagtgcagcggcactattgcgcatttgagactgtaatcccaaaatgcctgtaatcccagcattttgggaggccaaagcaggcagattgcttgagcccaggagtccaagaccaacctcagtaacatagtgagaccttgtctctactaaaaatttaaaaaattagccaggtatggtggcatgcaccatactacttatacactaatttaaaaaagccactgcatccaggctttttttttttttttttttcgagacaaggtctccctctgttgcccaggctggaatggtgtgatcatggctcactgtaaccttgaacccctggactccttgaaatcctgtcttcctctcccaagtagctgagactacaggcacgtgccaccgggcccagctaattaaaaaaatttctttctgtaaagacaaggtctcgccatattgcccaggctggtctcaaactcctggggtcaagcgatcctcctacttcagcctcctgaaatgctgggattccaggcataagacactgtgcccagccaaacatttattttttgaggttgtggtaatagctgtaataatagtgtataagtagtgtattaatagctgtaaaagtagtgtcttcccagctacttaggaggatgaggtgggaggattgcttgagcccaggaggtcaaggctacggtgagctatgatcatgccactgcactatagcctgcatggcagagcaggaacgcttaaccatctcatagataactagattagtcttcttctagggacctaaagggcaaagcgataaagcgagcataaaagcagtttgaaaagtaagtgacagaagcatgaaaagcatcgtttttgaattagttcttacttggattccattgatgagcacaaaacagtaatctggttcaggatagaaatataaacattaggccgggcacggtggctcacacctgtaatcacagcaccttgggaggccaaggcgggtggatcaccaggtcaggagttgaagaccagcctggccacataacgaaaccccatctctaccaaaaatataaaaaattagctaggtgtggtggcatgcacctgtaatcccagctactcggaaggcggaggcaggagaattgcttgaacccgggaggtagaagttgcagtgagccgagaaattgcgccactgcgctccagcctggccaacagagcaagactccatcttaaaaaaaaaagaaagaaagaaatataaacattaggccgggcacggtggctcacgcctgtaatcccaacactttgggaggccaaggcaagcggataactttagtcaggagtttgagaccagcacagccaacatggtgaaaccctgtctctactgaaaatacaaaaattagccaggcatggtggcacgtacctgtagtcccagctactcaggaggcagaggtgagagaatctcttgaacccaggagacagaggttgcagtgagccaagatcgcaccactgcactctagcttgggcaacagagtgagactccatctcaaaaaaaaaaaaaaaaaagaaagaaagaaagaaaaaagaaatataaacattaatcattagaagactttcttgaattatggcattctgttgttaaaattcttccattacccaccacttctgttgactttgtcaacatgttaataaattgaggctcatggtggtaactttaaagttacaggatcctaaaatgtcttctgaattattaaaaagtgtgtgtgtgtgtgtgtgtgtgtgtgtgtgtgtgttcagtgccatgaacagtgaagttaactatgtacttatcttttcaaataagggatccagtaatgactctcaagatgatccttctaaccagagtgtttgcttgcctgaaatacgatattccctcacagatgagctctccagaccccaggagaaagaataactgatcgaaactcatgtacttggttggtagctgtcagaataagagtgcaggtcttctgattctttttttttgagacagagtttcgctcttgtcacccaggctggagtccagtggcgtgatattggctcactgcaatctccgcctcctgggttcaggcgattctcctgcctcaacctcccaagtagctgggattacaggtgcccaccaccacgcccagctcatttttgtatttttagtagagagggtttcgccatgttggccaggctggtcttgaactcctgacctcaagtgatctgcccgcctcagtctcccaaaggtcttttacacagtgcttcttcctgcagcgtagcacgccttctcacatagaggatgcttgtaaagagcgtggactgtggagtcagaaagatctaaaccccaagaacagctccaccactcagtggcaaggtgatcacagctttggcctctgcttcctgaacttcctcaggtgtaagatagggttaatactatgtctttgctcaataaatgttagccactcttattataacagagggcttgctgtacatgcagtcattatgctttacagtttaaaatagaaagaccaagagcgaatcccttcccagcccattccaatcccagttccaggttccttcatccatgcaggatggtcacctttccttggggacagcttgcctcttttcatcacccctaatcaatcattctatcctttcttcagtccttgttgtcgtttttatatttcttttattatttgagttagccttattattattattattcaaattattatttgttttttctttttttttagcaattattattatcatttatctcagaaaatctctatgacaattgtgtgaagtacaattatgattacatatgagataattgcaccacagacatgttatataacttgcaaaaagccacaaacccaataagtggtaaagcccaaagcacagaggttttctttctgttcttttttttttttttttgataattcttgggtgtttcttggagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgattcttaacaagcatgctgccttcaagcatctgtttaacaaagcacatcttgcactgcccttaatccatttaaccctgagtggacacagcacatgtttcagagagcacagggttgggggtaaggtcatagttcaacagcatcccaaggcagaagaatttttcttagtacagaacaaaatgaagtctcccatgtctacctccttctacacagacacagcaacaatctgatttctctatcttttccccacctttcccccttttctattccacaaaaccgccatcgtcatcatggcccgttctcaatgagctgttgggtacacctcccagacggggtggtggccgggcagaggggctcctcacttcccagacggggtggccgggcagaggcgcccccaacctcccggacggggtggctggccgggtgggggctgcccccccacctccctcccggagggggcggctggccgggcgggggctgcccgcagccccccacctccctcccggacggggcggctgctgggcggagacgctcctcacttcccagatggggcggctgccgggcggaggggctcctcacttctcagacggggaggcggggcagagacgctcctcacctcccagacgggggtcgcggccgggcagaggcgctcctcacatcccagatggggcggcagggcagaggcgctccccacatctcagacgatgggcagccgggtggaggcgctcctcacttcctagacgggatggcggccgggaagaggcgctcctcacttcccagactgggcggccgggcagaggggctcctcacatcccagacgatgggtggccaggcagagacgctcctcacttcccagacggggtggcggccgggcagaggctgcaatctcggcactttgggaggccaaggcaggcggctgggaggtggaggttgtagctagccgagatcacgccactgcactccagcctgggcaacattgagcactgagtgaacgagactccgtctgcaatcccggcaccttgggaggccaaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggtaggagaatcaggcagggaggttgcagtaagccgagatggcagcagtacagtccagcttcggctcggcatcagaaggagaccttggaaagaggggagggggaggggggggagagggagagggagagggagctatttgttttttctttaattcatttgtgtagaaatgaaatgttggaatacagactgagcttgtagttaataaacagatattgatatagctgtgaaaatggaaacagaggcaatctatgaataaatacactttttccatgaactcaaccccaggacacggtggacattgtccttcaaagctttttttgccctcattatggcatgagaaaaagagaaccagtaattcaggctgtatctgcataaacagagttcacttagaagctagccaggaattctaaatgtgctaataaatggctaaaccaataagcaacaaagatattctgaacccaagttcctatcatggctgaattccactctgctccactggctaggaacaagagtaaaacatcaaaccctggaaaacagtctctatgtggtcaaccacagcactagctacacaccactgatctgctcagaagtcacttcagatagatgctgcatttgaaaagtttcagggttctgttctctccttcccaagggaaggagacagctccattgaagttgaggtggtggagaaggcattcagtgaaaaccctgtgtttctctacaggtggtgactttcgatgcagggggagtaagtggccacagcaatcacattgctctgtatgcagctgtgaggtatgattctccgggtgatggatgtgggggagggtttgtttatttgattagggctcatggtttaaagtctaaagcactttcccacttgttatctgagcccatgaaactcactgctggcttatcttctagccctttttggccatgttgctcactgcatctcaccatgtcctctcgctgagaaatctctctcaagtcctagtacgaatgctcgtctcctaaacagctgaattcttttttatacactgaatactgcgaatggggtaattgactttattcatctcttttctgtggccacaggaagcttgagggccaaatttgcaagccctgtggcactggacaagactttaaggaatgagtgctgtcaatcagtgtgcctccaccttcaccatcttcttccccttactctcacttccgtcatgtgttttatacaactctcaaatctttcttggagaaggaggatatacatacataatatgaaatgtgtttgttcttcacagtcacccgattttactgatatttatttgcattttaccaataaaaagaaaatgcaagctcaaaggtattgagtgacatagagtcatacaaacatagatgtgtttcctgtcccctagcaaagtgcttctcctgggcccctgatcagtggtgtggcaggcctgtcccagctactgaggaaggaaagaagcaacttgaagggaaggacttatttaataaccttcttctaaacatgcttaacactcagactgaagcaatgcaatatgtaaagttggaaatgacctcaccaaccattaagtccaatcactgggaagtggtttgcccagcaccacaaggttaaactatggcagaggcagaattcaggaatcctagttctccattcattattctgtcagatgtatgtgaagaccaatccaaactgaagaccctccttgtccttaaattttacatcacttggtggaagatgctagaattttacccacatactctttctaggcagatttccctgtttccttgactatggaatgaggggaggctagactgttctccctgtaaagactattcggttcctggtccagccagcagccacagctttagaagagacgtgctcctagtcgcattaggtcccttcaaattcaggaaagaaacattccctggttacagtctgaaatacaaatttttttgatgatatatggaaaaatgaggcagccccagagtggtctttccaaccacatggttactctgaggccttgagcttccaagactagcatggacagcaagccccatggagaactggaaaaatggtcccacctcattctggatgcacactgagcctggtgatttctctccgagaatttacactgcaccagagaaaggatcaggtcaggtctattgcaaacaaagagtacctcaacaggcagggggctggggcacttgagattgagtcacctggtcccattcctggtccagtcaccactgaagtggagaaaatagagaaggcgtcattctgggcagagaaagaacccaaggggacaactctgtgtagatagaactgcctggggccattttcctcagaagaggctggagtgccacaggctctcagcacgaaggagggccactgtgcttcagataaaacaattcatggacatgccaccaatctgccacaacctttttccccacagtcatctcttgcctgctaaattcgttagactcacgttagtcctcagccaccttgaaccttctgtggcatctggccctgcctgtccgtcactgcaatgctgctttgacttatatggcaccagcttgccctcctcactctggcctttctggctacttctcattctcttcccggcttccctcccaccagtggccccttggtccccctgtccccagggctcactccccagtcctcctcagcacagcttcccctgtggctttaagggctataagctctacttccagacagcgcctctagctcactgctttccctggacatcagaatatccacagggctttgcccagagtacaggacaagccacttcattctcaggatcccagaaagttttttcagtcttttcttttctttctttctttctttctttttttttttttttttttttttttttgcgacagagtctcgctctgtcacccaggctggtgtgcagtggcgtgatctcagctcactgcagcctccgcctcctgcctcagcctcctgagtagctgggaactactggtgcatgccaccacgcccggttaatttttgtatttttattagagacggagtttcaccatattggccaggctggtgccgaactcctgacctcgtgatccgcttgcctcggcctcccaaagtgctgggtttacaggcgtgagccaccgcgcccggctcctttttcaggtttttctacctctcaggctctgccaggcagtcagttccatgaatttgtcaattgtctctcaacttctcttgtttaacccctgctcccaagagtctctgttcatatgtgtgtctgtgtgttgctggggctaccttcccaatccttctctgcccccagctttctaaacaacaaagtggggaagagacttggagctcattgcagttgacactcccctcctcttaaggtggcgagcacagaatgacctgcactgtcagaaggtaggcgtagggaagctcagaaaggagaaaggaaatatcagggaagagctatcagttagcattgtaaaatattcccccatcatactcacattacacttccaagagaaaaactatgaagagtccagcacagttaccttcattctctaatgggcaaagcttggaccagagtacttcacaaaccacagaccagcctctggattggctgtccctagcttaggtgcccatcctggtcccttcagctgttgccagaggtatgggatcctggaaatctatacagtgatttatgcaaaagaaaccacctggagactcacatggaggggaccatgggcatggcagcctttcctctgaaggcccctcctgttacctacaaaggaaatgatccttactcctctcactcttgtcctatccctcctccagggccctgcactcagaagggaagttacctaaaggtaaggcttgttccttttgcaaagggccacaagatactgtccctctgagaaacttatgagggggaaatttgcaaatccacagagagctgccctcagccgagcagaggcagtggttggggaggccgccacactcttcctgactcacctcaaggtacctggcaggttgtatctaccagcaagtgcctgcctgcagggccacctctggatgagtggggaggccaggtttgcccctcaacctgtctagctttttcacagggtggatgttttacacctctggtattcttccagtctgaactcaatcccatcccccaaccaattaggcaggttgtaaatgactgctgggtgcttgatgaaccaatctgcctgagttaggaactcttcctaacccacataaagtatttgaccctacctgaccatttactgcatgacccccatgcttagcctctctggaccagtttctggtctgtcatacctcaccggcgcaatacgaagattcaatgaatgaaaacgtaagtagtttgtgccctttctatgtgggatgactgaaaggagcttaccaagccatgatgactttggaacatgactatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtctcctttacttcctttggctttgaggtagccagatctcaacctctagcagccaacctttttctggtagggcacaccgcagggtagagggtagccagccaggtcttctatggcccttttactcgttctagctgcaagaatcatgggcacagggcagctttagtgccacagaaacacgtggcaatgctgtggccactgtcctgccctgccctgagccacagggtagagggaggatgctcaggggaaaatctggctggaggcctcaaggcttatcacttcaccctgtctcctctccatccagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaaggtgaggattgtaaattcctggacaccccaactcagatccctgccccagaccccctgtctcctcaaagccccacctctgcagaagccctaactgaaggtttttcacagtggttcagcacctgtccctgagaattagggctaggccagctagatcttgggaggcatagatttttcaatgactttagccttttttttctaattataaaaataatatatgctttttctaaaagtaaataacacatgctcattgcagaaaatcttgaaaaacataaaagcatcaaaaagaaaataaaaataagaacaattacctgcagtcccaccaatcacaggtaatccttgttaacatgttgggctacatctttctactctttttttttttttgagacggagttttgctcttgtcacccaagctggagtgcagtggtgcaatctcggctcactgcaacctccgcctcctgggttcaagtgattctcctgcctcagcctcctgagtagctgggattacaggcaccgccaccacacccggctaattttttgtatttttagtagagctggggtttcatcatgttggccaggcttgtctcgacctcctgacctcgggtgatccacccacctcgacctcccaaagtgcagggattacagacatgatccactgtgcccagccctactctttatatatatataatgtgtatgtgtatacacatttcaaatgggatcacacagtgcctatttaaaaccagctttggccaggtgtggtggctcatgcctgtaatcatagcactttgggaggctgaggcgggcagatcacgaggtcaggggttcaagaccagcctggccaacatgttgaaaccccgtctctactaaagctacaaaaattagccaggcgtggtggcatgcacctgtagttccagctacttgggaggctgaggcagaagaatcgcatgaacccgggaggtggaggttgtggtgagctgagatcatgccactgtactccagcctgggtgacagagaggattctgtctcaaaaaaaaaacaacaaaaaacctgctttaacaatacgttatgggctgggcacagtggctcatgcctgtaatcccagtactttgggaggccggggtgggtggactgcttgctgggcaacagagcaaaatcccatctctacagaaaaattagccaggcatggtggcacatgccagtggtcccagctactcgggtagctgaggcaggaggatcacttgagcccaggaggtcaaggttgcaatgaaccctgatcgtaccactgcactccagcctgggcaacagagccagaccctagccaaaaaaaaaaaaaaaaaaaaaaatcaaaactatttattatgaacattttctcctatttcatttagtattcaaataccaatggctgccaattacgccactgtatgtatataccataagatatatcacgaatcccttactgttagacattttgatttgccactttatcactgttatacatggagcgatgctcccagcttgagtttaagaagaattcagacctgccaggagcctctgtaaagagcctaggggaggccagacgccgtggctcacgcctgtaatcctaacactttgggaggccgagacaggcagattgtctgagctcaggagtttgagaccagccagggcaacacggcgaaaccccgtctctactaaaatacaaaaaagtagccgggcgtggtggtgggcacctgtagtcccagctactcgggaggctgaggcaggagaattgcttgaacccgggaggcggaggttgcagtgatccaagatcgcaccactgcactccagcctgggtgacagagcgagactccgtctccaaaaaaaaaaaaaaaagagcccagggcagactgcaagaagcccacatgcagggtgaggaagagctaggccagctcaggtcatcctagggaaaactcttagctgtccatggaacaggtgactgagtgccatcagagttagggagagggtgggctgaggagaattattcctcagtttgtctccaggtgcatccccctgtagacttaagccccccacagagagatgggtagcataacaagtgaaagaaccaagtcggggattgtggctcgtgcctgtagtctcagctgcttgggaggttggggtgggaggatggcttgagcccaggagtttgtgtctgccctgggcaacacagctttattaggaaaaagggaaggggaaggggaaagggaagggagagagaggaaggaagggagaaagagacagagagaaggagagagtgagagaaagaaaaggaaggaaggaaggaaggaaggaaggaaggaaggaaggaaggaaggaaaggagggaggaaggggaggagaggggaggggagggagggaggaaggggaagggaagggaaggaaggaagggaagcgaaggaaggaagggaagggaaggaagaaggaaggaagagagagaggaaagaaggaagaaagaaagagaggggagggagagaaaaggagagaggaaggaagggagggagggaaggaaagaaggaagggagggaaggagggaaggaagggaggaaacaagggagggagggagggaaagcgggagagagagagagagaaagaaaagaaaagaagaaggaaggaaggaaggaagaaaggaaggaaggaaggaaaatctaagagaatagaaactcaggataatgattttggttttggggtttttttgtttagctttattttctaaattttctttgagatgaagtcttcctctgtcacccaggctggagtgcagtggcacaatctcggctcattgcaacctccacctcccaggttcaagcaattcttctgtctcagcctctccagtaactgggactacaggttcacgccaccaggcccagctaatttttgtatttttaatagagatgggatttcaccatattggtcaggctggtctcgaactcctgaccgcaggtgatctacccacctcggcctcccaaagtgctgggattacaggcatgagccactgtgcctggccattttttttttttttttttttgagacagagtcttgctctgtcacccaggctggggtgcaatggcacgatctcagctcacaacaacctctgcctcccaggttcaagcaattctcctgcctcagcctctcaagtaactgggactacaggcgcatgccaccacgcctagctaatttttgtatttttagtagaggcagggtttcaccatgttggccaggttggtcttgaactcctgacctcaaatgatccgctcccctctgcttcccaaagtgctgggattacaggcatgaaccactgcgccgggcctttttttttttttttttttttagatgtagtttcgctcttgttgcccaggctggagtgcaacggtgcgatctcagatcactgcaccctccacctcctgggttcaagtgatttttctgcatcacactcccgagtagctgggattacaggcatgggccaccatgcccagctaattttgtatttttagtagacacggggtttcgccatgttggtcaggctgatcttgaattcctgacctcaggtgatccacccgccttggccttccatagtgctgggatcacaggcgtgagccaccatgcccggcccatattttctaaattttctaccgtaaacctttgtacctaataagaggcactttgctaggtactgagagtgcagtgttgagcacatattaattatcttgtttcttcaatagtgcattcgtttttgtattttattatttctgtcctacttcatttatggttttattcttttccttccttccttccttcctccctccctccctctttctgtctgtctgtctgtctttctttctttctttttactgttattttatggtttttttttgagacggagtttcgctcttattgcccaggctggagtacaatggtgcaatctcggctcacctcaaccttcgcctcccgggtttaagcgattctcctgcctcagcgtcccaagtagctgggatcacaggcacacgccaccacgcctggctaattttgtatttttagtacagacagggtttccccatgttggtcaggctggtctcgaactcccgacctcaggtgatcgcccacctcagcctcccaaagtgctgggattacaggtgtgagccatcgcacccagcctatttatttattatttatttttattttttgagacagagtcttgctctgtcacccaggctggagtgcagtggagcgatctcggctcaccacaacctccacctcctgggttcaagcaattctcctgtctcagtctcctgagtagctgggactataggggcccgccacttcgcccggctaatttttgtatttttagtagagactgggtttcgccatgtttggccaggccagtctcgaacttctggcctcaagtgatccacccggcttggcctcccaaagtgctgggattacaggcgggagtcaccgcacccagcctgttcttctttaaatctctttaacttgaaaggttagctttgttttcattttcaatctttaaaaaaaaaatactttaatactattaattttccttgaagtgtttctttagctacacatgataagttttgatatgtagttctcctattgtcatttaattataagtaatttatagactccattgtgagttcccctttaatctttgagggtataatttacagttacaaacatgtgtcgatcttcattatttgtagttctatatttatgaatgcacctactcactaaaattcatttgtaactccaaagtcagtgctcgaagtgcttttgtagtcattcgtggacactcgcagaggggtgaaacatgagtcactggatgcacatatgcatgttcccagctgtttcagctctcctactgtaaaaaaatacctttttgtgtatatttaatgccccatttttctcatttttgtggtttttgttgattttgctgtttaaaatagcctctaaggatgatgctgagtgctgtcttgcattcctaagcacaagaggctgtaatgtgccttatgtgggtttgatcacaagcatgagttacagtgccattggccatgagttcagtgctaatgaatcaacaacatgtatttcatatggagtttttaaacagaaatatacacaaaacaaggttatatattgactgattgatgaaaatattgtggccaaaggcttggaggaacccaaccctgtatttccactagaaacaatggttcagtattcactaattcagtgttttcagtgactttgtagaactaccacaaatgagaatggcatggctgtgtgtgtatatgtggtctttttttttttttctgagacagagtttcactcttggtgcccatgctggagtgcaatggtgcgatcttggctcactgcaacctccacctcccaggttcaaacgattctcctgcctcagcctcccaggtagctgggattacaggcaggtgccaccacgcctggctaattttgtattttttagtagagacgaagtttcaccatgttggtcaggctggtctcgaactcctgacctcaggtgatcctcccacctcaacctcccaaagtggtgagattacgggtgtgggccactgtgccctgccgtgtatggggcctttttattgttaatttataatttaattactttgtggtcagtgaatggttttcgtaacactgatcttttttttttttttttttttgagacagagtctcgctctgttgcccaggctggagtgtagtggtaagatctcagctcactgaaacctctgcctcctgggttcaagtgattctcctgcctcagcctcctgcgtagctgggattacagacaggccggcaccaccaagcctggctaattgttttgtattttcagtagagatggggtttcactatgttggccaggctggtcttgaactcctgacctggtgatctgcacaactcagcctcccaaagtgataggattacaaacatgagacaccgtgccctgcccaaagctgatatatttgttagcagattatttctcttatttatttatttatttattttgagacagagttttgctcttgttgcccaggctggagtgcgatgatgcgatcttggctcactgcaacctctgcctcctgggttcaagcgagtcccctgcctcagcctcctgagtagctggggttacaggcgtgcaccaccatgcccagctaattttggattttttttttttttagtagagatagggtttcaccatgttggtcaggctggtctcaaactcctgacctcaagtgatccacctgcctcgggctcccaaggtgctgaggttacaggcatgagccattgcgcctagccaattcgtcttattatcttataatgtctctcttttgtaatggttttccctttatcttctattttatatttatttatttatttttttgagacggagtctcgctctgtcaccaggctggagtgcagtggcgatctcggttcactgcaatctccgctaattgcaatctcctctaattgcaatctccgcctcctgggttcaagcaattctcctgcctcagcttcccgagtagctgggattacaggtatgcgccaccacgccggctaattttgtatttttagtagagacagagtttctccatgttggtcaggctggtctcgaactcccgacttcaggtgatccacccacctcagcctcccaaagtgctgggattacaggcgtgagcctccatacctggcaagtcatgtagggtctgacaatgaatataaaaggggttatttacataaaagtttgtgaagatattagcttagagaggcaagttaattatggtacttagagataaacaggcacatccttttatgtatatctagtgaagtcagttgctgtaatctattctgtttaaaaactgaactatactaggtctgaataacaagataatgtacatttcccctagaagataggaacgacaactcacacctgtgtgccattcctttttttcttcttctgatagtgattggacctccccaaacgacctaactcagaggaatttgggcatagtgtactagctttcttcccatgaaacatccctgtttgtgttgtatatttgaggtagtagcaacgtgattaagaatgtggactctaactggccaggcgcggtggctcacgcctgtaatcccagcactttgggaggccgaggtgggcagatcactaggtcaggagatcgagactatcctggctaacacagtgaaaccctgcctctactaaatatacaaaaaattagccaggcatggtggcaggtgcctgtagtcccagctactcggaaggctgaagcaggagaatggcgtgaacccaggaggcagagcttgcagtgagccaagatcgcgccactgcactccagcctgggcaacaggctcaaaaaaaaaaaaaaaaaaaaaagaatgtggactctagaatcaatcagttggctctgggttaaaatctcagccagctctactacctactagctgtttgagactgacgagtttcctcatctatttattttttaaaaaacagtaataacagtacttgattcacagggttgttaacattgagatgatgcatgtggactgttctgccagttttctggtatcccatggtgagtgctgtagctacggtgagcattgtgtgttataatcacaggtagtaggagatgggaaagcaggggccatgacaggaggccaatccagagaggttcgtgggttacaggaagaagacagataaggctatagcatgaagcatattagttcgaggaaggatttaaggtgcggaggccagatctgaaagtaatgaaacaactccagtgcaactgtttcataactggttctctttgattcttctagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctgggtaagtatgccctccacccgccacaggaaacactgaattgcttctccatagctgcaggttagagacctgcttgttcagacactccacctcaacttgccctcctttgcttagtgtcaccattatcttgaatgcctcctaggggccacataagactaatagagctattaggctctgaagccggaatcaaaaatgcaaatctggttatgtgatttgtctacttaaactttgtcaatagctcctaatagccttcatgtgaaaatgtgaccagaagcacgttactaacactggctagagtgcagtaggagagtgtggtaggacaggctgacctctgccctgttactaggaagacagacactcacccagcctttctgaacagcaactctgctaagagcttttaaaatatgcatattctatgacctaaggaatacttagaaaatcaaaattatatacacactggctgggcgcagtggttcacatctgtaatcccagcactttgggaggtcaaggagggtggatcacttgaggccaggagttcgagacaagcctggccaatgtggcaaaaccccgtgtctactaaaaatacaaaaattagccaggcatggtgccgcaggcctgtggtcccagctactcggaaggctgaggcacaaggattgcttgaacccagaaggcggaggctgcagtgagctgagatcgcgccactgcactccagcctgggcgacagagccctgtctccaaaaaaacaacaacaattatacacacaaagattatcattgtattatttataatagcaaaactggaaaaatccagtgatgcagttgtgttttgtaacaaggaagaacgttcacactattaaatttttaaaagcgggttaggaatagcacaatcccatttttgttgaataaatatatacacaagtatataaataaatacatatatatcaaaagatatatatccaaaagataaatactagctggcaaggtaatctttcaacaatgaacatttataattgtaaaggactttgttgttgttgtttatggatcatttggatgtgagaattttgatatcatgtgaagttttttaaaaagtgtgtttataggcccggccgcggtggctcatgcctgtaatcccagcactttgggaggctgaggcgggcagatcacaagtcaagagatcgagaccatcctggccaacatggtgaaacctcgtgtctactaaaaatacaaaaattagctgggcatgggggcgggcacctgtagtcccagctactcaggcggctgaggtaggcaaattgcttgaacctgggaggcggagattgcagtgagccgagatcgcgccacagcactccagcctga

SEQ ID NO: 12344 - DNA, 22311 bp, Human
  misc_feature (1)...(22311): n = A,T,C or G
aaagtttcctccacctagaatcctgctatctcccagaatcctttctgtagaccaaacgggaagacatacggtgggtccaggcttggaggagggtggggagggaggtgcttctgagtgcttgttagaaaaacagctccagggcagggcgcagtggctcccgcctgtaatcccagcactttgggaggctgaagtgggaggatcacgaggtcaggagttcgggaccagcctggccaacaaagattagccgggcgtggtggcaggggcctgtaatcccagctacttgggtggctgaggcaggagaatcgcctgaaaccggaaggtggagattgcagtgagctgagatggagccactgcactccagcctgggcaaaagggcgaaactccatctcaaaaaaaaaaaaaaagaaaaaagaaagaaagaaaaacagctccaggacaagttcttttgcccccttctatgagtctagccatcccaaagccctcccagattctaaaataaggaatcatcctaccgtttcccatcatggtgaaaaacagcatttgcctatatatcctgcctgccccactctctggaggaagttgagtgtttgcagttgcttgaaaagataccacctgaggacagcttggcctgctgggatgacccgagaccagatgtattggaatcactgctttgtccctctccaccctctggctttgggggattgcttctcccatcccaggacctggaacccaaaataaggccccaagagatggattcaaatctagtcattgggggccgggtgcggtggctcacacctgtaatcccagcactttgggaggccgaggcaggcggatcacgaggtcaagagatcgagaccatcctggccaacatggtgaaaccccatctctactaaaaatacaaaaattagctgggcgtggtggcaggcgcctgtagtcccagctattcaggaggctgaggcaggagaatcgcttgaacccgagaggcagaggttacagtgagccaagattgcgccactgcactccagcctggtgacagagcgagactccatctaaaaaaaaaaactagtcattgggcagggatcctaagtatagcattaagaagtcctgcaagatcactggtaagtcagagctggaactgggactcagaatacagcctccttagttcgaatctctcctggcaccttagctaagtctcagtgtttgtgtgaaaggtacaaaatctaaggagacgctctctgaggtcggggtgctgaagcttcctcctctcttcctcctccttggctgaccagagtacaggaccacagccagtgaggaggcagttgtcccagcctggatccccagtgcttcagtccacctcctctctggcttcagggattcccttttttgtgggaaatgtagcaggaagagcctcagacaaaacccctcagatgctgagttaaagaaggaaggggtttattcagctgggagcatcggcaagactcctgtctcaagagctgagctccctgagtgagcaattcctatcccttttaagggctcacaactctaagggggtccgcgtgagagcgtcgtgatcgattgagcaagcagcgggtacgtgactgggggatgcatacaccggtaattagaagggaacagaacaggacagggatcttcacagtgcttttttatacaaataaccgattaggtcaggggtcaatctttaactgccaggcccagggtgtggcgctgggctgtctggctgtctgcttgtggatttcatttctgccttttagtgtttactttggaggcagaaatcggacataagacaatatgaggtatggtttcctcccttagaagaacactgggcaggtcagactgggcagaggctggtgttcctgagccctgaggagacatccagaaatagatgggggcgtgtcacgtttctgagcagctgtgtgggggaggttcaaggggtggggactaacaatatcaaaaagaaacttgtcctcccctctcctggtggccatggtggagatcagcagcagcttccccacccaggacaaggcctaggtaaggagtgcaccactctcctcctgggtgctgggcaggaaaagtggttttgaggtgaaatttgggagatgaacggtggaattttaggagtcatgagaaaaagtttccaggaaactttgatgaagtttgggatacctaggaaggttgggagccatgggaagtttgggattcctgtggggagatttggggtcacattcccaggagggtatgttcagcaagggcctggatgagaaactgatgacagaattgctccgagcaggatgagagggaggacagaagcgcagctcccttgggctagaaaaggaattgctcagcatccccagctccttgggcccatgcccaccccatccctccggttcccaccacatctcccctgacactggtcaccaaggccagccacccacctgctctgcagtggtctacactgttagctgcgctgagaaagttcctcagactctcagcaaacatgctggggcctccccagtccctggccttggcatacatggtccctgccctcaaggaactcactggccagaagaggagccaggcacatataagggcagcacagtgtgataaggacagtgacagaggacagcacagggtgataccagagcccagaggagtcagagggcttcctggaggaggtggccctcgggttaagccttgaagagtaggtatccaggagaagggtgtcccaaggagaggggcgatgtgtgcagagccacagggagggtaaccacggagccgcacctgcgacgttgttctgcactacagaagccaagcaggagtggcaggtgcgagcctgcagagggtgcagagggccaggataaggacgctggcctctgtccttagggtatggagggatgttttgtttgtttgttttgttttttttttctagatgtgtttgtatctcttccctcatgattttcatctctgcatttttactctatattttgagatatttcttccagtcagttttggcacagagggcttttaagcatgtaaggaacatgaccagagtcgcgctttagaaacattgctctccctgggcaggcaggatattggggctgactgtggaggcggggagatcagcgaggaggaaggggcaaacctgagccagggcagggggtgtggatgttgaagggaaggagaatctaggatggacccctatctcacccagcattagttggcaactatgtgaatgtttgacgaatgattgactgaatggacacccaggggaccatcatgggtgactgggtgaataatggggatggtttatcacgtgagacttgccatggcaaattaacaggagccaccctgagctagattaagcctaaagaggattttatcacaaggataccagggtatctcatggaacccaaggaccagatgcaaagagcctctagaaagccaaggaggagtgcggctccacctgacctctggcttcatcaatcaagcagctcaccctctgcctttcagccttctctttcccttgctctggggatctcatctcttccctgatttcaatcacctgtgactctcagatgtctccttgattgtccattctgctacctcttggacatctgcttcagggagttcacatttcccaaagtgaactcaccatttcccctccaaacccgatcattcattcaatacatttttactgagcacctgctttgtactgggactacaataatgagcaagatgagcttttcaagtctactctggtataacattgtgcctatagtaacaataaggcactgtgcacttaaacatgtgtaaagagggtacatctcacattaaatgttcttgctacatgaaaaccaaaaacaaaacaaaacaaaataaaaataaaaacaggccaggcacggtggcttatgcctgtaatcccagcactttaggaggccgaggcgggcagcggatcacctgaggtcaggaatttgagaccagcctgaccaacgtggagaaaccccatttctactaaaaatataaaattagccaggcatgatggcacatgcctgtaatcgcaactactggggaggctgaggcggagaattgcttgaacccgggaggcagaggttgcagtgagtcgagattgcaccattgcactccagcctgggcaacgagcaaaactccgtctcaaaaaaaacaaaacaaaacaaaaaaaaaaacgaggctgggtgcggtggctcaggcctataatcccagcactttgaaaggcctgggcaggtggatcacctgaggtcaggagttccagaacagcttggtcaacatggcaaaaccccttctcaactaaatacaaaaattagctgggcgtgcttgtgggcacctgtagtaccagctacttgggaagttgaggtgggagaatcacttgaacccgggaggtagaggttgaagtgagccgagattgcaccactgcactccagcctgggcgacagagtgagaccctgtctcaaaataaataaataatatataaataaaaataaaaataaaatgaaaacaaagggatacacagaaacttggaagtgatgaacatgtttattcccttgattgtgggaatggtaacatgagtgtatacttatttccaaactcaccaaattgtatatattaattatgtgcagttttttgtataccaattatacttcaatgaggctgaaaaaaaaaaaagtaaagttgcacagggctgtgctggagcaggacactctgcagtcatgtaagaatggtggaagaagatagagggcaataaaagaagatgggcaataaaagaggtgtcaggcctctgagccgaagctaagccatcatatcccctgtgacctgcacaaacacatccagatggccggttcctgccttaactgatgacattgtcttgtgaaattccttctcctggctcatcctggctcaaaagctcccctactgagcaccttgtgacccccactctgcctgccagagaacaacccccctttgactgtaattttcctttacctacccaaatcctataaaacggccccacccttatctcccttcgctgactctcttttcggactcagtccacctgcacccaggtgattaaaagctttattgctcacacaaagcctgtttggtggtctcttcacacggacgcgcatgaaatttggtgccctgactcagatcgggggacctcccttaggagatcaatcccctgtcctcctgctctttgctctgtgagaaagacccacctacaacctcaggtcctcagaccgaccagcgcaagaaatatctcaccaatttcaaatccagtaagcagactctttttactcacttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacggactgggaaggcagccttcccttggtgtttaatcattgcagggacacctctctgattattcacccacgtttcagaggtgtcagatcatgcagggacgcctgccttggtccttcacccttagcggcaagtcccgcttttctggaggaggggtaagtaccccaaccccttttctctgtgtctctaccccttctctgcttttctgggggaggggcaaaaactcctcaaccccttctccttcacccttagcggcaagtcccgcttttctaggaggaaagaacccccaatcccttatttccacaccccaacctcttacctctgtgccccaatcccttatttccacgccccgacctcttatctctgtgccccatcccttatttccgtgccccgacctcttatctctgcgcccaaaccccttatttccacgccctgacccctttcccgcttttctggagggtaagaacccctgaaccccttccctccgtttctctactctctcttttctctgggcttgcctccttcactacgggcaaccttccaccctccgttcctccgtctcccttagcctgtgctctcaagaacttaaaacctcttcaactcacacctgacctaaaacctaaatgccttattttcttctgcaaggctgcttgaccccaatacaaactcgacagtggttccaaatagccagaaaacggcactttcaatttttccatcctgcaagatctaaataattcttgtcgtaaaatggacaaacggtctgaggtgcctgacgtcaaggcattcttttacacatcagtccctccctagtctctgcccaatgcaacttgtcccaaatcttccttctttccctcccgcctgtcccctcagtcccaaccccaagtgtcgctgagtctttctaatcttccttttctacagacccgtctgacgtctcccctcctccccaggctgctcctcgccaggctgagctaggtcccaattcttcctcagcctcagctcctccaccctgtaatctttttatcacctcccctcctcacacccggtctggtttaccatttcatttcatgactagccctccccaacctgcccagcaatttactcttaaaaaggtggctggagccaaaggcatagtcaaggttaatgctcctttttctttatcccaaatcagaagcatttaggctcttttttatcaaatataaaaacccagcccagttcatggctcgttcggcagcaaccctgagatgctttacagccctagacggtaaaatgtcaaaaggccgtcttattctcaatatacattttattacccaatctgccccggacattaaataaaactccaaaaattagaatctggccttcaaaccccacaacaggacttaattaacctctccttcaaggtgtacaataataaaaaaaaaagttgcaattcctcgcctccactgtgagacaaaccctagccacatctctagcatacaagaacttccaaacgcctgaaccgcagaggccaggtgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcagctcacctgacagccactgccagagtccctggaactctggcccgaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctacctctgtctgtcctcactgccattctcccatcagacatcaagtcttgtaaattccacctcctacctctgtctgtcctcactgccattctcccatcagacatcaagtcttgtaaattccacctcctacctctgtctgtcctcactgccattctcccatcagacatcaagtcttgtaaattccacctcctacctctgtctatcctcactgccattctcccatcagacatcaagtcttgtaaattccacctcctacctctgtctatcctcactgccattctcccatcagacatcaagtcttgtaaattccacctcctacctctgtctatcctcactgccattctcccatcagacatcaagtcttgtaaattccacctcctacctctgtctgtcctcactgccattctcttactcaggtccactaattccatgtcctcagtctgccttcaagcctctcctcccctcaagcctctgatgtatcttgtttattgtagagcagatgcagacagaaacagagctgtggagacacaatgagagatacagctggcccagtgggcttttgctgcataactattttgccgtgtgccacaaaatctcagtggcaaacaaacatttactcccaggctcatggtctttgggttgacggcaagtggcttatctaaactggacttggttgggcagctctgctcaggccgccggtctggctcagctggggtcttccttgctctgggctgggctcaggtctgttcctcacgtgttcattctgggggtccagactaaagaagaatcttccaaagaaaagactctcagtttccttcccccaaaagcagacccacagacaagtacatgggtgcagtgagcttctttgtaaagtgatcccaagaaatacaagtcagggagcggcaaagtcagacagagaagagaaaagcagccaattaaaagcctgttaccactgtgatcaactagtcccactggggaccctctatgggacaggaagtctgacttccagccctcattggttgaaggctgtccttgagaatattaaatcccttacacttttggcctgccctgtgctcacaaaaaacaggctcccagggtgatggagaatgcttcagagacagaaaaatgtgagccctagaagtgggaggctgacagcctgcatgagaactatccactgtacctgcatgtggactcgaagacagtctccgggaatatgggctgaggaatccacagtgtcaggtacactctcttttaccctgcatccatagatcaactcgcaggaaggcctctgattggccttcttgggtcatgtgcccatccatgagccagtcacaatggtcaaagccttagggcaccagtcctggggcatgtgttcctctcatggggtgcatagaatgagaaaagccccacctgagcccatgactggattctacacaggaaagtgaggaactagtaacagcagctctagcctccttgctggacttcaagagaccacagacaagagctcaagtctttttttttttttttttttttgagacagagtttcactcttgtcgcccaggctagagagcaatggtgcgatctcgggtcactgcaacctccacctcccaggttcaagagattcttctgcctcagcttcccgagtagttgggattacaagcgcacaacaccacgcccagctaattttttgtaattttagtagagatggggtttcaccatgttggccagtctggtttcaaactcctgacctcaggtgatccacccgccttggcctcccagagtgctgggattacaagcgtgagccaccgcgcccggcccagggaagtgggttttcatagctcactgcagactcaacctcctggtctcaagcaatcctcctaccttcagcctgccgagttgttgggactacagatatgcaccaccacacctgtagcctggcttatttatttatttatttatttatttatttattttttaaatttttgagacggagtctcgctctgtcacccaggcttgagtgcaatggcgcaatcttggctcactgcaacctccgcttcctgggttcaagctattctcctgcctcagcctcccgagtagctgggattataggcacctgccatcatgcccagctaatttttgtatttttgtggagatggggtttcaccacgttggccaggctggtcttgaactcctgacttcaggtgatccgcccacctcagcctcccggagttgtccggatgtatttttttatttttagtagcaatggtgtctcacaatgttgcccaggctcgtttcaaactcctgggctcaagtaatcctcccgcctcagtctcccaaagtgctgggattacaggctggagccaccatggctggctgttgttcataattttatccttaatgcctgacatgctacagatgctaaacaacaataacaaaaaaaattgttgaataaatgagtaagcagcttttgagggggagaagataatgagctccattttggacatgtggaatttggtaaaaactactgctaaccccattgtccagagaagctcatacttcacatttaaattgtgtattggcaattataggatcttagatttgaagattaatgaaattatagacacatagaatcccagtgtcttagagtcactgaactatccaaacttaggtctccccagagccagaggagatgataaagcagcgacgcttaacctaaatgagattgggggcagaggcataaccaccttgatatttatgtaacatttgtgtgaaggcgcatatattcattttctgaagggaagtttcagcttttatcagattccaaaacataaagacccattgactatattaccatttgtgtacagaaagaaaacagaggctgggagctgtggctcacgcctgtaatcccagcactttgggaggccaaggtgggtagaatgcttgagcccaggaattcgagatcagcctgggcaacacggcaaaaccccacctctacaaaaaatataaaaataagccaggcatcgtgatgtgtgcctgtactcccagctactcgggaggctgaggcaggaggatcgattgagctcaggaggtcaaggctgcagtgagctatgattgtgccactgcactccagcctgggcaacagagcaagaccctgcctcaaacaaacaaacaaagtagataccatttttcctaccagttaaatggaaattaaaaagagatcaatcatattcagcactggcaaagatgtggaataaagggcactctcatccattgttggtggggtggcagtttctgtcaaaataaaaaatattcatattctttaaatctcattttacttctcaaaatctttcctataaaaacatgcacacacatagagaaggatttatatacctaaatattcactgtagtattatgtataatattttaaaattagggaagaaacctaagtgttcataagtatgaaatggttaattatggtttataccatgagataaaccaagctgccattatgtgagcagggagatatttatgtactgacatggaaggaagttaatattttttttctgaggaaaaaaggtaataaaatgtgtatgtgtaagcatgtttcctttcagttcttaaaaaaatgacaataaggccggcatggtggctcacacctgtaatcccaacattttgggaggctgaggcgggcggatcacctgaggtcaggagttcgagaccatcctggccagcatggtgaaaccccgtctttactaaaaatacaaaaattagctgggtgtggaggcgggcacctctagtcccagctactccggaggctgaggcaaaagaatcacttgaactcaggaggtggaggatgcagtgcgccgagatcacgccactgcactccagcctgggcaacagagtgagacttggtctcggaaaaaaaaaaaaaaagagagagaaagaaaaaaaaggaaactgcctgctccaatccagacccaatgcctggacaccctcttcctggaaccacttcgggcactccgcctgtcccccagcaaagagggtgtggaaggcttgtggttcctgctgcttctcttagggaaactggtatcctctgtcttctcctgctcttctgatcccctcttcccccagcacccggggtttatatctgtccctccctggaagcaccgaaggctcattccacaagaggactgcagggagtgggggcaactggtggaccaagccctgctctaagtctgtccctggagatcctgctaaggccccaccagctgaacactcctggatctgcccctgtcccaaaacccacaacccctgcgaggtgaagcccaggtctctcactgtggctgtcaagtcctttcatgactggcccatcttcccaacgttcctaccccgcaagctctgccagcctagatgacatgtctttctctctttacatcctcagttcccacctccaatacctttgctttttccattcctgctgcacaaaagtcctttcccacccaaacaccagtcttttctctcccagtctccacttgctgacatcttagtctcctgttcatcctacaagacctgttcacgtcactcctccaggaagtcactcatgttcctttcagcaagaagggtcctctctcttctgagcctccatgtctgtcttatgactctcagtgccaagcactaggaatggcacagactaagtgtcgattcatgtttattaaactatacagattaacactgcaattttccagatgaggaaactgagacccaaaaagagacagcaactggcccagggtcaccagcatgcagatgcctgctatgatgtctctgcttcttgtgtctgtgggcctcatggaagcacttcaggtatgggcatcccccactgttcccaccccagcagggaactgagccatcggcttcttctgaaccctggagggagaaagagagagaggaaagaatgcccgacgcttcccctggggatcactcagcccaaggggacagctccagatgctagtcttggggaaattacagccagaggttcccaatccccttccccaccaggtgtgtttggggcccttcctgcctttctcagtggaggggagagctggatggcaggggactcattctcccaggggcctatcctctcagtccctgctactcctgtcccctcaggcccagagccaccccatcacacgacgagacctcttctctcaagagattcagctggacatggccctggcctcctttgatgaccagtacgctggctgtgctgctgccatgacagctgctctcccggatctcaaccacacggagttccaggccaaccaggtgtatgcagacagctggacactggcaagcagccaatggcaggagcgtcaggccaggtggccagagtggagtctcagccccacccgtccatccccgccacccctgggcttccgcgatgagcatggggtggccctcctggcctacacagccaacagccccctgcacaaggagttcaatgcagccgtgcgtgaggcgggccgctcccgggcccactacctccaccacttctccttcaagacactccatttcctgctgactgaggccctgcagctcctgggcagcggccagcgtccaccccggtgccaccaggtgttccgaggtgtgcacggcctgcgcttccggccagcagggccccgggccaccgtgaggctggggggctttgcttctgcctccctgaagcatgttgcagcccagcagtttggtgaggacaccttcttcggcatctggacctgccttggggcccctatcaagggctactccttcttccctggagaggaagaggtgctgatccccccctttgagaccttccaagtgatcaatgccagcagactggcccagggccccgcccgcatctacctccgagccctgggcaagcacagcacctacaactgcgagtacatcaaaggtaggagggcaagcgctggtcggcacctgtgcggaaggtggaccttccacatccaccagggactttggcaaaccgaagcccctatctcctgtgtcccagggatacataaatacaagtcatatccaccagctcccaaccccttccatctaaggggagacataaccttctgaggggtgcacttactgcccctgaagggatctaagccatagttcgccacttgcctgctgggaggctgaagaggtttcctggccaacgcagcggtctctggccatttgagtgggcaagcagacccggtcgggcttttctcctggtcagaggctggaagggaattattttccagccagattattgacacctagatagctgttgccagaaatgagtaggagtcccaccctcagtttctgagaacagtgcatttatgagatggaagaggaattatgtgctgaagggtgtgctgggtggggtggtgggggcaaggagacagcagttgggtgctgtgcccctaaggtccagctcaggctgtggtcaggaagtggtggatgctcctcctgttcatgtccccagcacaggccagaagaagaaccatgaggatgggcccaggttcttaatttctgaagggctatgggctttacttcctatcttggacaacatcaggagcatgcatgagttgacagaaggtaaggagggcatgcaaagaaaacaaaccaggctggggcgaggcatggaagagggagaggtgagtgtggcagggaggcaaagttataggcccagggagcaggagtgccccagagtagaccctggctctgatggcccactcccttctggccctgctgctcatgggtcgaggcaaacctagtcaagggaggttccaccatgaaagagcagaattagggggaaatgcaccaacttctcctagaacaagtcagggatggactaccagggctctgaggtccctttccatcctgacagctcctgagcctttcattctttactgtttcttttctatagacaagaagtgcaagtctgggccttgccatctggataattcaggtaagggctgcaggcacctgtgggactcagttcagggatgagcaggctgctctggggttggccccatcacctcgatctttttttttttttttttttttgagacagagtttcactcttgttgcccaggctggagtgcaatggcacaatctcggctcactgcaacctccacttcccgggttcaagccattctcctgcctcagcctcttgattacagctgggattacaggcgcatgccaccaagcccggctaattttttgtatttttagtagagatggggtttcaccatgttggccaggctggtcttgaactcctgacctcaggtgatccatccacctcggcctcccaaagtgctgggattacaggcgtcagccaccgtgcccggcccacctgaatcttttataaggaaacaactgcattaataataaaaaaaagtgcactagctgaagtggcaccttgggggttgccagccttagccaggagatgagtgtgtgggagagcagatggttgagggagcagggacacctgctctccagcctggatctgcctatcccttgcaggaaaaggccactgatcaggcccctgagagattcaggctgcactgaggtgagggacagaagggctgctccccacaaagtcctcctttggtccttctctgcctcccagtgcagaacccactgtctctgttactgccctcagggctccctcaaacccacctttgaaggccatgaggccaggcttttggtgctggaggcctgggctctagtccaggctctgctctaactttctctacgaccaacccattctttctctgtgcctcagtttctctgtgtgtataataagcaaattggaccagatgatccccagctatgactcttctcttccctcggacacttggtgtgccaaggcctacccaggccaccatgtttctaggtgggaatgggccatttccagggaagaaacagcagctcctccccaagccttcagaactcctttgtccttcagaactctgtgagtgggcaggaaggaccccccagcttcctctgatccactccaggcacatcatgccattcatcctcaccacaccccagtggtactgtcatcacctctgttctgcagatgaaagtaccaaagcacaaaggggcaaagagaggccgggtgtggtggctcacgcctgtaatcccagcactttgggaggccaagatgggcagatcacctgaggtcaggagttcgagaccagcctgaccaacatggagaaaccccgtctctactaaaaatacaaaattagccgggcgtggtggcgcatgcctgtaatcccagctactcgggagactgaggcaggagaatctcttgaacctgggaggcggaggttgctgtgagccatgattgtgccattgcactccagcctgggcaacaagagcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcatcatctcatctcatctcatctcatctcatctcatctcatctcatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtagaggagccaagttcagccacagcagatcccactctgatcttaaatccatgtttcatcccactctgcagcaccttatttgtggcaatagaaggcagttaagttagacccaatgacctctggaagagaaactgggactctaattggtctcatctctgtctaccttcctaaattctttattaaaaaaatttttttttgagacgtggtctcagtctgtcacccaggttggagtgcagtggcaccaccacagctcactgtagcctcaaactcttgggctcaagcgatcctcccacctcagcctcccaagtagcttggactacagatatatgccactacgcctggctactttttgtattttttgtagagaagggttctccctatgttgcccaggttgcctaaaattttttaagccagtcaaatttagcagtggggggactgtacatcaactttagtgacactggtgttaataagttctgataacccattaccattggaccagctcctccctaaacttgatcttcatctctgttgcccgtggcagttttgtgtatcagtctgtccagctcactctgccaatctctccaccttgtatctgcatgtccccacttttgctcctgtgctcctaaatacctctttttttctctctctctcccccaacctctctgcctgttttccctgcagccatgggtcagagccccctctctgcagtctggtctttgctgctgctgctctggttcctcgtggtgagggcctttccagatggtccaggcctcctttgatgcatgagacacgggacagcctcgcctgctgcctctgcccatcctgaggatgttggccatgtgtgctttcagtgtaaccaagattcctgtcaatcccatctgcagggaactctgggaccttctctggtagctgccagaccggctggtggagaaacaggagacaatctggggactgaaccttacccagggctgtaggagtgagactctgaataaagggttgggccggcggtgtggcgggtacttcaagacaggcagcaactaacctggcgatagaagggcttcagctgatttgggggatgactggagaggaaagcgcttggccgtcatacctgctagtgttactcagatgcctcacgtgtccatctggaaagcttctgttcactcctccaggaagccttctgtgacctctcccacctggctggggtagtgaccctgtctctacgctcccacagagacctggatgcttccctataccaccacatgtccatgtctgtctgccacatcagaccatgagcttcctgagggaagggactgggtcggaggcacagagatggtgccaggaaacgtgtgaaactcagaaaggaacaaatacctgtgaatggctggtccctgcactgcccctgccttggacactgtcaagctctcattgtccgtgtgtgggaatggggtggacggtgcctaactccagcacacagagagaaggagagacgggagagagagcgctagtcctccatcggcacctcggtcaaattccattctcttgtcagcacagatgtaacttctgctctaatccatgagtcctgaggctcctctcatcacggctcactgtagcctcaaactcctggtttcaagagatcctcccacctcagcctcccaagtagctgggactacagatatgtgccaccacacctgactaatttttgtgttttttgtagagacagggtctccctaggttgcctaagttctttttttttttaagctagtcaaatttagcagtggggggttatataccaactttagtgacagtgacattaataagttctgataacccaccaccatggacaccagcaatacccagacagctgggaaagcattatttctggatgtgtctgtgagggtttgcagcaggagattggcgtgtgagttggtggactcagtggcaagttccactctcaatgtgggagggcatggagaggacaaaaaaataagggaaaggcaaattcacactctttcctggagctgggacatccttctcttaccattggacattagaacttcaggttctcaggctttgaacttggacttgcgccagcggccatgagacctgaagtagacagacctggacccccagcttccactaccacagacctcatgggtaacacagggcatcgaggaggtgctaggtacacgcttactttattgagtcagggatttggggccaaatgtctgtagggcctcctgctctggaaactcgactgagaatccccgacccttttccctgagcccctcagcagggaaaggtaacagccaaagccctgcaaagcagccacctaggaaggaagacaggaaatgcagcagtacagttcagtttctcattataacccatgtgctccccactgagagctccaatacccagcacaaacaattctgtccctccaagactgtactctgtgatcttggcctttgtagagttcctcttttttttggaattaggggagtggcaggctctggacttcctttagttagggtgtgtagacaatgagtgctcccttgtggattgtgaagtcaagtgtctcaggatcttaggagcagtggggagagactggctggcccaaagaccagcaaccacttggccgtggctgtccctttctggaggagctgtggctgcagcagatccctgtgacttagtcccagccctcacagggcctgcaccagcaccaggaggctcatgaccagggccatggagaagaagatggccaggaagaagcggtccatcacacgggccaggcgcttccagtcctcatggcagcgctgggcagctcggtggctgcggaaggtattggcaatggtggctacgtggtgcagtagggcttcctggcggcacagacatcgtggctcgtggcaagggcccgctggggggccagcccctccttcaggcgactgggggctaggagataactcaggtggcctggactgcccacagggctcccctctttcccgcacgcac

SEQ ID NO: 12345 - DNA, 86414 bp, Human
  misc_feature (1)...(86414): n = A,T,C or G
agtacttgggattactgagtcaagggatacagaccttcttaaaggcccagggcgtgctgcagaattgctccctagaaaccttgcgggatttgtgctctagccagggactggtgaacttgcctgttcctctctccatcccggctggaacgtcctaagactttttccagttttaaaagtgcagggattttcaacacaaggaaacacagattctcagaggtcatccccccgtccacgctggcagccactcctggctgtgagaagagatagtggcggaagcactctggagtgtagacgcggctgcacctggtggctctaaggggctgtggtgtaggcggcacgagtccagccacatcaggaacttgtccccacttagccatagggtggcctggcacatccccctcccctgtagcctctggaagagctgtttgcctgagggacagccctgccccacatccagcctgttctgcggaggagttctggggagcctgggagtggcctgggcaaggtccaggagttcagcgtctgccctggtcccaggctcactgtgccccctttccttctgcagacagacccttcctgctcttgatcctgtcccaggctcgctgtgccccctttccttctgcagacagacccaggcttgctgtgccccctttccttctgcagacagacccttcctgctcttgatcctggagcttccaggggcagcccagaggggcttgtcccttcttcacagctatgaggctggggcactgtaggatgggggctttttgccagattcccccaagggtggcacttacagatggggacgaccaggcagaaggttgcctcttcatggaatgtcagtgtggaagggtttcaaggaggcctcccagcctttgctctacttggatgcctctggtgatgtgggactcaccactgagtgggcaccctagagcatttagacagcaattggcgaaaacctctcgtgtcaggctgcatgaattctgtttcatggagttctggccattcctgtaaccaacagctctgtcccgaggctgtccctgtccctgtgcccaggagccccatcgttcaggccgcaagtcccacggggaagcagcagcatctggctggtcagcccggaaagacctttcacagtggctgcttcgtcactgttttgcggggagttttcatcagccttcctcagagtcccagtacccgagaggccaaatcattttggggttcctgaccaccaccccgtcatttcacagacggtaaactggggcccaggaagctgtcacacagctggggtaaaggccaggccgaagctggtcccccagccctggcttgtaccgaattccccatgacttgtctcctgcttctcctcagtggggctcaggaatgttcctctccaccttctgcgtgaattaccagcaggacattgggccgaaaacgttgacttttgtcccattgcttagggctgtctgtgctgttcttttcatttctgagtaaagttctttcttgctaattcagagaccacactactgctgatgtggctaccagctggcgcttggtgtgaagggtgtgatggggcattctagaacactgttctgttttaaagcgtccttgacatgtcgatctggagccagcactggctcttggggcctgcgcggacctggcatggagcccaccagcgcctgcatccacaggggaagacccttcctggggggtttgccgtgggtgtgaaggccaccttcacgttcacacccaggtcgctgtgtttctgtttcttttgttgggtttcagcttcctcaggcttgcgaagctgggttccactggtcccgctgggctcctgctttctagaattatctgcgctgcctcctctccttgtggattccaccccatgcatgtatcacactgggagctttggaggggagtggaaaagacctgtggcttcagctgcagccggagtgcctgtcctgcctcctcagatattgtttctaattcatgtttcccttttttccaaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccagtgagtatcagcctgcacagcatcggggtcggccatgggttgctgggggccatggtcctgtgcctatgggccaggctcagcagtcaacctggccctggccgcaagagcacctccttgtctatgtggcgtgtgggtgtcctggggctgctgtaacaaactgccaccaacggtggtgggcttataagaatagagatttacgcttacagctgtggaggccagaagtccaaagtcaaggtgccagcagggcctcactctctctgagctcctagggaggacctttcctgccttctccggggtctggtggttgccagccaccttggcttgcagcagcgttgctctagtctctgcctccgtcgtcacgtggccttctcctctgtgtgtctgtgtctctgctttcatgtggcttttttataaggacacccaccactgggtttggctttcttataaggacacccatatgtttccccacatatccaaaccgtatcagtatcttggagcaagaaccaattgtcatctctcagttctgtggctggctgggctcagcggggcagtttgtgctggggcctctggtgcagctgcaactgctgctgccgtcacaggatcaagtggtgtcagctgcactgagtggtgacatgaacagccacctggtcttcaggatgtggacaatgacagccttcccattcacaggtgccgtgcacccatccgacatgccctcatctattatctaccaggtggggaggggggcgtcccgaggggagggcactcaggtcccatggaagcttcctccctaggtttagtctccgaggcctgctcaggggctggagattcaggtgtcactgggggtgttctgggctctgtcacgtcctatggaagtgagggctctgctcgggccctctgtctggcccagggatgatccttccagaagcccgtggagctctgtggctaatcatggtgcagtggacaggctggggagaccctgctaaactccagggtatggaggctgctgcggctgtggggccccagtgtacttcagggttgcatcctgactgttcttcatggtgaattgttttgtctgtttggttcctggaagcagacccagagatgaggatttgagcaccaagagtttatttgggaggtggtcccaggatgcactgtgggagattggggaagtttgaggggaagctgacaaaggtgcgttcgtaagtgggtgacctccgtggccggggccctggccttgccggggcccgtggatgaacacaatgcacctaccggttgtcctgcccaggaaggccagtgcttttccaacaacgctcgctgcattagctgactgcagccctggccttttgtggtcggagaaagtgctcaggtggcaggacccttgcctttaagagggaagcctcaggatgcgcagagctgtgagtctggaaatgtgacctcaggtgggaaatgtgacctcaggtgcgaaccatggctctgggtgtgaccttcgactccgggtgggaaccgtgacctctggtgagcactgtggcccggggtgggcagaggacgcctgttccacgctccaacaggctttgctgtgtcattgtaaggtgacccaggacatcagggagggccctgtgaatccccttccatcccccactgggtgccggcagcacaattgccacctcagtcttgcatgtggggtcatggggaactccatggttggcacagtgacaagaaccagacccgtcgagcagctaaagaccaccagaagcagagtggatggaagaacaaagcctcagagatgggaccctcctgcccctgaaccttgagaatggcccagcctcaggccagaccctaaatgacagggttaggcaggtgggcgggttggaatgtgtgtcccagaagtgacggccagggtgggcgagtggcacccttgcagcctccgacctgccccctggctcagcctccaggggcactgggtaggcggcctccccattatgcatttcccctcataggatccagaaacgggagggtacagcctggaggtgagccagcgttgccaagacctcgacactggcagcactgcccagctggtgaaaggtggtctggctgaggctgcgccggcccagacccagagagctgccagttcagagacagcagtgcaggcctggacccgagacctcatgccccagtggtttttgcctgcttcactctaccctctcctctggcctggagaacaaaagctgaaccaaagctttaccccacggcttaggagccagaggccggagccatatctgtgggcagccacgtttcctttagccagtgggattgaaacctgaagcgagacaccctgcttcaaatgcctggatcccgtctggccctgaagacattggagttctgggatttcgcctatgtgccagcagcctctgctccccagtaagctctgagcagaagtctaggcaagcccaggaggtcaggagggaaatgcaggagcccctacactttttttgggcaactggtaggtcctgaaggaacctccccttctcaaagatgaacatatgcaagacaccaacctcttctgagatgccgatcttccggggatcaccaaactaaattaaatgtctgtggggttacagcaaagttctgaaaccaaggaggaggaaagggccgtggactcagggtaggggtggagagcctgccagggcatttcctccaggacacctggaatgtttcagacattgtcactttcatcctcgggaaactgaagagccacagagcccaaacaacacatgagatcagtgtcctgcccactgtagccgaagacgcaccaagaaagccagggccccaggttgccggcaagcaaaaggcaggttgtgagggtggcagggacaggcacccaggccgcttgctggggacggcctggtgatggatatgagacgtgtgaggccgacctcaccaggctgcttgcgtgaaatgcaacgaaggttatccagcaagtggtcaaaggtgtgcgtttgaaacgttcaccttggtgctgttttaccaagcccggggcaaccgcccaaatgcccgccagctgggagctgctgaagggatgttaagtctatcccggcagcggacctgagtgctcctgaaagtttgtgtttacagctgtgagaaagtgccacacgatgttgtggggaagggggcaaaggtcagcacggagcccaagagtgaggccgtgtgtgggtaaagggcagatgggcactcactgcaggtcctgtgtgcactggatgtgcacgtgcatgggagacagcagggtgcgggggagggaaaagagtggccgaagaatgaataatcaggaaaaatctctaggaaagctgttttcattttggagaaagcaaaccagtggtggttttggaagaaagtgctggaagctacgtcagaaatctgagtgaagggctgagggagctcaggagagaaggatgtcccctaggcctggcgcagggaagcctgacggaggaagggggtcatgggcttttctcctggaggttgaggggccagggtgttccagagggctgacctgcccccagacaagccccaggaggacactgcagacagggcatgagagggtgcgggtggatgtccacctgccaggagcactcacaggagccaccgtccctggtgacttctcagctgcagctcagatcaatagaattgggagtggctgccctggctggtgtgccaggcccctcggaagatggcggggactgtgcggggcccctcagaggatgtcgtggggaagtgacctggccagcctgccctgcctgtccggtgaagctgctgactgttcctggagtctcaaaacatgaggagaggccccactctctaaagcgtgccttgtagctccgctgtgacgcagaaattggaagcatttgaaagtaaatttaactgttatcccgtaatcatcacctgcataaataatcctcttcatttgaacacaccagacctagcagttttgtgagccagctgagctgtccattaggtgcacttcggtccgacctggcagagctagtgtaggttggcctgggggcagaagttgagtgtgagtgcttccgtcctcctcctctctcctcacattctctgccctgaggaccggaggacgtgagggccctgagcctgcccagccattctgcagatgctggaggctggctggggacgcggaccctcagccatgtgcggcccctgaagtgagttcctggagtgaggggcctggctgtgctcatgacttactcgctgtgtgacactggctagagggcatccctttgggcctcagtttccccacctgtgcagtagtgaggggtggtgctgggtactccctgaggtccccaatcatatctgcactcttctggccatgcagaggaggcccagggtttgggtggcctctcatctctgcccttgcccacagatggggatctggacccagggtgggtgcgacccaggcccccagcctccgctgtgggctcccccaatcccgagcagtcggggacctgggcaagcccctctgcacgggcagcagtagcacccgtgtggtccctggggctgctgttacagagggctacatgctgaatggcttcaaatgacagaaatgtcccccccctgttctggaggccagactcggaggtccaggtgcgctgcagagtgggcgtcttaaacagcatatgttcccttctccgcagtctggaggcggaagtccaatcaagatgcccacaggtctagatcgtgggagggctgtcttcccagcctgcagctgctgccttcctgctgtgtccttgcctggcccagggagctcgggtcccttcccctcctttaaagccactcatcccaccatgaggtccctgacttcgtggcttcgtctcatcctcatcacttcacaaggccccatttccaaatgccagctggttgggggtcagggcattgcatatgaatctggggacacgctcggcccacagcaggctccgttgggaagagccagctcagctcggccctcacacctggtgctcaaggccgcaggaaagctgagactctgagaaaacggctgtattccattcctttcccgtcccccttcttccagctccccccactcctcaccccaaccctccccccgctgtctctgtcgtctcggtgtccagtcctttgcaggcccatgcagagtcctgggaaggctgcctgatactgggcacctcgccggccttggaggggcccagctctgggggcctggccagagcctggggtgggaggggatgggggccctaaaggggctggctgaggagcccagcccagcaggccctgggaggacctgtttctccctcctccctcctcaaacctgcacaaggaaaaaattccagaccctggcaaaaaaagccctttctccagcagaatcggggaggtctctgtgagaagcaggctgctgaaggaggggctgcctgtctccacaggcctggcggacctcagggctgggaggtgttgcggggaccctggcttctagtctggctgtgcgtcgtgtgaccgggggagaggacctcccctctctggagcttggggcccatctgtagtgacagaggatggttcccagccacagcacagggtgtgggaggggtggcagggccagggtggggtggggctcccagacacaatacatggcctgggagtggggttgccggcagggtagggtgggggtcccagccccagtgcagggcctgggatgggggtgtaggcagggccagggtgggatgggggtcccagccacaacacaggcctgggaggggtgggggcccaggacaagcaggcctgagggattctcccaagggccatttacagctgcaactgagccccactcccgcccactcacctgtgctgccctctgtcccccacctacctggcattccttgggcaccatctgtgccctgtcccagagggcccccacctcatggagctcatggcccatgtggggtgtggcatcagggcttcatctgagcaaggttggcacctagggctgggcaagggtgggacagggagcaagggctagtgggggtgtggggatgggggccaggcctgtgcggggagcccgacctgagtgcagcggggtgaggcgagggggtggatggggcaggaaggggtgtggggatggggccaggcctgtgcggggagcccgacctgagtgcagccgggtgaggcgagggggtggatggggcaggaaggggtgtggggatggggccagagtgcggcggagtgaggggatgaggtggacacggtgggtgttgctggcttgagcaaggggccccaggcctctgtgtcagagctgggaggcccagccgggctgtgctagggaaggcgctgcaattgtttccacagcgctggttgatcgtgctagggttctggaggcggcgccacgggtgctgttgggtcccggcaggcgctgaagtcgggacagcttggccttctctctgcctctgctcctggccatagcacggacgtggcccctctcacctccgaggacagggctgtgatggtcagtccccagctccctcctgctggctgcccggggtgcctgggtgtttcccagaaatcctcaggcctgggatgggggcgcaggtgggacctgaaactggatctgccctggcgacaaggctgccagtgatgcctgtgctgtcagcaagacgcttggccagagggggtctcagtgccctgaactgccataaggaagcaccgcaaacagaagtgtgctgtctcgtgattctggaggccagaagtctgagatcaaggtggtggcagaggtggctgctcctgagccatgaggggcacctgtccaggccctccagcttctggggcttgccggctgcttctggtgttcctagcttgtcatcaccctgatctctgccctcatgttctcatggcaccctccctgtctccaaatctcctcttttataaggacatggcagcactagattagggcccgtcttcatggagtaggacctcatcttaactaattacatctgcagcaactttatctccaaatgaggtcccattctgagatactgggggtaaagacttcaaaatatgaaattagggggacacagtttaactcgtaactggggcattttgttctccgtggtcctggtggcaggtccccagggtgcatgctggcacggagggtgcgggcatactggaggctgtgccgctggcccccagcccacgctggctgaggaaaaccaatccggggcagacacagcctcatctccagccttcatctccaagcataggacggtgccatgagggcttcgttcttcaggtttgctgatgtgatggtggtggtctccgggggctccctgaccaggaatggccagtgttcctcctgggtgtgagaacctgggaggggactgcctcaggcctccaggcctctgtcaacaccaattctgggttcagacagtgttccagggggcagcgggtcctgtccttccggccactgaggacatgcagtctgcagggtccaggcccgtccagggcctgggaaatgctgggggcaaggatggaaggtggcagtgggtgtgctgggtccctgagatacttgcaggctgtgtgggtgggaggagctcctgggacactcatactgggacagctcctgggaaacccccccaggcaccggctgtgggcgggggcatcatcacgtgttcatggatttgttctgggtttgaggaacagatattctgtgagcactgcctgaagccagcccagggtgcctgggactgggcttgaagttgggtggaggagggagggggaggagggactctggcagaagacagtcccatagagctctgtctggagtagcaagcctagaagaaccgcacaggcgtaacacaaacgtgatggacgcccaggcttccagcgcttctcgggcacgtgcacgctgagccggagcataaaggcctgagcagggggcggggcagggcaggggctgtgagcccaaggtggacaccagagatggaggggccgcagcttgcaggtgggaaggatcctccccgggtggctgcctttgaggggagccagttgcatttggcgggagaatgacacagagccttgcaggctggtatggtggtacccttggacatccatgggtggcagcgtccaccataaggagggggcagagacagctcatctgcctgggagtggggtcctaggtcccctccaatttgggggcctggcttgtctggggcccgaggcctcttaagaccatctccccaccttggagtgtagatgccagctagtcaggggccctcccagcacagcgctaaccacctgtgttccctcccacagccattgttaaccccaaacagcccaaggagacgcccaaaagcttcagctttgactactcctactggtcgcacacctcagtaagccgggaccccgggtcgggggaggcgggggcagcagtgcataggccatgtggccctcggggtccctcaacttctctgagccgctcattcctctctaactggggcgaggaccccaccctgctcccctggaaggtcaccctgagcggtcctcagcgaaggcagtgatggaggctgcaggaactgaggggccttcagctccgtgtgggtagtttccagggtcagagctgtgtgtacgtccatctgctggtgacttttcccccagacatcccaaagtcagaatgcccaaagctgaccctgagcctgtctggaagctgtgccctgcatgctgggagcccaggagacccctggactcttctccttccctcctccccgatccagtccacactgagccctgtcttccacctgccacctcctggacccttctagaagaaggcatgcagcctcctcatctaagcccctcatatctatatctctgagcacctgccccccataacagccccagggctccccgcttctgccttccccatccagtccttcctccttccaggatgacccccagctaatcaccctgtccccctgcctaaagtgccccactgtcctcaggacagtgtccaggcgctgtagcccagcctgtggggtctctgggcctttgcaccctgtccccagtctcagctcttgtcacccctgcttgtcacggtcacatggaacttactttggctttgaggtctcacctctgggcctttcacatgctgttccctctgctggaacccgtcctgcctcctgcctggctggccgctcttcatcccgcatctgtgacacagagggcttctcctccaggaagctaccccacaaggcaggagtaggatggggggcaggcatccctccccactgtgctgccctggcaccctgaggccctgggcatcccctggctccgcagacatgatgggctgagcctcggatgcacccagcctcctgcaacttcattccttcctcgtcctccagcctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacaggcacgaagcggggggcgggcgggggcagccctggcagatggggcgggaccagctgaggctgagagctccgggccaggcacccctgagagcagcccccagagagcagggagtcaggaggggaaggccagctgggtcaagagtggggctggggcaggtgagagccagatgtggctgtgaagctgcagacccaggccccaggtgcaggaagggccctggccttggacagggtccaccttgatcatgtgcctaagacacagcagctgggagagccctggctggggcagctgatctctgaaggtgtgagggctggcagtgtgggcagagagaggtgctcaggacaggggtggccaaacaccagacccagcagctcctcatttgctgcaggaaccctgagtccccagccattcccctgggcaggtctctggacgtgagttggtcactagtactttgcctgctgagggaagggagatggctgggatgtctgtaggatggcagagccagggggaggggcagatgacccacaccagccagggacccctgagttaagagggagacactggctccttggctacagactttctcagtgcctttaccatgacgtgtgtggtgagggtgcaagaggggcctgagagggtggatcccgcctggcacaggctgcccacagtatcgcaaggggcagggatccagggagcagccccagccctccctggctgactgtccccccattcctgcagctctgcgaggacctcttctctcggatcaacgacacgaccaacgacaacatgtcctactccgtggaggtagggctccccgcctgccgtcggccgctggggcagggctgggaatctggtgtggctggcagtgcttttctgatgcaaagtgagtgcccaccacgggtctgcacgcccagcttgtccctcactcatccaagtggcaggcaagacggcgggcctgggcagggctcgagacccccaaagcacagagtgatgaggtgatccccacctggcaggtgcttctccagcagctgctctgtgccagggcatgggcaggtgcctcagagctcagggcctggccatgcctgccgtggctggggtggccctggcatatgtgtgtcctagagcccaggatggccgtggtgagggaggccacattgacacccctgcctcgaacatacacacaggggctgcagactgggagccctctgctcagcaggcagcgcctaccctctctctcaggggtcctgatggcagctcccaccccctcactcaggggcccagcaggcagcccccaccccctcactcaggggtcctgatggtggcccctaccctctcactcagggttcctgatggtggcccctaccctctcactcaggggtcctgatggcagcccccacccctcactcaggggcccagcaggcagcccccacccctcactcaggggtcctgatgctggctcccatcccctcaggggtcctggtggtggcccccaccccctcactcaggggtcctgatggcggcccccatctcctcactcaggggtccttatgttgacccctaccccctcactcaggggtccccccagtggcagccccactccctcgcctcaggggcccctgatggcctggctctgccctgcaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggtgggtggagggactcactggacctccctgccctcctgtcctgccgcctctccccggaggaagccccttcacctcggtcctggccctttttggtagggtccatctgtgcccccgcggaggtgtggcctcctgagcccgaggtcgtttaggcctgtgccagcccgagagaggccgagggctccccctgtgcaggggacactgtcacctccatggggcttctccttcatgggggtctgcgtcctccggctgaggtgcccggggggtgctggcagcatctgtggctgctgcttcgatggggcagctgctctgctagtcccaggggtccacattctgtgtgggggccagtgtgctggggtcagggggcatgtggggagggtcggctgcagtgctgcagccataagcaacctggctccttggcctctgctgccctgggcctcctgcctgggatgccctggttgtcatggcaacagactccctctgccacccgggacttcctgagggtgaggtgatggcccttgtcactctcagctcctgaggtcgtgagtcacactctgcgccatcctgcacccctttggtggccccacaagggctggtgggtgggggtgctgttcctgatgaggcccacagcgcaccctggccgtcattgtgactccgtgctggaggtgggccctgggctgccacatcccatgtgctgagtcttgggaaccttccctgaggtccctggcaggtcagggtggcatcaggaccaactccaggccaccctcagcagccttgggcttcctgttctggaggaccctgccgagacccatgccatctcctgaggggtgtggcgggctccttgggcttcccagagccgcgggtgtgggccgtggtagggtggacagtggacagccctttcccccttcccctcccatatcatggccctggagggctcctgcccagctgggcactgcatgggcttctctgtgcccaggagtgggaagctttcgcagtcactgctgccctgaatataccagcaagggctggggctgaggacgccactgtgggcaggtggccatgggccctgctggagttctggcaggaggcgccatcagtgccaggcccagcagggcggcccctggggtctgggggaactgccccccccgatgacctggttcagagggctggcaccaccggcgatctcgcacccggccacaggacgaggggtaaccgtgcgtggctttctgctcctcaggaccgtggcggccaccaacatgaatgagaccagcagtcgctcccacgccgtcttcaacatcatcttcacccagaagcgccatgacgcagagaccaatatcaccacggagaaggtgagtgagtggcctcacaggcggtgccaccaagggcagtggctggtggtcagggtaggggtggtggtcaggccagtgggggcagcacaaggacaggcccaatgctggcctgtgcagggcgggtagtgtcctcacacttacactggcaccaggtgtggacgtccccccccccgccccagaggcccttctcccatgccttggcattctccatggaccaggccagggggccatcttctggggcttttgcctggacagccagtccaggcttacgggaggggcagcaggagggcacccagcctctccctgaccatctcttactctgtcccctgccctcatgccccagctgtccaggcccaggggcacctcagccaccacctggttgggggctcgctcaggcagccgtgtggggagcgcaaaggggctgggtggagtgagggctgctcagtccctgatggtgctggaggtccgccaggcacatcctcctgaccgggactccatgaaacagtgagcgggggctcaggatggctgaggtgggttgggggacagacgagggtgaagctggacgaggtcggcgcggctgcctgccccgctgccctcactggtgggcaccgagagggtcctgtggtgtccgtgggcaagtcctgccctgtagctatggctcaggaggggccaggcctcccggtgcagggcctcccaccccagactgcgggtgcccctgttgggagcctggccggtgcccacctcgctaggtgcagccatggcccgtgtggtggctgagcagggccagggcctcctggagctgggttctaatccaaccacggacactgagcaccatctatggaagtggggacagtgacagtcgcacctcgtggatgccatagggagcgagtacgcccttgtgtgaaaaccacccagcgtgtggtggcagcgcccgtgctcccctggggaggtggctgggcactcaactcgggcagggccttgggagagctgggacggaggtgcgggtggaaactgcggggtcaggactgctgggcctggggaggggcggcgccttgcagaggggacgcttggccagggctccttcaacagctgtggagaccttgcccaggggtcctgggatgcccccgcgcatcttgtggcctttcctgcatgtgatgtatctactgtttcaggtgagcaaaatcagcctggtggacctggctgggagcgagcgggctgactccacgggagccaagggcacgcgcctcaaggtaggggccaggccgccatgcggggacccgtgtccacatttggcctgctccagagtgggtggcaggagggctctgttggggtcccgggggcctgggccaccctgagggtgagcctgcatagggagggtgggcataggctggggtcttgggctgccagcagccgagggccatgcccggggcaccagcgctgggcacacaggtcaggggtttggcgggacggtgtcctctttcgggccccaaggaccttgcgcccagaggccaggtcttccctggggagattggggcaccacccgggaagcagtgccggggtcgggaaggagtgtgtttcctcgacccctgctggcctcagcactagatgcttgggcaggggacccggaagcatttcagggggacatgggatgatatcagggtttgcatggggctgagggcaacactgggggacatgctcctggccagaggctccagctggctttctgccagggcaccccacgcccaagtggccccagagatcagcagctgcagtggtggcctccactccacactgcacaggtccacccagggcatccctccagagcaggaggccccacgggtccccagcatcccaaccccactgtcttttctgcccgcaggagggggccaacatcaacaagtcgctgaccaccctgggcaaggtcatctccgccctggctgaaatggtgagtggcccggcccggcttccatagccagaaccccagagggtctttggcgccccatcctgcccctgtcaccctcgtttccgggccctgtgtctgggaggtggccaggttcaagggagagcccggagatggccagagtgtcacatgctggagaaggggtaggggccctggtttctcccgggaccctcagtttccccgcctgtaaagtggggctatggccacagttggccccgtgcagcaggcagcccaggcctgggcccgggaagggcggccctggagggaccctgcctgggggagctgctgtctaggagaccacggggtggtagagcctgagtcatggccagggcgaggcagccgggccgcctgctcttccgcccccacagcccgcgccagcttcgctccgggcctcagcctctctctgtcttttccttttcaggactccggacccaacaaggtaagcggcttccttcagccccggggcaggtgcgggaggctggtggcggtgtctgccctgcattggcgccctgtggtgaggggcggggcgggcagtgagtgcgctgggagatgggggacgtgggggtggatcccgggaaggaagaaagcgggtgtgggaggccccgtgcggtgcctgtgcctgcggggacggagggcgtccggggcggcctcacggcagggcctggggcgggggctgctgggagacaccgaggtgggaaagtgtggcccggggggcgtgggggccctgggaggagctgaaaggggcgcggaggagcccctcggacatggagagggctggggagccctgagaggaagcgggtgacaggcgtgctggactctgagcagccgtaggcgtgacggggccacagggggaggcgggcgcgtgtggagtcggaggtgccgcggagcgcgccacgtgtgaagctgcctggggcgacgctggggactgtgtgaggaaccgcgtgggcagccgtgaaagcgttcgagggaccggcaggaacggagtgagccagcgtgggaatgcgtgagacagggcgggcgccaccacggggatccgcgaggtgctcactgggaaacgcacagggaactcggcggtggctgtgtggggacagagaactgtgtgaattgtgaagagctgtgcggcccgtgtgaggagttccaagagactaagaacacgtggggctgcaggaagaactgggagaaggcgtgtggactgagtggggaactgtggagaacggtgtggcgaacccgagtgggagccaggcgaggaagctgagggcccctgtggggaactgtgtggggaactgtgtgggaacgggagaggaagcgtgtgggaaacggcacaggacactgcgtgggactgcgggagacggaggacctgcgtggggaattgtgtgtggagcggagtgaactgtgaggagcggtgataaccgcgtggaactgtcagagaacgctggggaatggcgtgggcggcgtggggaggaagcggagaacgatccgctgtccagattgtgcgggactgtgaggagctgtgtgtgtgtgtgtggagctgtgtgtggagctgtgtgtgtgtgtgtgtgtggagctgtgtgtgtgtgtgtgtgtgtgagctgtggagctgtgtgtgtgtgtgtggagctgtgtgtgtgtgtggagctgtgtgtgtgtgtggggagctgtgtgtgtgtgtggagctgtgtgtgtgtgtggagctgtgtgtgtgtgtggagctgtgtgtgtgtggagctgtgtgtgtgtgtagctgtgtgtgtgtgtgtggagctgtgtgtgtgtgtggagctgtgtgtgtgtgtgtggannnnnnnnnnnnnnnnnnnntgtgtgtgaaactgtgtgtgtgtgtgtggaccagctgtgtgtgtgtgtgtgtggagctgtgtgtgtgtgtgtgtgtggagctgtgtgtgtgtggagctgtgtgtgtgtgtgtgtgtgtgtgtgtgtgtgtgtggagctgtgtgtgtgtgtgtgtgtgtgtgtggagctgtgtgtgtgtgtgtgtgtgtgtggagctgtgtggggagcctgcagagaactgtgtgtccaactctgtcagaagccggaagaacctgtgtgaggaccagaggaataaatgcctcaggaaccgtggggggaacccgaggaactctgggggcctgagggtagctgcgtgggaacatgagctgtgcgtggtgccgggacaggacgtgtgtgccacagggtggggagctacgtggaatcatgtgagggaaccgtgcagagctctctgtgcagctacgggaaagtatgtgagaaaccgtgtgaggaattgcgtggggaactgtgggaggatttgtgagaaactgaatgtgactgtgtggagaaggcggggaagcaggcgggaagtgtgtggggaatcgcttggggaaagtgtgcgctcgtgtggggaaccacatgggggctctgtggagctggagctccgcgtactctgaggacctgtggaaatgggagcggaagtgtgtggaggggtgtggggccgcgtgggaatcgtgtgagggacgccgaggagccatgcagctgctcggggagcggtgctgggctgggagaaactgcggggggccaggcgggcggctgctgggaaaggcatgaggaaccgtgtgaacgctgcgtcagggactcgggggatctgtggaaatgtggaggacactgtggggaagcgtgcgggaactcggaggaactcgcgggggcctgagaggagccacgtgagcccccgtctgaggcactgtgagaggatctgcttgagaaactgtttgtggaactgtgaaactgtgaaagtgggtgcaacggggctgtgtggacctgtgtggaatgctgtggagagctgtttgaaaacggaagcaccgtggggcgtggggaggcctggggggaaacatgggacagcctgcgtgtggagccatgtgggaaacaacaactgggaggcagtgcatgcggctgcgtgaggagccgcagaaccgtgcgaggaagcgtgtcagccagtgtggggaagtgtgggaactgtggggaactatgaggaactgagtgtggaactgtgaggaactgagtgaggaactgtgaggaactgagtgaggaagtgagtgtggaactgtgaggaactgagtgtggaactgtgaggaactgagtgaggaagtgagtgtggaactgtgaggaactgagtgaggaactgtgaggaactgagtgaggaagtgagtgtggaactgtgaggaactgagtgtggaactgtgaggaactgagtgaggaagtgagtgtggaactgtgaggaactgagtgtggaactgtgaggaactgagtgaggaagtgagtgtggaactgtgaggaactgagtgaggaactgtgaggaactgagtgaggaagtgagtgtggaactgtgaggaactgagtgaggaactgtgaggaactgagtgaggaagtgagtgtggaactgtgaggaactgagtgtggaactgtgaggaactgagtgaggaagtgagtgtggaactgtgaggaactgagtgaggaactgtgaggaactgagtgaggaagtgagtgtggaactgtgaggaactgagtgaggaactgtgaggaactgagtgaggaagtgagtgtggaactgtgaggaactgagtgtggaactgtgaggaagtgagtgaggaactgagtgtggaactgagtgaggaactgtgaggaactgagtgtggaactgagtgaggaactgaggaactgagtgaggaactgagtggaactatgaggaactgagtgtggaactgtgaggaactgagtgtggaactgagtgaggaactgagtgaggaactgagtgtggaactatgaggagctgagtgaggaagtgagtgaggacctgagtgtggaacgatgaggaactgagtgtggaactatgaggaactgagtgaggaactgagtgaggaactgagtgtggaactatgaggaactgagtgaggaagtgagtgaggaactgagtatggaactgagtgagggactgagtgtggaactgagtgtggaactgtgaggaactgagtgtggaactgagtgagggactgagtgtggaactgagtgtggaactgtgtggaactgtgaggaactgagtgtggaactatgaggaactgagtgaggaagtgagtgaggaactgagtgtggaactgtgaggaactgagtgtggaactgagtgagggactgagtgtggaactgagtgtggaactgtgtggaactgggtgggaacatggaggtgctgttggggacccgtgaggagccgtgtggagcgctgtgtgtaggaacggggtgcacacgggcgaatggcctgaggaagtgtgtggaaagtgtgtgtgcacccgcattggggatggcgtgaagggttgtgtgaggaacgtgtgaggaagtgtgtgagccatggcgggaggagctgtttgggaaacgtggggagcggtgaggaaccgtgtgtggaacggtgcgcagaatcgtgaggaaagctgcagagacgtgtgcgaggggttgtcggggagtgtgaggagctggatgggaagctgcggggacctgctgggcgccgcgtggagctgtgggaaccgggaggaagtgtgtggaagggggtggggagctgtgtggggacgggggccgagctgaaggggttttcgggagctgcgtggctgctgtgaggcccgtgggacactgagaagcctgtgtgtgtgtgtgtgtgtgtgtgtgtgtgtaacgctgtgcgggagctgcgagcgcctgctgagagctctgagaaatggaggatcgtgtgaggcctcccgtggggagccgtgttaggaaatgttggaggaacgtgggcaagtttctctggagctgtgaggaaccgtgagagcgagtgtgtcagggacggtggggactggcgtgtggagaatggtgaggaacgcctgtgtaacgaggccctatgtagagacctaggtgaggatcgcgtggaactgtgtaaagaactccacagagaactgtgacagaattgcgtgtggaacttgtggggaaacttgatgaatggtgtgaccggcagccatcccgcgggtggggtccgcattcgagtgactgccgttttcctgaatggaggaataaagggggaagcaggaggagctgcgtgaagaaccgtgtggagaaacgcgaggaagtgcgtggggagcgggaggagctgaggaactgtgtggtgagctgcgagcagccgcgtgggaaccgtgcggggaacggcgagagctccttgagggactgagtgcttgagcgtgcgggactgacatgtggaagcaccgcgtgggaaccgcgtgactgtctgtgtgagggactgggagggaaagtgcgagggaccctgcgagggacagtgacagagacttttgaaggagccgcgcgagagggttttcgaggaactggttgaggagccaggcccagagcagggaggcgaggccggcaggagccgggcccgtctgaggatccgaggtccctcccggcttgtcaggagctgcctgggggagctttagtggcagcagcgggcgggtgttcagcggggctcacagtgtctgctttagccaagggtgcgtcctcaggccatgtgcgctggtgacggataggtcgggagcaggtggcctggtgcggcaagtcaggatggaaggtcagcgttccaggcttgggatggtggaggctggggggcctagacgggagagcggggtggtcctgggagatggcggagcacgactggacagggaggcggtgagggagcaggaaacccagggggctgctgggctccttgctgaagtggctgaatggctggaggacatttatgtggaagcaaggaatgtgacacatagcagagaattcaccctcaggaattaaataatcaaaaaccaaactagaggccgggcgcggtggctcacgcctgtaatcccagcactttgggagcccgaggtgggtggatcacgaggtcaagagatcgagaccatcctggccaacgtggtgaaaccctgtctctactttaaaaatacaaaaattagccaggcatggtggcacacgcctgtagtcctagctactcaggaggctgaggcatgagaatcgcttgaacccgggaggcggaggttgcagtgagccgcgatcgtgccactgcactccagcctggtgacagagggagactctgtctcaaaaaacaaaaacaaaaacaaaacaaaagaaaaactagaaatagagtagagttagtccctactaagtttccaaagaaaaaagaaagcagtcagttatgctgctgagctgcgagatggacaccctgaaaccctgctcgcagagaagccagtgcagtattctggaccccctttgaccgggagtctcaagagctttcaaattttatgtgccttgtgagctggtggagcttctcctggggttgtcttcaagaacaatgatgtctgtgtgtgctcccagcccttgaggtggcatctgcgtgcatgtcctggggtgcaggctgcagggtcagaggcctcatctgccggcccagcaggtgctctggaaatgcttcataagccaatgcatacatgaaccagtagacattggaagtcactgaaacccacagttagtgggatcattaagtcagtcacagagtgtctgtcagaagcaattcctggcaggcattatgtggatggagtccatattttaaagagccaaagaggcagcaagagcatggaggatgcttcattctgaggggagggatgggagaacaggccgttagaggaaagcttgtgagctggcttctgcaggaccatagggagtttgatgggggagagggcgggtgaactctgggtgaaggggagatttaagctggcagggaggtaagcgtggcagaggccataggggcctggagggccacatttagctgtggggccttttcccttgggtcaggagtcgctgatggtgttcgaggaggggccatggactcagatgagtccttcagacagagtggagggaggacacacttgctggtgacatcagcactcctggccggtgtccagctgggtggcccaggggcagcagggatggaagagggaggaacctgaaggacatgctagcaagtccctgactgtggcctagaggaggcctctggggtggcggcctggggtctgggcagggagaggcctgggcagcctgagaatgtgtccagcagagcgggccccgccccttgcccagcctccagctttgaggacccacttggcagggcctgcgctggcccctccctttcgcttcctctgcagtgggctcgggcttgaccttgaatgttcctcccccacagaacaagaaaaagaagaagacagatttcattccgtaccgagattccgtgttgacctggctcctccgggaaaacctgggtgagaacttgtgggtttgcctgtccccagggctctgatcccaccctgggctgtgcccttcttccccactgagggggtgcccagtcgccagcaggcctctcaccctttctgggctgaggctgggaggtgaacctggagggtccagtcagttcgtggcccttctggaggacctggggcaacggccagcagtgggttaacgaagcgagtgtgggaaccaggacagcccagggggtggcacagcacacacctgcctgtgtcagtggtcctgggtcaggtgggctgtgacacccaggccaagtactcatccttctctgggccttggtttccccatcagtcacggggacctgggacgcgatctgggagctctgcttgctggattttgaggggctgccataaacctcctcttctccgtctgagttctgagcagtgagacttagacggggaggtgggaattgaaatgcacccgacgctgatcccgtccatcccggaataacctcagagtcctccccaactgcatttacagctggagaggctgatgcccagggaggtaaactgagtcttgggctgacctggtgaacatagatgactgggggtccctggcctccctcagccgcatggctgaggtgtgcagagccctggctgaccacctctgcaccccacaactagccatgcttgctccccagctcaggtcagtattgcagaccgcagcaggcctgcggatggatgggccccgctgagagaggaggagagtgtgttccttcacctgagacgtgggctgggaaggagccgcctgctccaggcacacccaggttcagtcccagggcgggggcaggggagtcctcccacagaggctttcctggggcccgtgtggtatgtgcccagcccttcacaccgtctcttcagtccctatggggacccactggggacccatgccctggggacatggccctgaggatacacagttccctggggtcaagcaggcaagatcatctgtccagacttgaagcaccgccaggcagcagtcctgagggctggcgtggagtcagtggtgatcttttccgatggctgaggttacctagacaggattccctcaagagaaagaacacagtctgttcctcatgccacgcattacctgatgctttgatcctactaacctgggccaggaatctgatgttaaatactgaggaatatatttcaaatgaaaatgatagaagtgcttgaaaaaaatattgaacataaatggtatttattttggagtaaatactttaaaaccctccacaactttcctctctgctttggggaaaggaaggcctgatggttgtaaaatggccccaaatgtgagaaaaacacaagtaaaagagaaataatagcggtgcctggttcagagatgaaggagcagccaaggaaggccaggtccttgctgttgtctgtgttcatggggtgggggtggggggggggtaagcctgtgactcagtttacctctctgggcctcagcctccccatctgtaaatgtggggggaaggggggagcagacatagccctggggcctagatccccctctgggcacaacctggtcttcttcccacaggcggtaactcaaggacagctatggtggcagccctgagtcctgcagacatcaactacgatgagacccttagcacgctgaggtgagttctccagggagacaagctctgcttcccgctccctggtcttgggggatggatcctctcgtgcttgaattaggaagcaccagtgaccaggggcgactctttgtgaggggtataccctggactctgtgaggctggaagagactgttctgaggctcctgggcctgcatgggccctgttctattccctccatggagcctttgggggtgtgctttggggctgcaggcagcccagggccccgtggcaccagactgggagagctgtgcctgctgggcgaagcagtttacactcacctgccggccggggtaaccactggggatttttagatagcagaggggacataggtgtgtcttatgggcagggtgggcacctggggtggggagcctgggcccctagccatgctagaggctgctcggttgtttgggtcagtggtctctcccttctttcgactgtgcaccaccagtgcttaagagaaacaaagggcgtgtggcccaatagaggttcatgtactagctggaaacgtagacatgtgcatcggctggtacacggtgtgagcacaagcctatgcacacatagatgtgctcacattttcccactggactttctccctctaccctgggaccactgggggagaggacaccaccctgtcccttctcacctgggcctcagtttccccaagtgggcgagcgggaactgggtgacctcccttgtaagtcttctctggcctgtggccccaaatgccctccccagcgacttgccatgggggcgatttctcactctgtgccaggctgtgctggctcaggtccacctttggcctggctgctgagcccaaaaggctgggtcttgggcagggctctaggcacccttgggacctgccagatgtggacctgtcccgagcacagcccacagccccctctgccacccaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacagtgagtgcctgctccagcctgtcctggacagggttgtggggcctcaggctcaggggcctcgcaggtcatcacatcctctctcctggggccaccactttgctggctgcaccctgggctgtggcagctccacaccgctcccagagcccctctgggccaaatccctgtccctgctccacgttcctgggcagaaatgcctctgggtgggaggccgggcgggggccctggacaagggcaagtttcctggccttggcctggatggtaccacatggtttgggttcaatgctgatgcaagtgggccagagacggctcccctggaagccccataggcaggctgtgggtgctggggtcaccgaggtcccccgcgttctggagctgaagaccttcaccaccctgcttgtggccacacacccactgctggccaccctggcctgtgaaaggcgtgcctgaccctctggagacaaacctgttcttctgtttctctgtctctccccctcccccacgcttccctcccccatagccaacactgtgcctggaggacccaaatgtgtgtattccctttgctgctctctgcatctctgcttccagccccagccagcatgagggcctagggtggcatggtcagggaggggtgaaccccagggtacctgctctgctttcttctcctttttggggggcagaaagcactgctctccctcagccacagggccctgctcgtagatgtgggattctgtctgcctctgagcccacactcctggctccttcccacccatatggtctacatgagaaaccaaagcaacgggggagtcagggtgtcgctgaggccttctcaggctaaacatggccgagatcaggtcctctgaccccctgtgcacccaaaggcctgcgaaggtcaggatatcagcaccaaagggccaggagggctggagggactgtcctgtccccagctcttggctcaggcctccatctgcaatgccatttctccagctgacctgaccccccacgcccaggccctcaactctggaaatgccagaagctcagctttcacagcggatactgccaaatcccacccaacctttgtgcctcctggcctcgggtctggctccatggggctcagtgcctccccgagcttggctgcagggcgccctccacttcccccacaccccgtgtggtcccgtgcttgctgctgctctgctgtgtgttcgcttccgctaggagacccctggcaccacccacttcagagatgtcacagccccacctcccgggccttagggatgcatgaggcctaggctggtgggtgagctcctcgtggtggaggggaagggcctccctcatgagggtcccatgttcacctcctccaggatggtctctgggccaatttccatgtcagtgggctgaaggttagcacagcctggccccacagctcgggggtgtgtggtgtcccaggctgacggtggatgtgaggggtgggaggacaagcgtgggggtctgcacggggcgctgctgggtgaccacgccaagccagtggacagggtgggaagatgcagggaggactggctcccagccctcaggtgtgggggctgtagggtggcctggcagtggggcctggagtgcagctgtgggaaagcaagaagcctggcgcagggggtgcaggggagctccagagtgcctaggtctgtgccatgctgctgctggggagggcaggcctggggggcaggcgggcaagtgcgcgccactgctggccccgtcccatcgtaggcaaggggtggcaggaaggccttgcatgcgcttgtcctgggcctggcagggctgctgtgcctcgttgatggtttctgtttcttgccttctctgggccccatctcttactttttcccatcttcatcttttttctctccctccctctgtctgtctgcccgccctacccctcctccccatagacgtgtccgaccttgagaacaataaccttaaccgtggcgggacggtgaatgaagcccctgaccctctctccacagtgaccaatgccctggtgggtatgagcccctcatcctcgctctcagccctgtccagccgcgcggcctccgtgtccagcctccacgagcgcatcttgtttgccccgggcagcgaggaggccattgaaagactgaaggtgagggcaccacctggggcttcagggtgtcagactctgggagtggggagctcggaggagttagagaggcaccctgccctcctgggtacagcccatcctcatagggccattgtggagcatcagcaggagcctctggcgtgtggccacccaggtgcccagtggtctatctccagaccacccacagcagccaaggcagccagttcacttgggggtccccaggctgtgggctgcacaacactcagctgctgggcaggaaatgcgcctgcaggaccctagacctgggtgtctggatggcctgtgcccctacccatgccaagcctggacaagggaagctccaagaatgaatgtccaggactgagactcttcctgtcgagtctttaattgtgtgagtgggtgcttgttcaaggagcagtgagctggatggcatctgtgggtggagaggagtctcgtccctccccaccccgcagcatcccctccactgacgacagtcccaggtcacagcagcttcctccctggcgtcctatagaattataccccctgagaagggcagtgagtgtggtgcaggttcctgagctccctccaggccatcctgtgttcacacctgcacacctgcctgggaatagtcaccacctcccaccgctcaaaggcacagtgtgctccctggtgcccagcaatgggccgggatcattttaggtttctagacacatgcccctcagtgaatggctgtgcaggggcaggtgagccacacgcctggagactgaggggctgaggggaaaaggcagaggccccactgaggctgttgtgaggaaggggatgggggcgaggttgggcctgtgaccctggagcagagagcccttctggggtgttggggtcccactgggctgtgggtgggaagaaaaaggagagaccaggctgatgttgggcagtgtcgtccatgtcctgaagagggctgagcacctgggcctcttggcagcagcgaggatggctgtgctttaggagccgaggctcagaatctcccaggagcatttgcttctcttttccttccagatttgttttgcgttttctccattctcctgagtgtgtctaagggaaagacagacattctctgagctttaccttggtcttctggatgcctcgttgccttgtcgggcccaggaatatggcgcttgtgctttgcagctccttctcctggcacccgtgtctccattgtcctctcccttggccctagccccggcagctcactgtgctctgcctcaatccccaggaaacagagaagatcatagctgagctcaatgagacctgggaggagaagctgcggcggacagaagccatccggatggagaggtgtgcagcggggaaactgaggcccagggggaggggtgcagccagcaagcccggagcctgggcaggatgagcactgagccctgccctccagtgctgggcacctgcaccatggggtggccacatcccagcccagggcaaacctgttccctcatcgccaatgacccccaccttgtgtactgctggctgctagccaccaaggcctgagagacctgaggcctgatagacctgatccctgaccatggtgcagaggggccagtcccatcagcagatgccctaacccagtgaccagatgggacacgcatgggcaccacccaggccacggtggccacaggcccgctgcccccattggtcagccagggctgaggccagtgctggaagccttgtggagcttgtgctgacctcagctctgttcccccagggaagccctgctggccgagatgggtgtggccatgagggaggatggcggcaccttgggcgtattctctcccaaaaaggtaggagctatctcagttctgtggtactgccctcatctgaacaggaccaggtgaggtgctgtctcaggtagagccagagggggctcctggaagtaggggagcacggtggggctctggcccaggcactggggctgtgaagctcacccatagtcacactttgctttttgtggagaattctgtccccacattctcatggtggggcatgctggtggctttgggacatcagatgggtctcttagtggcctggagtgtggactgggctctccaaggtcagagcaaggctgaggagccaacacccaggctggagactgagacacgaggggcctggacctgccctggagcctgggctgctcacagagctgggtgccagctgccttcttggaactcagctagagtcaggtctgactgttccagtggggacccctcttttcccaccaggccaggcctaaggggtctttcagctggaggccctcacatggcacagaacccctgggcagctgcttcagagtgtatatgactcctgtgcccccatccagcagcccaggtggggcatggcacagcagcccaggtggggcatgacacacacacttgggaaaaagtctttcttgtggttctagtccccaacccccacacacccaccccaaagatggccaggacatggggacagacacctgtgtgtccatagcttgggaggggctgggcagggctgtgctccaggccgccggcccagcacgcgctgaggtccggaggcaggaagggcctgagaagagctgtagggagattccagtcccaggcagggccgggacaggcagtgtcctaatggggcttcactatacacgtcttctagacaggcctttggtttggtctggaatggattgttccctgcactgtttcagaccccatccccttcctggagggatagggtggaactccaggggtgcagctttattggttgccctgggtctgggcactgcccagaagtgggaccactggggacccccttcttgagaagttcagtgttcttgggaatcacgagacgtgcacaggccagtggggtcccaaggctgtagcccctactcagccccaaagctgtgggcacagcccctcctggctggacatcttccccactcagggggcagggacagctggggatggtctgtccccttcgtccagtgacgaggtctccacctctctgcatgggggtgcctcaggtggctcatcaaggatcccttcacaactgcttcactccccagactccagggctgagccctccatggtcagtgtcctgatccttcttggctcttggctcccactggtgaacccatggtttctgggctgtctgagctggaatggggtcctagaaccccattttacagtccaaagctgggaacccaggaccccatgggacaaagcctgtggtctgcacatctgggggctcaccccagcctcagagggccccagggcccccacatgctgagagctggggctgtctgcccttctggaagctcagcttctgctgcagtgctggggctgctgtgccaggcttgggtgtatgcgggtggtcgggtcccaccggcctgctgctgttggtgggctgggccttcggcttgagctttctgtgttcctcattttcctggcttggagtgaccagcctggtggcaccagccaagtgcgggggcagggaccctggtggtagtctggtgcctggagagaggttggaggggggtgtggccagcatcaggctcctgcccctctgcaagagagatgatcctcctgtctccctgcagacaccacacctcgtcaacctgaacgaggacccgctgatgtctgagtgcctgctctactacatcaaggatgggatcaccaggtgagaggggacctggcagccactccagcctggccaggccctgggatctggcaggggaaggctggactccccattcctgcttctgcagaggggccactgagtttggacttccccagcgaccccactgatgtctgcgctgggtgtttcccaaacaatcctggttgggcgtccctggaggccagtgggtggcgtcctgggtgtattgggtcccagctgccgtgctgatggtgcccccaccccgcagagtgggcagggaggatggcgagaggcggcaggacattgttctgagtgggcacttcatcaaggaggagcactgcgtcttccggagcgactccaggggaggcagcgaaggtatcaccaccctaccgtccctacccgcacccatgcccctgtgccgtgatgatcaggcctgaatgaggtcaccctctcccagcttacccagcactaagtgggtcacgagtcatacttctaggcaggacgtgtgtgtgtgtgtgtgtgtgtgtgtgtgtgtgtgtgtgagagagagagagagagagagagagatttggagagagagagagatatttggggccagccttaaaaacaacttccattaggttggtgcttgggaaaatgcctggtactttctgtggccaggggtagctgctgccttagggagctgagcctccttgagggctggaggtgggggcacaggtgggctgctggccgggaagcgtgttggggcccagggtggaggatgttcatggcgggaggacagtgagccatgaggattgagcccagatctagggtggaaaactatttccagaccttggtttcctgttggctgtgggcggccatctgtccgtttcccctgcctgcccagtggtctccctcctggagatgacgtggggctgtccccattgcctggtgctgcccaacttggggatgggcctgtggtgtcagtgtgccgtcacatggcccacagcccaggctaagggcatctcccggcagcatccagccagcctctggcctgcagacctgtgactgacacccactgtccaacttggccacctcagggtgatggccctaagtggtgttgggacgattggctctcctggaattctctgactgcaaagccctgcctaccctctcctgtgggacggcccaggccccattagctggtgtttttatccttgtccacctggggagctggacagggccctgggtgattaggcccagcacagcctcttggcttcaacgtgggcacatgcatcctccttctgggggtcactttcttcctctgttaagtggggtgagacccctaagctcctctgaggcccaaatgagtgttgccaatggtcacggcctgtgtagcagggaaaagagaggcgagaggcttggaagaggccatgcccgggggccaggtaagccgagctgctgtaggtgacagcccctcatagtcctcctctctgcccctcccacctttcctgtagctgtggtgaccttggagccctgtgagggggcagacacctacgtcaatggcaagaaagtcacagagcccagcatcctgcgttcaggtatggctggggactccgggggccagtcaggtaggcagaggcatgaggcgaggcctctgttcccatgtccaagccaccgcctcctgtgcactgtgcgggatggcagctcttaagggccgctgggcaggtaggggagggggctgcgggtatccaagcagctcatgtgcctccccagtcccccaactccaggaacacagcactacaggccccattcacacaacacaggggccccgagacactgagtccgtgctgtgggctgagtgaggagccagggtgtgcctgcctaggaagaagctcctgcctcctggcccaggactctgccctgtcgggctggtctgggggatacagggcagtggacaagggcttcccagagctgaggtgttgtggagctcagtggggtgggctgctccagtctctgaatgcagcaccccgggtggggttgggctctgttcccagacactgcagtgtctgtgatgttcaaacacgtgcaggcacacgtggcataaagtcccttctttagagaagtcagacagtcagacagggggccctcttgagtggtgtgtgactattgcccacgcagttagggttctgccagagaaacagcagcagcctgatgcacagacatggctgtagacatgtaccgagatgtagtgagataacgtacaaccatgtctaggtataaagagatttatttcaaggaattggcttatcagatggtggggctggtcagcgaagtttgaaatccatgggcaggtggcagtctgggaactcagggcaggctgggaactcggggcaggctgggaactcggggcagggtgggaacttggcaggagtggactccatccgctgggtttcttcttcctcagaggaagccccagtttgctcttaggtcttcacctgcttggatgaggcccaccccaccgttgggggcctccttgatttccatcagctgattgcaggtgtggagcacatgtgcagaaacctccacacaacacccagggagggtgtggctgaatcactgggtgctgtggcctggccaggctgacataaaagtgaccattggcttggaacaggggagaccctttcctaaccctgtcttaggggaaagcagagggggtgaggaggggcaggtgacacccagtggccccacttctagcccatctgccaacccccgaaggctttcggaggagtcttcgggactcaggagtcctgcctgtggggtccctgggcaggagggcaggacacactgaatgtcctgaattcgtggggtggccttgtaatggggagtcggtgtggctaagcctgggcgacagctggtcagacggacagagagacagctgtgcccattctccctgcttgttttggggttggccctggtgcctgtggggctcagggcagggcctaggctaagagaggccttagcttggggtttccctcccagtgtccgaggtgggctgcatacggcctgtggacagggaggacagaggaagtggccagctgagagcagccagcaaggaggtgctgaggggggacagacctgcaggcacgggccacctgggtgggaggcagggcagagccggctctatggggccccaagacagagctgcagctactagggaaagtcagaggaaaactaggccatccaaagagagcccctgcaggcaggactgtcccaagacagtgagtgctgccctggagggccctgcagatggggcagccctgaggggggtccagccgggtgctggggtgggaggggctggactgatgcccatgcctcggtggccctgatgctgaggctctgcagccacctgtgcctgctagtggccgtccctgcttccttcttgtggtctctggactccggaccctggaccccagccctgggcacaggggacctgccccagccctgcttccagtctagtcggggagacagatggaaaggaaaggtcctgtgccctgcagcagtgctctgtggagggcccaagtccagctctgggggcaccggccccagactggatgtgagaaggagggtcctggctcccatgtgtgcacaggggcttgggggcaggaggcaagtacaaggctggcctggggaggggcggggacactggagcacagcagaagccccagatctgtggtttgcaaatgtcactggatgctgagtggagagtggccaagggtggatttatggggagagtgaggagacacattcaggtcccagcgagggctgaagaaggagtggctgggagctggggatggtggggtgcctgcacccgttcccctttctcctcacgcctccccgcttgagaccatcagggacctgaagatccccatccctcaaggccacctgtccctctgttccccaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggtgaggcggaggccacccccatctgcctgctgcccctcctgccctcccgtgctcaccccaatgcccccttgcaggctccaggaactggaggaccagtaccgccgcgagcgggaggaggccacctacctgctggagcagcagcggctggtgagtgacgtggccccgccctccctgcccagcccccacccacaccaggggacccctgtcctcccacgcccccactcctccctgcttgcctggccccatctcttgcatctaaacagtgggatgtggtgaggcccactgtctaggcgcagtgtgagaggcccaggcaggtagggccgtagtggagtcacaggccttgctttctgcaggactatgagagcaagctggaggctctgcagaagcagatggactccaggtactacccggaggtgaacgaggaggaggaggagcccgaggatgaaggtgaggggtcactgggccagcacctgctgcgtcaggagggtctcagcatggaggtgggcagccctgggcctctccctggaggtcactggtcagcacttttgccctggggtctggacctgtctctttagggaaagacctccttgccctgggaagcaccgtggaagcagcattgggggaggggggatactgtgccacagctggcaagcagctctgcacactcacgcactggcgtgtgtacacacatgcacacattcacgtgcacacatgtacacacgtgcacacacatgctgcctctaacaggagtggctggatgatgatggggaatggggctggtaggggctcaccatgctcatgcgtccactcttcccatcctgctgaccacaaggctcatggggcccccgaggaagagtccactgtgcacatcacctcaggattccctcagtgagcatgtgctccgggggccaacccagctgacctcccgcagctgtgggcagaggtggcccacatgcaggtggggaggggtttgcacccatctcagcctctggccaggtggtcagcagctttgtgctggcatgaccttggtatcttcccctgtttggcctcatttacccagcgaagctccctcccacagcaaagctcaggcgtgccagattgggggcagccaaaggcgtgtagtgctgtgttgggaggaggggtggggtctcagcacaaggacaagtccctccttgtgtccctgcttgtccttctctcaagggcccagtggacagacagggcatgggtcggggagagagtgtacgggccagggccacctgggagcacctggcctgccctcctgcctcctctcctgtgggccctgctccccactgctggccccagatggtgtgtggctgtcattgacggtgttgctcccccagccactctgatcttcagcctgactcacaaggctgctcgtggcggcctctcctttggggcatgcagagcttttcatgttgctcactgtgacagagctctctgccggtttcttctttctgtgtacccaaatagttagtgtgaaacggggtggggggcaagcacagagctctcccagcccagacccagagtgagaggaagcctggggagagaggggcctgtccacctctggcctcagtgaccacagggggagtaaccttccagccttccatcttgttacctgataaccacccggccgtgatgtacacagagcacagggtcagcttaggcagccccatggagtggccgaccagcctgaccttccagagggcggggcatggtgggcagggtcatggccttcctgcgatgaccacgtgtgacctctccccacagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtgggctgcccactggctgtaccgtttcctgttggagagagtgtgtcacctcactcatgacggggacagctacttgggactcagcacttggctctctgccggccccgggggtggcatagcagccctgcctgacctggccccccagaagggtgggcagtgagggagcccagacctggccaggtgggacttggctgctcacgggagacggcggccgggtgggcaggcaggaagtaggtggtcccccctggcggctgtctgaaaggttccagtgaaccattgtggggcaggcagctgaaatctccagaaggtgggaaggaagcctttttggggacctggcaccctgtcccccaaggagctgacgagtggtcatcttcccctgtcacaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggtggggctggagggccgctgggtggatggtgggagggtcctcctgggcagggctgaagccacaggagcggtggtaggcacaggcttcacagcgagtacctgcagacaccgctgttcctcctgttccaattattttaaaatcagaagaaaaatgtgaatagagtccagccttgtagaatcctcattctctttctaccaatgcagcaatcatacataaaaatagatttggacattttctttcggaggaaaggacagatgaggggaatgctccctaggcccacaggggtcaggacggtgcagtggaggggagggcaggctgtggcaccgacagaacaggctggcggagcgccaagagcgggtacagcagggcctgaagggtggctccccagagggactgggagaggtggtgggggatggaaggaatgcccccttgctcctccattcaggaagctgccgggaggtggatcccttagctgagcccagtggaaggtggaggaggagctgaggtgggggtggtgaggaggaagcctgggctgtgcccctctgtgcccaacgtgagctggtgtccttcctaaagctcggcctctgctgtccccacatgctcacgctgatttgtcttgagcccttaatttttttttttttttctttaagagacagggccttgctctgttgctcaggctagagtgcagtggtgtgatcatggctcgctgcagctcaaactcctgggctcaagtgattgttccacctcagcctcccaagtagctgggaccacaggaatggagtgcactatgacacccagctaatttttgaattttttttgtggtagagatgaggtctcgctctgttgcacaggctgatctctaactcctggcctcagccaatccttgcaccctggcctcccaaagtactagcgttataggtgcaagccactgcacccagccaggcctcaagttacgggggtgactgagtcaccatgtgaggtcagcgccatcagtgggggagttgaatgtcactcacaggcccctgggaagcagagcatggcacgccccaccctgcagggctacagggggaggcaccaggcagagaggagtaggagtaggggaaggcccaggccacagcctggggttgtgggaaaggccaggcagagcagggagacagcttaggcttggctagtttgaataattctgcagggctctggggcatagggctgtccctagttgtctggtaccttgtcctgggtgatttaggccagggggaatattggcctggtgtgtgaaaaagttagagaaaggaggtggctggggtacagacttgggattggttggtttgtgtaggaaaggcaggggtgatggcaagttgctgactgtctctaggaattatcaggacctgggcagccctccccagcctgcagtgccccccaaggaagtcaaaacatcacaagatacagaaaataaaaatatgattaatgcattcatacacacatacacattcatgcaaacacacacacacacacacactcataagcattcatgaagatgtgcacatatacacagcatacactcccacactcaccctcctcactcttctgccctgttctcccaggttacgtggcttggaaggacggacagccactgttgatgtggtttctcttatacctgagatctaggggcacaatgattgcttttcctttgtcctacattaagtttttcttgggaataataatttgtaggctattttctctgtcttctgtgtccctacccccagtttgccctttattccttgagctcttgcgcctctgtggcctgatccccgtttctgagcttcacttgggttctcttcccacctctccgccagctttccagcagcccagtgccgccagcccctctagcccctcactgcttgttccccagcccaccccctggagggagtttgggaggagctgttggtgaccttgcgtgcttagctgagtacgttacttgtgactgaccagctctaagggtcacagagggggtctgtctagcaagccccctggaccttgatgaccctgagctggatgtggtggccagagctaggctgagcccactgtccccaggagataagggtgtgcggtgccagctgctgagcgctgggcctgggtccacattgacccctgccgtccctgcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcaggtgggcgcctcctcccttccttggcagagagagagattgagagagagagatggcagtgggggtaggagtgggccctggcctgatacaaggagcggccctgacaagtgcttttccagccccatattcccagccctgtcctccctggcctgaggttcctcccagccattcctctccacacaccacagggcctgttatttcaggggacgtgggatggggtcttggcactgccacccaaacccactgcagggctgtagccgccagaacccatgggtccatgtgtatgaatatgtgaggctcccaagcaaactttccaggtcacctgttggtcctgagggtgggaacatggaggcagggctgtgtcacctgagccttacaaatggctgcctccttccccggtctccagtctggggtctgcacccagcccccttcaccccatgggaccgtggtattctgaggcctcaacgtggccaaactctcgaggtcctcatatggcctcagccactcccagccgagacccctgttctcagtcccacctgcaggtgtcctccggaaccttccggaaccttcctgctggccatacatgtgatttctttccaagcctgggggcacagttttggttctctcatcttttaaagcagcattctcgatggtctgtgtgtttggttttggttttaaacagaagccccccagccccggccccggcccctgttcgtccctgcgagtcgctggtgttaacttctctctgtcttgtcgcactaacctcagttcagccatctctggctgcaacagctaccctcttctcaacacatgcatgagcgagcgcatggctgctctcaccccctcccccaccttctcgagccccgactccgacgccaccgagcctgccgaggagcagagcgtgggggaggaggaggaggaggaggaggaggaggaggatgaggaggaggaggacctggaggacgacgtctttccggagcacgcgctgtgcgacggccgggacccgttttacgaccggccccccctgttcagtttagtaggaaggttggtgaggtcgaggagagcatgctggggaggacccagctcttttgcacaggagcactgctgcgggcacagaggaaccgctggggcctggcccgggccctcccagggcaggcgaggcaggtggaggggctggcctcctgaggagagcacccgagggcccccgggccctgcatccttgcagtggggctgctcacccatcctggagacggtcgctttgggccggcagggaagagtctgggttccaggtacagaagaggtagtgcaccccggagcttgcagctgtggccccaggcaggtgggactatttctgcagagaggccgtaggaaccccggagtggctcaggcacccaatggccgagttcctccctgaaagtcccagtgcagggcccaaggggcatttgataggtgagggccagccgcccccaagcaggatgcccgtcctgtcattctcctgggaatcaacactgtcctagcggaggcagcctcaccccagctcagctgtcatccagaagagacagaggctcccggctgctctcagtgctctccactctctttggggaaaggagctgaactcagaggcagccatcctgaggccacttttaggagtgggaggcagctgctaaccctcccatctccctctgaaatgatggggcctgggcaaaacatgcctgtctaaaggtgaggactactccatccctcctgacctcctcggttgtcatggccagagatggcggcatgtggcccaatgccctcatggaatgtgccctttgcagagagaagctggttatcacgttgcccaaatggatgagaagccacggttgggagacagaatggaggctggggaagcccagacccagggagcagacgtcccaccctgctggcagatttggcaaatccagctgcctttctgttatcatggaagggaagtcaggtgaaggaaagatctagaaacctggctgtagtagtcagaaggtcagctcacgaaacagctgaatttatatattttacatatatgaatgtcataagataattcttaatagcaacctttttttggcgattaagattgcttccctgggctaggccagtggaagttttcaaaagtctggagcttggagcagcagtgctgacagctgaaggctaagggtggccccagatcgcagggtttacacgggctttactctgtccttgggtggagatggtggaaggaaagcctcaccctccctcttggaagacagcaggtcctcatgggcaggtgccatggatttattctgattaatttttcatgagtgttactaggctgtgaggtgagataagctggcctaccagataaaaacctgtggcactctccctccgagatgctctgggcctgtacttcccactctgcagggcccaagagggagcagtggaccccaaggccagttccatgcaggcctctctcagaaagccccgggccgtagggccaggccccctgcacctcctgggccccaggagtggctccgggtgtcaggtaggtgagggatcaggacgcacagggggatgaggacatcaggagaagtggggtggggctctcgcagtctcagccagaaagagctgggtccttccaacatttttttccccttttgtggatttgagattttacaaaactaccaaaccaaacaaaagtcatcaaagagagacctggcccccatattgcggggtggtctgtgaagggcttcattgggaatcatcttgatctttttggtttggcaagaattggcttctcccatgcagcagctgtgcaggcccggccctgggaaggcccctcgttgattttcctttaaccttctggtagctgctggctctctctccaaagcttcagcgaaattggggcacccactcttgtcccctctggaaaggcttccctgggtcccagcatgcgtctttgcacctcaccaatctgtggttagcacctgcctcctccctccctcccgccacactcagccctcgctctgtctgcctctgctgctgcctctctcgggctgggtttcagtctgcttcaaggtaccctggcctctgcggaaggcctatccagcactggcctcctgtgttctgcactggggctcctcacccaaggccagggtcagcccccaggggcctctgcctctggcggtctggggcaccaggtgacctggggaggcaggtgggttggtgaccactgcccatattccaacaggagtgggcctggggctctgatttcccctggcataggaggggtaggaaacacaggaagggtgggtgggcacaggagctgcagagagagcagggcgagaggctgactgcctgggataagggtccctgggaggggagcagggctggggagggagcgcaggtgtctagggctgggtcgataaacgttgctccagctcgagggcttcactctgggtcagctctgtgccctctggactggcaaggccacgccactcccttgggtcccacatggtgctcttggtgggctggggcccctctgtcttggtatttgtagcatggctgcggatggcgtctctcggcccgagatcctgagagccactctgcgttgggtgtgtctgtggctggtagggacaggcctgggctacgctctggttcccaactgatgtcaggttatttctggcacctagagggcaggtgggggcatggcctgcccagcatgtgagacctgcggccctggagggtgtctccactgggcagagacgccaggctccaagatgccaggcaccagtgctctgccccatcacctcacacttcgggtgcattggttggcatgggctcttcgcagagtggaggggcaccttccgggcccagctcacagctctcttgaggctgttgctgccactggggcagtggattcagggccctagaggtcccttctggctgaacaagtctatcactgagccaggcagactgggacgggcagtggggagaggagagcaggagagcacccagcactagagccacagccagatccacatgtcccaccggtggcctggggcccgaggtcagtgccatgaggatgctcacagggtgctgtagagatgggggagcatttggtgtcagacctccggggtccttttcattgtataacctctacctggatgtccctcggggccccacccccagcagtccccacctttggggcacagtctgggctgcatcttgcccatctgtttgaaagcagttagcagcagtctgtgatgctacagtgtctgggtcctcccagcccccagcatgaggacagtccaaaaaagcatgaaacaatcgatctgcttaatcaatcagctgtgataactaagcaggtgcccaggtgaattgcccactcagagtgggtgaggaggtgcccatggaagccaaccctggccctagaagtaggtggtggagcttggtgtccacacagttgagctggagatgagtcccttgcaggcccttgctgccaggccctggtgacttccttaatctctttgcctcagggttgtcctctgtgcgatgaggtataagtaccatatttcatcgttctaatgtgctgagaccctgggtggattttttgcatctctaagaaagaagggtgcagctggttgagttgagatggctgtttattaggacgtgccctggcgaggagatgggggtgcactgcctcccaggaggtagaagagcaaaaggccctgtgtgctcgccactgtgcttggcccctagggagcctccacagatgccggctgctgtgatttctgccatgttgcttcataatgggatgatcggagcctggggttgcgaggggcttgggcctcctcctcgagcccagcccctgtctgatttgtggggcactcgagtctgtgctgtgctgctggagcctgagcccacagttggcaacatggcagaaggcgtctcctcagagtcagttccacacagcgtttgttcagcagggagcccttgtggagagagccaggatggggcctgcctgctacagcctcacaatgtgacctgggatgggcctggcccctgcctcagtttacctctctatgcactgcctcagacccccttggacctggcctttcagggcagtgggggagagtgaggaggggatcagtgtgagaccctgagagctaagagtgggaagggagtggccccttctctagctcaggtgcagaagtctcctccctctgggtgtggtcctggggagctcagaagttggtgggtcacctttgtggtgccatgagtggcacatgtggatggccccagagcccagggctctgctcactgccagcagcccctgtggaattgccctaagctttgggaaggcagctgtggtgatgggtctttgggggtaggaaaggtagtgtctgaccctgtctgggtggccctggacagctctagcctctccttcctgtgagctgcgccaatggattcaggaaccccgtgcctgagtgtcctcacctggcccacagtgggagtggtcccaggtcctgccccgtctccgagcaccaccccatgggcttcctgcagagtggggtgggggcagtctcttcatcctcagtgcccttctgccctccaaccctgggatttttgcagtgggcactagctctgggaaaatgtggggtgggtgggggctggagggcaggggctggctcagagccccacagcatgggctgtcccgtctggtctcattatgtctcccccagtgtggtgcgccagccacggggaagagccgtgctgtctggcggcccaagttctggctctccccacccccactcctggacaacttagctttgctcagtttgtagcagccccttttcccacccccactgtcaagcagagacccttgtccaggagcccggggtgccctggggagggaaggcattgccgtccccctcccaaggggatgctggtgagtccctgcctgcggagcacccagcaggactgtggggaggggccccgccctgtgggcctcagtgtcctctcgtgactagggccagggtgagcttccatgggcgcttctggacataacctgggtgggtggcccagggcagtggagctccagcccccacacctaagtcaggcagagccgcctgcagccctgtgggtaacaagtccctgatgggctccattggtgtggggtactcgcttctcggggggcatcttcagagggggcgttgtgctggggagagggcccaaaaagccaccaggggcttcctttacccccggagagaggcctgaggagactttcaggcccctggagggcagcaagacccttttcctgttgggagcctgggccattttgcagtgagggcgttggtgaggtctcagcttagcagggccactcagaaagcgagggaggtgccatgaggatgtgtaaagtcagaatgaacgagacggccaaggggaaggtcctgacagtgactgggattctggggcctctgaggaggcttgaggccgcagatgagatggagggtagggcttctgcattggaaacagagacacccggggcatccatggacccatgggccacaaggctgagcttgactgtgctggggaggcagggcctggacccccagggccacatggggcatggacacccctgcaaggagcttgagtgtcaccaagggcatggggggatgtgtctgactggtgccttaagacctttctgtctgctgtgggggccatggcagggtggctggtggtgatgggacagttgaggggggcttcttgaagacttttgaggtggaactgatggatttgatgagtaggaggggcccctgtgctgctggtttctgacttgctgctgcaggaaggtcaggggtattagggtgtggagggagcaaggtcaggagcccacctgagagaggtgttgggcgttcacagcccgctgagtctcactcatcccctcatcagtatctgctctggaatcgagggccccaggcacggccctttcccatgctggaggtcatggtgctcagagccacacctgcctggagcaggaagcagggtatccttccgcctggctgtgtggcgtggggtcttccagggtcctctctgtcctcccagctgcccacatattggtcagcacagggaacgcagcagctatctggcgaccgtaggtactcgtggtctctgcctaggccggtcctaggaaagggggatcttggtgctctgggtctctgacagggcaggctgggccgcaccgtggccctgggggtgtcctcagggctccattcagcacctccctgggccctgggctgggggtgcctcatcttggccaactcacctcggagctcccacctgccgagtttctgtctggggaaggggttctgcggggtccgtgagcatcagggacccctgggaagtgggcaggaggcagagcgatgctggccatcagtgccagtgtgaaaaggggggcagtgcagtgtggtctgggtcctggtctggcccccgtcctccttgaagcaggctgaaacctccctcctcggctgctcccttctcaggcagccaggtccgggcccagctggactgtgcctctgctctccgcagctcattcctcgtcctcctctctgtccctccacctcctgtctcctgtgagtgcctgccctgcctgtccccgcccgctcttgctgtcctggccttggctgtcctgtccggcggcttccctctgctttgcagctccatgttgtgtcgtgagccaggccatgctgccaccgctgccgttcagaacatgcgtggaggggtggcccatgaccgccgcctctgcttctccccagggccttcgtgtacctgagcaacctgctgtaccccgttcccctggtacaccgtgtggcaatcgtcagcgagaagggcgaggtgaagggcttcctccgcgtggccgtccaggccatctcaggtgcgtgtgggccaaaggccgtgtgtggcattggagcccctggggctggctctgacctttgcaggcagaggcgtgggcccaagaagggccttctggcatcatgtagtggttagtgggaagctggcctcagctggccctccactctccctggggtcaacctgaagctgtttttccacgctgtcctgggctggcgccccgggctgctgccccgcagtgggccctggaggggaagcccctgctgcccagctcttggctctggactccccagggtcagctggaggtgccttgggggctgtgcaggctgagcccagtgccatctgagcctgctctggttgggggtttccaccttcccatcaggcagtcccatatggacccaagaccacctggatccctcccccagcctgctgcagagcaagtgctctctgtcaacacattccacccacccggctgtctctgcagccccaggaaaggcgtgtgaggcccagtccctggcccctgggccctgctcagggcagccctccctggggtgcttctggttccctgatgcattccctggtctctcaggcacaggcctgtccccctccacactgggcctgaagacacaagcccctcccttgtgggaggtggagactggtgctgctcagcctgctccggatggccagaggcaccagggcagccccagagtgtctgagccttggtttgctcacatgtaaacgggatccgttgtaatgctccccacctgataggaatgttgaagggtacttgagaacacagatgtgagagcgcttggctgcctggaagctgcagggcaacaggcggcttgtgccgtgagggaaggtcccactcccttccctgcctgccccgggctcctccaccaaggtctcccctcaccaaggagcactctttttcctctcaaaggccttggctgcctgggcaccctagggagggagtagtacagacagacagacacacagacaggcagatggatgcagagaggacgtgcatccatggctgcaggggggctcctggctgccgggctggggctgcttagaggagcgacctggagcaggctgagatggccatacccctccccagatggcaagtcccccaactccgagatggctcatattctccaccctgagttacctcatatcccctgcaagatgcaagatgtctggttctcccggctctgctatcctggctgccttgggtgattttaatcccacctaattaatgaagttaatttgactctaatgttaaattctccttagcccataatttctttcttttctttttttttttttggacaaagtcttgctctgtcgccaggctggagtgcagtggctggatctcggctcactgtgcaacctctgcctcccagttcaagcgattctcctgcctcagcctgccgagtagagtagctgggactacaggggtgcgtcatcacgcccagctaatttttttatttttagtagagacggggtttcaccatgttggccaggctgctctcgaactcctgacctcaagtaatctgcccatctcggcctcccaaagtgctggaatttcaggcgtgagccaccacgcctggccagccaccctgcccagcctagcccataatttctaaatgctgtttatagcacctcccactggccatgtcattgcttgtcatccagtcactgtgataccacagtgctgagaatcagggggcccagctggggagtgagggtgaacaccagggaagggccccagccctgctgctggaaggtggggtgtttaccagggctgcaatactcagggaagctgggaacacctatcacctctgtctcccctccaggaggtgccacccccacctcaccaggtcctcccaatcctgccttgtgccagcagctcccaccaagtggtcaggatggctgagcggagccatcctgagcacttcctcccactggcccccaccctgacagccacttcctgagagtggggctgcaccagaggccgtggggccggcccatgtccttgtgagggcagctgccgtcctggtctgcccttggtcagaggagctctctggggtccacatggaggtttcccatttcccaggatccgagttcaagctcagtgcaaagctctacctttgtcctgcaccctatggggttgagaggtacccccacctctcagatgagtgtcgccagttaggaaggtgtacagcagctctgagcccaggtctgtgtgcccaggtccacagcccctgctatcccaggtcatatactgggaaaccagactgggatagtgcctaggaagtgctcctatcctgggctgcgtcgccaggcctcctgccggccatcctacaactggatcattttatgttgggtgatacctaattgtttccctgtctaatggctgtggtggtggagaagggaacttagaaaaggcaccggcccttgcactggtggtgtcagaagtctcatcagccctgcccgtgacccgggcgaggtcagtttgctgttccctcagcactgactcctgcatgagcaggcgctgactgtcacagaccatggcaggacagagctcagggctttaggcagcaggtccactgagagctttgaaggctggggagtgtgggcgcatgcaccggcaggcctggggagttgcgtggaggggcggttggtggcccttgaatgtctaggcaggtgacaggtggtagcttcacccagatggtggcagaggcactttgtgattctggaggtgggaccagcagggctggtggggtggtctctgcacatggggatggggaggggctacctgggttctgcctgagcacctgggaatgcgggcaagatttggttttgaaaatatagactttgtgactcctatcaaggtgggctgtgatgaggccgtggctgctttggggcccctgggcaggcgggtggtcagtgtgccgggacatgccctggttgtcactgagccacgggtggcagattcggtcaggggtctgctgcctgctctggctcctgtgccctcactttgactgcggggtggcccagcctggctctgcccacacccacctcaggggacaagctgggctccaaccatttgctctgtttctcctgcagccgatgaagaggcccctgattatggctctggcgtccgccagtcgggaactgctaaaatctcctttgatgaccagcattttgaaaaggtaccaagctccctcccgagtcccagacctggaggtgcctggcgctcactggagtcctgtgcactttgctcctctaacacccctgtgtcccatcccacgggccctgagtcctcttggggttcttccctctggtccagagcactgagcctgccccatctctaagcacactgcgccccttttcccgggtttgccctgacccctggatccgcccatctcccaccacggccgctccagggtccaagtcggggcgcagagcaggtggacaacacgagcctccagaacagacactgaggtgcagccacccccaccctgtctcccttctctggaccagctctcctctgggtccccacagtacggcgcgttcccactgcccccttcgcctgctccttcgcctgctcctgggctgcccccctgaggctgcctacctgcggtcctcatgtgaagggccggcgctgtgtccagtggcacctggaccactcagtctcctcttctgctcttgagagagtggtggaggaaggtccccaaagtgcaccccatgccacactcaggtggctcctgtccccaccttcttagactcgcttctcacccctgcccacctggccgtgccgtcacctggaacctgggtgccctactccctgagcgagggtggtctgtctgcccaatgccttttctcttggaggggctgtcagtattggggatgcccaagaaggggaggggagagagctaacctgctggacaaggggccctggcaggcgggggtccggctgaactgaagaccagagcagagaggcaggtggtgagttgtttccaggacagctcagaactcccatagccataggctgtagaatccaaagacacacatccacagcagggaaaactgagacctggggaggtggatgcccccctacaaggcaggcacaggtctggtgcgtgggttcatggaggccccagcccaggctctgggtggcacagccctcccgtgggcctgtggcagggtctacggtgcccctcctcggctggctcctggctctctctgactctggtccccctctgatcagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcaggtgggtcgcccaccccagctgcccagggcgtaggggatgctgagacctggttcctgagcccggcccaggcctgtggctggaagacaatatggcctggaggtccatgactctctccttgactcccagcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaagtgaggccctgctgcctttgtgtccctgcgctgcgcagggactctgtgcccaaggctcccgtgcctgggtgctgggcagggagcaggccatgttggtgctgtgttggcccagcccgcaggccctgaacgccccagcgccctcgtgtgaggtgggttccacctggtaaggtctcatcccaagtcccccaccccacaccaaagcatctcctctgctttgcagcttcatccaccgccacgacgaggccttctccacagagcccctgaagaacacaggcagaggccccccacttggcttctaccacgtccagaacgtacgttcctgggcacttctccccatccctgccactgactgaccctcccagggcctctctgagcatggctcattctccctcttctgaacaccagttgtgggccaggactgccttgtgcaccgggaactccagtgccaggcagggtgtaggagcgatttctgggcagtgggagacccttgatgggtttacagctggggcatgggggccgctcagagcccctgggagctgctcatagtgagcatagagccgatggggagccggatgcaggtgcagtggggcctgggatttgtactgagggccgggggtgctcagccagggcagccctggcttgggtgttgggaatgggaaggaggcagggccacaggggctacagggtgccggcaacgtcccgagaggtctggaaaactccaggcaggagagtgatggcagctgggctgctaggatgatggagaggaggggcctttaaggcggagcagctccttctccaggcgggagaactgggctcctggggcagcaggggaaagagtgcctaacggtgataaggaaagctaccagggagccaggccttgagtgccaggccacgggtgtggatttggcaggggtgataacctggagactcagtgggttagttggctgggacttctgtcacaaagcaccacaggtgggggcatctaaaaacaacagaaatgtggcctcccatggctctggaggctggaagcccgggatgagggtgtgggcaggattgcccccttcttaggcctctatccttggcttatagaacagccgcctcttccttgtgtctgttcacatggccctccccctctgcgtgtgcctgggcccaaacttccgcttttcatagggacagcagccatgttggattgggacctactctgatgacctctcgttaactccgttttctctgtaaaggccctatcccaggatatactctcattctgaagtcctggggttgggacttcaacatacgaatttggtgaggggacatggtccaacccataactcttgctgagtggggcaggacctaagaaggggagtcctgaagagaccagcgctgccctttgtcacctttcccagctccgtgttctgaaagggcagctgagccacgcggcccctgttcgtcctggagagagagcccgagggacacactccagagtctgtctggggcacgtggtgggaggaggggctgggctgaagggcctagaggaggctgctgcccctgggcagacgtgggcccagctaggggtcccagatctgggcctgaagcgcttagctcactgatgtgactctccttcccccttgaatgtgacctggccgtgccctcctgtcctcccacctgcctgcccaccagatcgcagtggaggtgaccaagtccttcattgagtacatcaagagccagcccattgttttcgaggtctttggccactaccagcagcacccgttcccgcccctctgcaaggacgtgctcaggttagcgccctgggtcggggggttcggggctgctgtcctcaaagcccctgcccagatcttttcatccagctgtcttgaggctgcagagcctatgcaccccctgaaacccacctcccctgcccatccaggaggccttttgcccagggctggcaggactcagagagcaattaagagctctgggcctgcctgcagcttctctccttcgggactgcagagagttccttgtgagcattgcttgacctcctgctggcctgggcagtgtgcaggggctgccagctgtaggatgctggggtggccccggggagaccacttctgctgcccaccgaggaccccaggaaaggggcccagctgtgccacaccctggggaagcccggcctagctccctcagtccacgcagcctcctgaggcctggaaaatgggggctcagagagacttgcggggctggggcatgaagtcaggacttccactcaggccatctcacccagacccttgaaggtggacaggagtgtctaccctgggccaagccgacccctcctgggcacctcgagtgcagagagaactgcagagaggcctcgggtgggccctttcttcccatctccatctcccctcagctgtcaggcaggactgggagctcaggggccctccagggtgtcagggaaagagaagggcaatgaaggctttgttctgggggtgcttgtctgtcctcgcgagtgcctgagggactctggactgggagccagagcttgacccttgccctggttccctgtggcctctggggtgggagctggggtcccaagggtccctcctcttcctcccacccaagctggtggacggtcttggagaagagagggtgggaggggccgggatgggcacctggggcctgtagcccttctgtctccttctgacccctcccgcccagggtcccgcaaacacctcacactggtcctttctccacagccccctgaggccctcgcgccgccacttccctcgggtcatgccactgtccaagccaggtaggaagggtctctggagccgtctcagggcagtgagctcccctcactgtgggtgctgtagtgggctgggcccccgcagtgaatgctgtcctctgtgactgggctgtgccctcccaggcactctggcgccaccctgagcctgtcaggcctcacggggtccccatggagcaagggtctgccctgtgcccagagagtagcctggagctggtggcagaggtgtggggagccaaggaaggaaggcagcaagagggtcgggggctttgaggggacttcaggcatctcagctgaacgcagagaggtggagatttggggatgaaaggcaatctaggacgctccttcacgggggtctgaggctggaggtgggagcgagagtgtggggtcagtcggggagaagtatttgtcagagcttttgcctggagcctggagcctctgcctgtgggaacaggtgggtcatggaatagcacttgagatccactggcttttagttaaaagagtggagtttatttcctgcaagaccaaaacccagggacatggtcgggggagagctgaagacagccagactgaggcccagcaggtgtggccgagtctctcatagcccagaaaccctcctgaaggagggagtgtggtcccgggcaccagcaccccagagggtaggggcctgtgtgagaagctgcttctgcagctggtgggtggaggcactgggtctgcacacatggtgaccaggtgtcagcctcttgtgcctgccttgcaaggaccctgtcctcggaacccctgtaagatgaaggtttgcgggctgaggacactgtgggaggacaccctccagctgctgcagagccagtccctggtctgtacaggctttgtggcccgcagtatgagttccctgagattcagtcctccccacagcctgcaagaaagacctgtagatccatatttgtaggagaggcagaggaggggacttgctagaagaggacctgtgtgatgggtctcagagaagggagtggtagacagaggtgggtgaaggatgtgaggacagaggctgtttgtcaggagctggacacgagtggagggtcagtgggagctgagggacaggtcctctcgggccaggcctgggtgctggtgaaatgtgcttggacaggtgtagtaggctgtggccaaggtgtggtgtaggcaatgggcctggcagcatggcagagcggccccgtgagggttgtggggcttttgaacaagggtatgtgcggctgccctgttggttcttggggtcttgaccactgtcctcctcatgagctgtgccgagtgtacatggccatgtgcctttcctagccggggcacagagaacgtgagcgtccatgtgacgtgctaaggccacagagtgcccaggacccggtgtatcttgggaatggctggggttggctggttgtttcccttgaggagggggaggtgcccttgctgcctctgagtccctttggccccggcatctcctccttgagtgtgcccttggcacgtgataggtcaggtctcccatccatgcatgcctccctcctgtccctacagtgcccgccaccaagctcagcacactgacgcggccctgtccgggaccctgccactgcaagtacgacctgctggtctacttcgagatctgtgagctggaggccaacggcgagtgagtgctggtgctggggcccccagggcgtgagtgtgtgtcggggggtgcgcggagagggacgaggacttgagctgcctgagggttgccagcatccagagtcgttcttccagcgggtgttcactgcagacctcttgtgggcccggcctcatctaggtcttggggagtaaaagcagacaaagtcctggaggagctggcatgaggggcagggaggtgctggacagataagcacctgaattagtgtccccatggtcctgagcactaggacagcaaaccagggtatggctcaggggcagggcagggaggcagacagcacttacaaagtgatcaagggacttttgagggaggtgggaggggagccctgaggccctggggaggcaggttccagggccccagggtggaggccagtgggggtctgcctggtgccctgggggcagctgggagctgggctgtggctggcagctcagagtggggcctggtggagactcggatccttgcccagagtgggacaggagccttagatgttggagaagacgagcccatctgctgggatttcctctggatcctctggccttgggttgcggatctgcagggcatgaggggaagcagaggacccttgggaacttacaaagatccagcccagaggggccaggctgtgccataccgtgtctccttgttggacaccctgccagtccagtgggcagggctgggaggtgatagccaaggaggcctggtgggtttctgtgctcagctgaccgtggtctccatggatcagaccacctgatcttcaccagagggagctgctgacttttccctgtttttgctcccgtccactgtgtcctgtgctgcggggagggcagagaggaggggctggccgctcctcacatgtgtctctctcttccagttacatcccggccgtggtggaccaccgtgggggcatgccatgcatggggaccttcctcctccaccaggtgtgagcccctcttgcccctaccctgcctgtgtcccctcccccaccccaccaggtgtgagcctctccctgcccctaccctgcctgtgtccccctccctcaccctacgtagccccctgagccgtctgaccatatcctctcacctggcaccggcagggcatccagcgacggattacggtgacactactgcatgagacaggcagccatatccgctggaaggaagtgcgcgagctggtcgtgggtgagtgcggtgtgggggctgccttggtgggtggggctgagctggtgggaagagtacaggccctgagctggatacccgggttctaaccacacctctgcgtctgttgctgcgtgaccctggccgggtcacataatctctctgtgactcacttcctcacctgaaaaggagagccttggacctgggtgacgatctgcaaatttctgtttaatcagtgtattggagttctggggctgccatgacaaaataccacaaaccaggtagcttaaaacagcagacatttatcatctcacacttctggaggccagaggtccaaaatcaaggtgccggcaagaggcgcgctctctctctctgaaacctgttggggaaaatccctccctgcctcttccagctcctggtggtggccagcatcttgggcgaccctggcctgcagacgcatcactgcattttcgcaggcttctcctgtcctgtgtcttcctgtggccctttctcctaaggacaccaggcaggttggattagaggcccatcctgctccagggttgactgcatctttactcagtttgatcacctctgcaaagccctacttccaaataaggtcccctttgaaggtcctggaggttaggacttccacgtatatttttcggggacacaattcctcccataaccatcaccaaggatcttacactcttttcttccatgacctcatgtttcgaattcgggtccgccaaatgtttcctttgctaaagcggaaagaatttgtcttctcagttttcattcaaggaggcagacagtcatccattcaagtgtgtcactagcatgaggccagcccagccctgccttgccccagacattgccatggccgggctgggtggctgctcaaggtcacttccctgaggctggacccgtcaccttgtgtcccagtgcaggactgtagacaggaggttccaggtacaccaggatacatgcttatgttttacaagttttgtgtctaatttcacatgaatcagaaagtcatggaacaagcacccaaaccctcctttcagaggttgtttagggcaagcctaagaagagtgaattgatttataggcagaacgtaagcaaatacacagctggtttatggacccggccacacggtagttgaggaacgatccctggggcagcactgccctcacattctgagccctggtctcacttccctcaaggcagacaggagagaaggaagaggggaagctggatctgcatggttgaaaggacgcatccttcgggcctgggtctgtcaccactcaggccccgcctgctcagatccaccttctccccaccttctttctaaaaaggccaacaggagtgtctgtttatgtggggttgggtgatcagggatgctatttaaagggatctggggagatatggtatgaaccccaatgctccccttcaggctaaggggtttgggctcagcctctctgggcttcgtgactgagcagccctgtgattggactcagggcacagagcagccaagtcactttctggggagcacctagcctctctcctgctcctcacctgggacccaatctcactgttcacagccttctccaagctcagcatccctcccaagagggccatgggactttccagccctgtgagttggacaggactgggcacagggtcagcgaaagggatgaaagtcgaggagagaccccgggtgtccatgagcagtgggtgggtgcaccctttgaggcaggggagggagtcaaagtgcagacaacagagggtcaggaccccagcccaacccctggcactctgtccagaccagcgggctcatgggtgtcagttttgtgggccaggtacttggtcagacgcagagcaggctaaacactgcttaagtgcaggccccgagggctgagagcagctgcgctcccctccccgagggctgagagtggctctgcccaggcagcgatctctgcagctgagcctcttccctgccatgggcactgcccagcatggacccagagggccctggcgtggggaagggcactttgctgggatccacctgcctcttcccaggacctaagtgctgcaaagtcatgggtcagagttccagcaatgggatggggcaggcccagtgtgcacccatcaacacaaaatcctagcgtgtcctgggttttatcttgtccatgcatggcggagagggaaggctgccgttccttcctggcgcaacagagaaaatgtacatgtgtttgtttactcctttgaatgagcagaactgtcactgtctggccaagaaattactaggtgaagccactagacagttttcctgcctgataacggctctggtttctttcacagagacagacagacacccccagtgcatgcaacttagcgggctctcctggaaatgccccttgtaagaagaggttttatggcacagaaagtgttctctcctatcccttcccatccctcccctcctctgctcttctttccctccctcccttcctccctccctccctccctccctttccttgttattatcatgactttttggtgtaagaagaagcaggaacattcctcctctgtgtcttgcttagccttccttttccagcagtcaggaaggccggtggtttccaggctaagcacctgcatttgtcagtgtgtgtatacgggggtgttcactgtggccgagagacagacaagaaagaccgtggagcagcaactacacatggcacctgggttgctgaggaccctgtagggcctccctgttccccctggcaccgcctttgacagacgctctagtgaccatgtggggagctggcttgctgacaggacccccacctgaggcagccccccagggtcccacctgccccctgggaagtgacctgtggcccgttgccttttctgcaggccgcatccgaaacactccagagaccgacgagtccctgatcgaccccaacatcttgtctctcaacatcctctcttccggatacatccacccagcccaagatgaccggtgagtcggagactccctggagacagggcccagggcatgttcccagcctgccaggccctcagccaacccggcacagggttcagccacacaaggtgacccgctcaacgctctcccggccctccctcctggcacctgcaggagctgtgcggtgaggggctggtggcctctgcacccccggctcctcgtttgtgcacctcgttgctggttcaggcatccccatgcccatttgtttatcaccaagcagaggggccagcgcaggggttggaagatgagctgagttctgtcctcgggagttttgtggttgcgtggtgtggggacaagtggctgtatgtccaaggaccatgctgctgtggatgagtcagtggcctctggcaggcatcctggggctagaggtggagcagctggggtgggcgcccataggcactgcttggcacaggcccctcatcaccaggctgctccttcctacactccttgcacggccaagaccccacagtctgggcggtcccagcccgaccgcatttaggctggggttttggcgctctgggatgtctgtggcagccctatcggggtctgctggggttaggggatgggagagggaggcagcccctgcggttggcctgggcaggtggctcagcactgccaggggcagccctggtgggtggggacgtcccgcgggctccactgcgtcccagacgctgccttccaggggcttggggaaagtgaggcgggggctccagtgtccagtcctggctgctccctgggggctcgacctggctcatgatgcacaagcccagagtggaccctcagagctgaagccgcaggtgtctccatggctgtgtttgtaggaaaacgtctttgagggcctccctgcaaggagggtcagggtcataaggaaggagggtcctggcgggcgtcgtctcctattcttctgacttgggtccacacaaagctttggtttcatcagcaacacccagaaagtgggctatcggggcttagcactgcagtaaggagggcactgcaggggcagccagggcagggggcagctggatagtcagggtgggcacagcgctgaacagtggggggtgggggttgggcacagacctgggcagggtggatgcagctctggtcccagccctgcctgtggccttccagagggaacttgccctgcactcatgtccataggagggtggagaatccggggggtgttctatgtggaggtggtgccatgaggggggagcacgtctgggagagggagaggtgaggcagaccaggtgggacgggccggggcttggggcttccccgtgccttgcttctcctgccgccatgagaatgctccctggtgaggtgtggagaaggcctggagcccccagcacgggcgctgcctgcagagtgtgggctgctgtgcctgggccatgggggaccaggaattggagtagggggtggggcccggaagggcgggtctgccatgtgagatgtgctttggagcctgggagatgacctcattaccttattttcctgacctctgacccccctcagcccaggcagctcctggggtggggtgggcaggggctccagccccccaaccccacctgctatctctctgcacagagggctgagtttctgaggtcttcctcagaagaccagctgccatgggtgacgtaggagggagcggctcatggctggacctcaggccaccctgttcctggatgcctgagaacctgtcactgaaggggctttggccccacaccctgagggctgagacatgaggccggtcccagggtgcctctggggttgaggcagccctgttctggggtcaaggccctgggtctgagaaaggaggaaggcgcgttgcgtgggcgcggcctccccgaagcggctttggccctcgcttggctcctgcccgtgctggcagctcccacccctagccctgccctggagcagtcttggggactgtcctctgctggcacccccaggcaggcaccgtcctgtggcttggctgaccaggccagtgggccttcctgtgccatggacggtgctggcgtcctcagccccatgatgggccgggctgctccaaggccgctctccctgacgtgcggaggctcaggatccccggcttctggctccagcctggggccttggccttccatgcgcttttccatggccttgcctcctgcccgctcccaggccccacgctttgcagcctccctggctcagagtgggcctgtggccacaggccgcttccctctgcctgtcccccgccccgctcccgctgcgctgcccggccctcactaaccgtgtgattgtttgtgttttgcaggcagtttcttgattcggacatacctaggtatcatctgtgacccttggtttacccttggtttcatttcagcctcttctttcctccctgctcctcccctgaccgccccccatgcccctgagaagttaacttccagcttcctggactcctcacacacgtgctcacctgtcctcctgttcctcccgtcttctttctttttattctcttggaatcttggtttgatttctttattgctttcccaccctgtcctcttggctgagtcccttcttcccccactcctgattttggctgctttgtagtttcctgctccctagtagacactggctggcctcctgctcctcctgccccagccttgcctgccccgcgccacaccctgccctgtggatgggctcggtgtcccgcacgctgctggctggcccgctgcccttggctgcaccaccctgtgaggaccagccccgctcccctctccctgcaaggggctgtagcaggcagagccatgagcacaggggttggggaagggcagacaggatccagcccaggagaccctcacactccggcacattccacagcctctcgtgagtccctcacctggccaggccaggaggagggacagcggctccagccacgctcctctggccgtggccaccgagcatccttttgtggaagtggcgggtggtgaattcatgaagagaccatagagtcccagactcaggttgtccagcaggaggctcccttttccccggctgcagtgaggcccctgcccgtgccagcctggggcagggagtcggcgagaccttggggatggagggcctccaagtccctaatccaggcactggtgagaactcgagtccgttccgaatggaaaatcaaggctgcctgctcctgggtccctgcatgactgtggccagcgtcacggcagttatcctgtggggtggcgtttgtgaagtgaactgagcagcagaaggcctttcagaccaatgatgggcctttaagccctgtagttgtgaggtgtgaggccgctcctggcacagagccccagggcagtggggcttggccagcactttctgaggccacatccttgtcaggtcgtgttgcgatgggtcaggacagatgattgacaactgtggcagagggactgtggccaggagaagactctgcccaggggtggccgggccagagtccccattggcatggtcccttgagcacgtgcacacacacctctttccatgaacagatcttttctgaaggctgccgcaccagccctccctggggacctggatgcagcagaaaccctgtcaagggacccctgtgatggtggctgggctgaggagggagcacggccctgcagggcctgagcaggggcctccctctccctgcagtgagtctggcgggcttgcaggaggaggagatggcatcgtgctagctggtcctggagtcagctggcctgcctctgggagtttccccatgctcggaaagatctgggtctggggagcccatcagcttgggctctaatttaggagctgttttctgggcattgctgtgccattggtggggccgcaacattcacccacgcactcattgatctttcacgtgtgactaagacactcatgtgagccacatcctgtgggattaaaggcaaaatcaggaaaagtctgtccaggtgggtcagagcctggccaggaagctcattcaccctctcatccccccctcattccccctcatccctccctcattccccctcatccctccctcatcccttcctcataccctcatctctccctcatccattcctcatctcttacccttccccatccccttatccctccctcatcccctctcttccccatccctccctcattccccctcatccctccctcatcccttcctcataccctcatccccttatccttttctcattccccctcatcgtctcgtccctccctcatcccctcatcccttatcccctcatcccttatccctccctcattcccccttatcccttcatccctccctcattttccctcatccctcatcccccctcatcccctcatttcaccctgtcgtccctcacccccgaactcctcatccccttattagctcctcccctcattccctcatctcctcatccctccctcattccctcatccatccctgatccctccctcatcccctcatagccccctcatcgcccatcccttcgtcattcgctcatcgcctcattttaccctatttcctcactcaattcctcctcctctcaccctttcctcccctcaccccctcatcccttacctcctcgtccctgcattccctaattccctcaccctctcctccccttacgccctaatcatgcctcccttcattccctccgcccctcttcccttcattttttcctcccctctctccctcactccttcaccccctcatttcctcatcccctcctcccctcattctctcctcccctgatccccttctcccttcatccctcctcccctcatgtttcatcccctcttcccctcatgcctcatcccctcctcccctcacgcctcatcccctccaccgctcattctctcctccctttatcctctcctcccctcctccccaatccctcatcccctcctcccctcccctcatccctcctcccctcattctctcctcccctcctcccctcttcctccttccctcctcccccatccctcatcccctcctcccctcattccctcctcccctcattccctcctcccatccccccctcctcccctcattggctcctctcctagtctcctcccctagtctcctcccctcctccccccatccctcatccctcctcccctcctcccctcctcccctcctcccctcctcccctcatcccttaccccccaatccccatagcagacactaaccaagcaggctgtgtcctggccctgtggcacagcagtgatggggactgctggccctggttctggagccagagtccagcgacagtgtcagccagggcgagggggactgtgggggtcttcccagtggggagggctcaccaggaaacagtgagcttgcctgagctgggggcacaaaaggagcccatgagcagaggtggaggggagagtggaaaaggcagctcccggtcagggccgagcccctgacctgcactgcctctgaggccagatctggtctaggattctcctcctctgaggacagcgacctccagggccacgctgtctggtggaggtggtggggagcagtgacatgctggttgtctcccagctggcacaacttcaggggtggcatgcggtcggggcaccagctctggctgtgtcagcggctgcagcccagcgctgctggtggagccagggccagagccgcatccgatgttgctcaaagtccgtgcattcctcaagcctgtggggacaggatgcagctgtctccagctgcgcccccaccccctccctgcctctgtttagtctgtgcctggcatctggcatacctggcatctggcatgcccaccatcctagcccctatgtctaagtccttggtgggctttgaaatccagctgcagtgggccctcctccaggcaccttcctgactccacccacctccttctcactagcctagctgtaaaatctctcctgtctctgtgtggatctactgcagatttgccctcaggccaggtttcgagctttaaagggcaacatcagccttcccagctgtacatttccccacaggacagagcccagggcagggctcagtcaggccgggagggagcctgcagctgccctcagggggcttggagggtggggccagtactgaccaggactcaggctggaggtggagaggctacagagcaggctcatgctgcggccctcaggggtgcctggcccagcctcctccagttggctgggccctgtgcgaatgctgcatccagctttcatcccagagacagatgggctgcctgtgttctctgctccattcttgggctgcttggtggatggtgccacatgactgtgttgtgtcatgtccagatcctgtgaaccgtatccctgaggtcggggttcaagcacaatcccctgctcttagctgtgtgttcacatcggatcaagtctcctgctgggatcatgttcccttcgggcgaggagggtcagccctggctgccatctgtggcctcagcctgttagatcgcctccctggagaacctgggcctccacatctgggttgcatgtttcctcttgtgatgattctgagggtttgggtgctgtcacgtgggatagagtgagggaggcttcaggggacagggcctggagcaacctcgtgcctgctcctggagtgggggtcctggagtggtctccaaggccctcccagcccacatcctccagtttttgccatggcagggtgatcttggccacctctcagcctccctgggtcttggtttcctgctgtatgatcacagggcacccatcagtggttcccatgctgtgccctgcaagcccggtgggccccaactggcaatgtgggtcccatgtgggtcctgtgtgggtgagctgctactctgccagcctgctcctccctgatccaccagctgttgtctcctctaatctcacttgggatctgggtaagacttgtcctccctttgtagaggcttgaggggcatagggggactaaggagtgttgccagggaccctcctggcccgagattccaaggtctgctgcccgtgaccaggtggagccaggcaggatgtgggccaagggctggttgcgaggcatttagggtacagctcccctgggcagagtgggaagcctctggggctgaccagcagtttggaaatgacccaggggcagcaccatggctgtgcccatgtcagaccctggtccggctagccatcttggcacctgggggaggggacagtggtctggaaagggcccatccctgctgtgcacacagtcctgtaaggctccctcccaccattctctccccagctcacaggtgagactccaccacagtcaggttctcagagagattctagtccactggggtctgagcagggcaaagccacatactacctgaactgagaaattctctgctaggacccccaagggggctgttgtgggcctcatgtggaagtgggttcatgttctacttacagctccaggcctggctccagcagagtccacttgctcctaaggagcagcccctggctgggccttggagtcctgcctgcctcactgggcttgttcctttgctgtgtcccactcaggggccaaggagccccaggatggggcagggacgtggttcctgatgaatgaggagtgcctgggctgggaggacctggtgctctctgaagggcacagagaagggagtaggtgctgatgctgggaaagacctgctggttctgatcctggggcccaggggtgaggggcaggtgggctgtgtctgcacacacggagatggaagagaaggaaggggaagagaagcaagctgaggccctttagggactttggaggcagaagacagagggtccagcacaggaccgaatgcttgggcccagcaggagagacagggctggtgggacctgcaggctgggtcttacccagtgcatagaagtaatgaggatgctagagtgtactagatagtgacgtgtgccagatagttacactgatgtgtaccagacagtgatgatgacatgtaccagacagcggtgctgacgtgtaccagacagcgatgctgacgtgttccagacagggatgctgacgtgtaccagatagtgatgctgatgtgtacaagctccaggctctgttctcatcgtgctctagtattagctcatttaatctgcaagacatcttgaggtaggggcaattactgccccatggtacttacaaggaaatggggcacagagctgttggtgacatcctgaggccacacagctgtgaagtggctctgtggcattccagcggtctgaggcacttgttccaggccaggctgcagtggctccagccctggcctgcaggcctgaccctccacaggatcctgcaatgttccaggagaggagcaaatccctccaggcctttgtcctggcttctgggcatccacctggcccagctgaggacagacgcaaggctctcactgcagaccccagggaagggggtgtctgcagggccagggccaggggctccacctggggcttgcaccccagccctgtgtgcagcgagagcctgggggccgtgagatccggcgtgcacctgccgaactcttaagttttctgccctgggccttgtgccggtgcttgttctgacatctccatttcttctgtatgtgtacgtgtgtgtcctggctgcctccacctttagcgtttcattgggaaatgacactaggtacagctcacttttctcttccgcccttgcttggtctgtcctcttctgctcttccgagttcctttctcctcggcgtctgcctgcttctatgccctttctctgaccacccgctgtcctcactctcccaggattgctcctcggtgacatgtgtccgacagcagccctccctggtccttctgcttccttccacacccccgacttgtgagatccatgccctgcgtcccagaccatgtgtgcagtagacagggcagcctggtgccacctgtgctccaccgcggtctcgggaggggcccggccgccttggagcctgcgtggccgcccagctgtgtgtgttgatgtctctgaactgtgtccttgcgaggatgcttggaggggagctgggtgaggctgggtggatggtggggtgggcgagctgaacgtgctgctcagggtctgcagagtagccacattctggagtcaggcaaattgtccacctcgggtatgaccagtcctccctgtgagcaccaggcctgaggaagtagctcagtcactgccatccagaaggctgaaaacaggaactctcacgtaacagaaaaccctgttccggagcagagggcacccaaggtgtttgcggaacgtggttcgaccccatggggatgtaaaatcccaggcccctggggctggccctgagccaccctgggacagggtttgtgggtggctggctcaggccgtgctcatcataactccagggtggagattaggaacacagcgaggccgccgctgtctcccgtgtgctaacagagacgcttttgcacacggccttgcagcagccaccctgcctccatgccaagcatcctccccccggggccttcctcttcccaatggaccaagggtgagtccattgtcagaggagatggaccatggaggtttttggcaaacccgggcaggtccccttcaggtccagggagagatggtggcgcctccttactcagactgaggctggggtgggcccgcgcaggctctgccctctccctccctgcctctgtccttcctctcctccctgcctgagtcctctcctcctgccctcccctctcccttccctgtgttccccacatcccagctccctgtcctgcctccctcctcccttccctctctgcccttcttgttctcattccctgccgcctcctctccttccagcctcagcgtgacagctggggcaccatttgtggtggagctgggaaaatgctgggctcaccctcatcggggcgtccaagagaccctactctctgggtcctgagtaaggagggacctgtccttcctggcaccgccgcccgggcttccagcctgtgcccccagccgctcccttgcggctgccccttgtctgtcgctctgtctgtctgcatgtccccggcctggctgaaagcagcccccacgccatcaacttctactttgtctctgcttcctttcaggaccttttaccaatttgaggctgcgtgggacagctccatgcacaactctctcctgctgaaccgggtcaccccttatcgagagaaaatctacatgacactctccgcttatatcgaggcaaggcacctatgccagggcactccaccaaaaccactcagcccctgaagcttgaggttcttgtaagctctggacaaccccatatgacccagacgacttctctagttctcaagtccctgggttaaatttgtgtgccttttaaaaaacaaaaacaaaaactggactgcaaggttgaatccataaatccataaatccatgtgctgttttttttttgtttttgagaccgagtctcactcttgtcgcccaggctggagtgcaatggcgcagtctcactgcaacctccgcttcccaggctcaagcgattctcctgcctcagcctcccaagtagctgggattacaggtgcctgccaccacgcccggctaatttttgaacttttagtagagatggggttttgccatgttggccaggctgttctcaaactcctggcctcaggtgatccacccacctcagcctcccaaagtgctgggattacaggtgtgagccaccgcacccatcctccatgtgcttttaatggcagttaactcactctaccatacttagtgtgtgggtgttgtccttgggatgcaagatggctgcagcaccaccagacattgtgtctgcattccgggcagcacaaaaacagaagtgttccatccccacagcacccccagagtctgcagtacataggccgtggccagacctgggctgtggcctcccttccaagtgcaagaggtgactggaagtgtgggcgtttcttgctggtcatagtagtgagggagagggagggtggggagcagtgggcaggggcatctgcaagcacatcccctctccttagttacagccgaattattccagcttcacatggggatggtgtgaccatctcaccagatggtggtgaggttgccgtgaggaggcgctggcagagctcttcccagcgagtgcttgggactcttcagccatgcacagcagctgcccccacttcaggaagacaaaggggccagctgttcagcagttagcgtgtcatccaccaggaagtcattttctgtggtgtttgggttaaaatgtgcacattcaaacaagacctggtttgatcctcacagacattccagggtcggggaggggtcaccccaattttatggtgaggcagctgaggcccgagcagtgagcctatgtctgggaccctcggggtccccacacatggagaccagtccctcaggcagcccaggggtggacagagctgtggctacctgtccccagtggggttttctcgagggcaggagcagagactttctcctgcctgcgtccaggccacacctgaggccctgggaaggccctggggctgcctgtcggtgctgggcattgtgcccccaggagaaggctggaagggcacctgggcactcggggtgtccttgtgcctgagtcctgctcccgcctatctcagatggagaactgcacccagccggctgttgtcaccaaggacttctgcatggtcttctattcccgtgatgccaagctgccagcctcgcgctccatccgcaacctctttggcagtgggagccttcgggcctcagagaggtaagctcccaggggtgaggaccacatggactcccaccctggtctcggtgcgggccaggcagggctctgcctggcagcggtccttgggccacccggcagctcaccctgtgcgaggcccagccacactcctggctggctccctgcgctcagtcccctcctgctcaccctagatgaagactctgtggaggccatggttcctgcaggggacactgacaccactatgagggacttgagggccagcctgcagcggatgggaggaggggcaggcccagggtgcccacctggggcctcctgtgggtgatcctggggccacaccgttcccccccccccccccccccgccggtgaccttcttccctgaggaccacggaacctgtgccatgggactgactgcccacaaggcactgaaggaggagctggataagtgggcggtggctggaagggggctctggacacagcttcccacaggacctgctgggtggctcttcttggaggctgtcagcaccttggggagccacacaccgaacaccaggaccagccgtgcttgcgtgctgaacacgctcctgattcttgggggtgggggagaatgagccggaatgtcagggccctgacagcagggctgccgaggctaccgggcacccgtggccaccttcagtgggtctccctgtggtctgccacatggacctggtgtccaggttcacactgggcacagctgggaggaaagagcttgggggtcaggatccagtgtccttgagggctggctgtggtcattctggaggtcactcagtaattgtgggatgccaccgacctgtctgtgggagggtggccgaggtgctctcagaatctgtccggggcacagtggggctgctctgtggggtatggggcctgaggggctctcgacgccgtggagggactggagatgccagatgctgtgctcatgttgcctgtaccccacttgggctgggacaaagtggaggctgctgtgggggcctggcctcacgtcacagccccatgggcacctgagcaagaccagccaatgcatcttttctctgggggccggagggagtctgggatgaggactctgaacaggggctgtagctcagggacctcaacaccccatcaccccagccaggctgactgtgcgtttgatagtggggcaagtcagcagccaggctggctgtgtgtccctgttgcggggcctggtgactgcatgtcactccttctactccccacagtaaccgtgtgactggtgtgtacgagctcagcctgtgccacgtggctgacgcgggcagcccaggtaggtatctgccctgctctcactgggtgggttcctggcctgctcaacctctgcccacttggggtgaccacagcgaagctgccatttgcagggggatccctcacagaacccaagcactcaccttgtggcttctggagttgttctgagatgggaggagagcgagggaggagagtcaggcctgctggcttccttgggttcccagggcacagccgagatggccatgggacgccgggctggataacttcctatggaagaggcctacatggctctttgggccccagggtggaccaaggaccaggggaagcccatctccactccagaggggagacagcttcacagatgggcggacctctaggatgggtgggaggagcaaccacccatcaggtaggggtggaatgtccacgtgccccatgcagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtgaggcagcctcagaggatgaggcccgcacggtggtgtccatgtggctttgtgtgcagagcaaaagctggagagggcccagggcctggtgcctactggggggcagcacagctgcttgggagtcacagccacctgcaggaggagcatgtgatgctccagtgtgcactgcggggctgcgtggtgtatgacagaaacatggccagtgtagcacagaggcatgctctggaattagccgaggaagactatcgggcatatagacagaggccagaaagggacccggaaggagagtcgcggggctgggctgccctctgcggctttgatcagggaaaccaacatgcagcatctaggcactgcctcgggccgagtgtgtgtgtgacacgtgacgcgtgacgtgtgagatgcgtgaggccagggctctgcccacccctcggccctctcctgaggcctccagcactgcaaggcagcacagccctgccccagaacctggcgcgtgagatggatgtgtctgagaggagcagcttgcttgctgcccatgaaggtggcagggctggggtgggggctgagggctgtcagccccggggcgccagggtctgttccctcatttcacagctgagggctgtcagtcttcagtcttagcccaggggagggtgggctctccggggtctgcccagagggtcatgctgctgctgaggctgagcacaactccggaggtcacccctgaggtgcagcaggtaaggccttgtgtcctgtctgaaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaaggtgggtccagctggtgggcagtacagccgtagccccaggccctcaagggccctgagtcatttctgggcaactccagcaacccggccttgcccatggctgctctggttagcaccaccaggagctaggagcttgaggggtccctagggtccccttgcccactgactgcaccccacctgcactgaaagttgggtgccttttgcagcctcccttcccaagcgatgaatcactctcttgaatacctgtgctgatggggagctcaccacttccacccacaagtggctcttttggcggctgaacgggcctctgggaaggcttcctgcgcctcctgcactggaggcagcacagcctctggccctcacaccaggccctcagccggtgcctgaccctgggagacttcctgggctcacccgatgacctgggcggggtggaggtgctgcccaccttgacccactgtgctctggcgtcggaacccacctgtgtctggggaggggtgggtagaagagcctgcaaggctgtctgagcagggtcccgggaggcctggcccctgaccacgcgtgtgctctgtccacagtgcttgcgcctgctcacgcacacattcaacagagagtacacacacagccacgtctgcgtcagtgccagcgagagcaaggtgggtgcagaggggctgcaccaggctgccccgcagggctcgggctcccataggcagtggtccctgaggaaaactcccattccaagtgggaaaaggcagttaagagtttcctaggaacacgtctcagtgcagagggacacctcatacctaagtggctggtttccctgggtcggcctggggtccatgggaggtggggatgtgagtgaggggccgggtgggtcctgtggccttggatgcacccatgcacttgcaggcttctgctgtcttcctggcccccaccctgtctggccatcaccctgtggcctctggcccagtcagtcaagctcccacttggctgtccctcctcctcctgggaccgaccccacccctgtagcctgggaaactgctgctgtgctgcattatgcgtggagctccagccctggcccatggccttccttgtccccatggcatcacccagcgccacctcacgctggcatgggcaggaggcggcagggcagagcttacccagcccactcctcgaggcattggcagggtggctgcctgggtcaggccagagcctgaagtgatgggaggggccggccaggggccacaggggctggagggggccgggggtcttgagctggccaactttgagccaaggctgctggtaggaggggtggggtgccctaagcagcaggtgtggggtaagcgcaggcacagggagcagctcccacagaggccggagaccccccttccctgtgtcccctgaaaaaggcctctcctccgcagctctccgagatgtctgtcaccctgctccgggacccgtcgatgtcccctctaggggtggccactctcaccccctcctccacttgcccctctctggttgaagggcggtacggtgccactgacctgaggtgagtgagctccaggctcccggagtggcttctggcaccacggctgacccatgaccatggccgtgactcgggcacagagagcacagaacagggggccccaatggccgagtgccttggggtggccacaggctgagggaagggcctggaggagtggagtccgcagccctctcagagggtgcctgtgccccgccagctccatcctagtgtgtgtgtgttctcttccctgaagaagaccagaaatgggtggaaaataagctaaagctcccctttcctgagacagtgcttataaaataatggaaaaagaaaaggttacgaaagagggcatgagagccgttagagtcagtattgtggaggggacacctggcccctgcaggtccgcatttggaagagacctcgtgtgaaccccttatgtacaattcataagcaggcagatgcttttcactcttgttttaagcgccttaagggttccagattttcatttaaataagaaagacggtggcatcagctggccttgtcttctgcaggcctccttgaccaccaggtcgagtcgcgtggggcctggcccatgtggggggcccatgcgggaggccatcggcaccctctgctccagtggctccttagaacctcgtgtcaccttcagtctagttgtggagatgaagagatgctggacttgctttcacagggtggaggtgggggcaggagagccactgggagaagggcgtggagtggggcacaggctccctggctgggccccgaggttcctgggggaccctgcccaccaagcccagcacttcctggaatcgggcacaagcttggctatcctggtggacgggccccgggagctcccactgtgggcacagctggagagaccctgcgaaggtgccctactgcaccttctgaggtgctctgaggagggtgaagcctgggggaagacggccccaggcccagggaggcctgcagtgggcagcacttccctctgcttcccaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcaggtgtgtggggcctccctggaaagcaccgccaccagctctgtgctgacaggggacaggcaggccaccctgctccccatactgggggcacagggaccctcatacttggggagacagacaggttgcctgatgcccatactggaggttcaggcaggctgcccctgacccacatggaggggcagctccatgctgggaggtcaggcagggccctgtgacccacatgcctaggctgggaaccagcacagagcacaggggagtgggtggggtcagagccaaggcccaggtggggaactcgtggtcactgggtacagtgtgacagccttcagcaactttagcttatttctttaagtttttccattttatggtggggaaactgaggcccagagctggcttggtggtctggtctccggcctgctgggttggggttctgccaggtgcccttcgatgcctcgacccactttctggctggggaggtggttggcactgctgcgtcccagctctgggtggtagatggtgagtgcccgagtcagtcgctgcccccaccgagggccccagcgagcagctctctctgccttcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaaggtgcggctgggcccggctcaggctcgggcaccaggaaccctagcagggcaggagctgagccaccatcctctgcagccctgcgtcagagcaggaggcccatctgctcaccccagactccgtcctgttccacggaggctgggctcagggactcagcctcagggatcctctgtccttgccccaggcctctctgcctgcccatgaggcgcatattcctggtgacagctagtggggatggactccggtcagggcaagcattagtattctcctgtgtgatggccacagccatgtcccctcctccggagtcacccaaggtgggtggcaccagccctgcaggaatgggcgagccacagggctcagaggagccctcctgcccccactctgcccagcccctccgtctggaatggccctggacaagttcaggagcctggactccttcaggctggctggaggagaagtttctctgagccatctggaggcggccccagtgtctacgagatggttttttgattccctgtggtgggagtgggtggtgtgaacccacatctgcaccagcagcccagccagggtcccagggagcaggggccatgaggggcagtcacgtcccgtggggaggcatagcagtggtgagggtgtcctgggaccaccggccgcagatgcgtccagaaggcagtcacagccctggctgggtcagccttcccctctttgtcccctccgtgtcccctccctgggactttcctggcagtgcccctcccctgcctgcctgggccctggggagcaggagggtggtgtgctgaccacggagcctggcacctcctcaccagctgcctccctctgcagacacccaacacattcgcggtgtgcacggaacaccgcggcatcctgctgcaggccgccagcgacaaggacatgcatgactggctgtacgccttcaaccccctcctggccgggaccatacggtagggccgcctgcagggcgaggttgctgccatgggggtcctgccctcaaccggctcctggccaggaccatttgatagggccctgctgcaggacaagactgctctcccaggggtcctgccctcaatcccctcctggcggggaccattcagtagggccagccgcagggtgcggttgctctgccaggggtcctgcccgcaaggctgcctggggaagcagtgcggccagtggaaggcagcgcggcctgccctcacttatgtgggctggggatgcccttagggctattaatgctccctctgagttgtggcttcttgtggagtgataaatcccaggccatactttcaaaattacatcctaacccggtggcctcggcatggggaaaccgtgtgcccttgggcaggctgcggaaggagctggtccctcccacagcagggatgtgaaaagcggggtgcaggaggggatgggcgggctgagtcctacacaccagaagcagagattcagtcccttccccaggtggtgagggaaccagcggggacatggggtctgtggctgcccctcacggctgcctgcctgtgcagggcacggtggatatggcctgcaggtgttcctggcctgaccacgccgcctctcccaactcttctgcaggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtggggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcccgtcccgatgtcttacacccgagtgttagccctaggctcctgtactgtgcgtgcacttgaggctctgtccaattaagaaataaatgtggctcttactcaacacagtcccatgggctctgctgtggctttatttgcgtgttacgtgtgttgcagggccccggaaaatggctg

SEQ ID NO: 12346 - DNA, 89843 bp, Human
  misc_feature (1)...(89843): n = A,T,C or G
gctgcagtgagctgtgattgtgccactatacgccagcctgggtaatggagccagagcctgtctcaaaaaagaaaaagaagaaaaggttttctgaagtttatgttaagtgtttgtacatgtgggaaaacagggaagaacagatcatctggggttttggacttttgaagatgggatgtttgaaagctcttttggttatgttattcgctattttttaaactttagatttagcctgaagcctaaaacttttagccaaggaaacaatgttttagtaaatggtgctgtaataaacaatagttggtaagtagtttacatgttaattttataatgatacattggaaatatctggcagaattagaatcaggctgtgtgtgtgtgtgtgtgtctgtgtgtgtgtgtgtgtgtgtgtgtgtgtaatcaggctggtctcgaactcctgacctcaagtgatccacccacctcagcctcccaaagtgctgggattacaggcatgagccactgcacctggccaggccatatatttttgaaacagacactttgatggactgtttttacttttatggggataaattcatttgaactttgtttaatacagtgattgcctgctctctctcccacacccttagggaagaatggtgtagttggcaaagaatggctttggaggaaaatctctttatgccatttctaaaatggaaatagtgcatttcttttcttgattagtaaaagggaaattaaagattatgagcatctcagaagaacactgaacaccaactctttatttttgccttccctcatttctctgagcgacagcctgagagttttatagtcatatgaggactctgaaaaatgttagagacctggctaagttgtaggtaactagtgcattgagaagactgaaaggctcctgaatgcagacaaagcattactaattgcattcagggtcaggctgtctttagccggaccatgaaagatacagcagcctgtctgctgagcggagactcttgtctttaagaaagactgctacctgatatgctagaccgtttcaggttgccctagtttacatgaatttagtcattatcgccaagactgctaaacctcagtgtgatacttctaaatggacttgaagacaaggtatttgaccttgcaatggggcataggcaacgttcatacagtttttaaaacacgaaacagaatactttgctatttgaagtttccgttaaaagattgaatgatttttaagatcgcaaagtaaacagcagacatacctttagaaatttttttatgacttgaacccaggaggcggaagttgcagtgatccgagatggcactactgcactccagcctgggcgacagagcaagaccttgtctcaaaaataataataataataatttaagctttaatagttctatcttttagatttatgaatgcttgccccttaaagggtaaggtgttaatagcagtactaatatacggtagtttagacctattccacaggcatagaccaaccagtgcaattaattcttcaacctcacaagtcctaatgttctaggtagaagtgtggctgaaattaaaactggttattagactttgtaatacaaaagtagaaaaaagtgatattagctaggtggtccaatatatttttgtctaagtaggaatctgaatattgtagaattgtacatttcggtgctgcttctagctattcctgttcttttttttttttcaaattgagatgagtttttttttttccatcaaagcttaagataacataggaattttatatggaagtactgttcccacagaactaactttacaaatgtaaagcttgggcagaggttgaggaaaatggtaaagtgatagatttcgtaaaaactgtagaaattttcattgactttactttgaaaatgtatagttgtacatgcgaaacgcttctagtattgcttctagatgtattattctgacaaagttccctaagtcttaaataagttctttttttttctaaacagacttatgaaaatatgcatcagtttaatactgtcttggaattcatgagatggaagcataggtcaaagctgtttggagaaaatcagaagtacagttttatctagccacatcttggaggtaaggaaaagaacataatttagaataatatgaaatttctcattttttaatagttgaaaataatccttctacactgcaactttatttgagccttcttcagtttctttgtaacaccacaactttatagtagcttctttagtttccttaatcatcttcctgacgagttcataagtaattctaatatatattcctcataaatgttgaacctcttcaggagtgaaaggtatttatttcttactaatcactttcataaatctccttttagaagataagcattaaatggtttatatgtttatttcttccccctaagtttgcaaagcagagttcagcatgcaagattaggccaggtgtgcctgtaatcccagcactttgggaggctgaggcaggtgggtcacatgaggccaggagttcgagaccagcctggccaacatggcgaaatctcgtctctactaaaaatgcagaaattagctgagcatgatggcctaagcctgtgatcccagccacctgggaggctgaggcatgagaattgcttgaacccagaatgcagaggttgtagtgagctgagatcatgccgctgtactccattctgggcaacagagtgagactctgtctcaaaaaaaaaaaaaaaaaaaaagattatattgaaaaatgaatgtttatgttattctgaaatttttacgctttttagaattcagaattttttttttttttaagacaggatcttgctttgtcacccaggctggactgcagtgagcatagtttcaactccctgggctcaagcgatccttctgcctcagtctcccacatagctgggactacaggcacacatcaccatgcccagctaatttattttttgtagaaacagggtctcattatccctctgagttgctcaggctggtcttgaacccctggactcaagtgatcctcccacctcaacctcccaaagtgctgggattacaggcatgagctaccagacccagcccaggataagattttttaacatgttagaataatagatctttggaaatagaatttaaagaggtaggagctgccatcatgccagaaataggaggaaagaagccatcctaagacagtatgtacaggaaaatcaggcttactgttttaaaatccatttagagactaatgatcaggtaaaaggtttgaattatgtggggaatctacattttaagaaatagatagaatgtatggttttatgaagtggtctacgcttacacttctggaagtggcaggctttgcttgctgctactgttaatacttgcagcattcactcgcccttctcctgcccctgccaaaccgctggattagatcttctaaaaaataacgtaactctcgaattcttttgttaggtttcatattgtttgattggtagagttgtgatcgtttttttctttctcagttcttttggtttctatgattgtgtgctcttctgattctacttatttaattactccttgaccttttttccttcccctcctactcttaaataataatgaccttccccaaggttttatcttagaaattatcctgtttttttcttatgtctttcctagtctcatgatttccgcaattatctctaaaatgatctctctcaacttcctatctcagttgtggcattttctctaagcttcaggcccatattttcatctgtttacagatggctcagcttagtgcctcagacttcccattatctagcacatcattcatcatgagctctgcacccgctatttctccttctgttaatggacctctttgtcacccaggctcagagtctcagtgctgtttcggattcctcatcatttgcttcctacccttaggcacaagtgaagtcctgtcagttttacctctctaatgtatcacaaatgtttgaatcctctctttccgaatcccccttcaccatccaagtttaggtctttatgttacatctcactgaaaatattgcagggatctcccagcttgtgctgcttctcgctcctacttcattttacatgttgctgccagcttaaattatcttaagagataattttgcttgtattgtcggtgacactttgcctgtctgccagagtaaggacagattcctctaattttaaagatagtgtagctttgccttcatctgtccatttctttcaccctttaaacatttattaaacacctactgtatgccaggcactgtgttaggtcagaatgcaaaacattaaataaaaacaggttcctagctatactcaaaaaatagtctttctagggttggatgagcatgaaaacaattattgaagtgcaatctgagaagtgctatattataattgaaaagatatatttgattattccacactgtgtacatagatgataactataacatcactgatatgcccataattacatacagctataattttcaaaagaatttgaaaatacaggtgaccatgtcagaaaacaaaggtgtattggcatcacctggaaagactacaccaatgttatgagaggagagaattgtcaggcaggcttcacagaagagataatatttgagcagagtcttgatggatgaatagaagattgctgaatagaaattggaaagtgtaatactgtaaaatacatatgtgtttttgatgccatttcctggcattcaactcttaaaatccttgaaacctctgaagtgatgtctttttgtatgctaatgagttaactggtagatgacagccccctaggtagctttaggatgggggctggtcagcagaaagactaaggcaggattagagtcagaactttcagttcccgcccccaccaacccccaacatttagggaggggagaagggcgaaggttaagttgatcaccagtgacccgtggtttaattagttgtgcctacagaatgaacgttccataaaaatccaaaagaactgggttcagagagcttctggatagctgaacatgtgcaggctctggtgccctgtacatctctttatctgtcctttgtaacatcccctataataaacctgtaaacataaatgtttccttgaattctgtcagccgctctaagcaaactaatagaacctgaaaaaggggttgtgggtacctggatttatggctggttggtcagaagcacaggtaaaataacctgggcttgccattggcattggaagtgggggccgtcttgaggatggatccctcaacctgtgggatctgatgctgtctccaggtgggtagtgtcggaatttaattggaggttccagctggtgtctgatgcagaattgtctgcttgcttgttgatggggagaaaccctcacacatttggtaagaaaagtcttccctgttgattgttttggtgagagggcagaggaaaaatagtttgagtgttttccatactcacagaaggcaagggaattaatttcatgcagagcccagagcggggtggaggcagagcttgaaagtgtatagaatgtacagaagatagaataatttttgtatggcttgaatttagaataggagagagagtttgagggacaaggctggaaaggaccttatgaagaattttgaatgccatggcaaggagtctagactttattttgtgaaaaatgggcagtcattgaaaaattttaacatttaaagatattttggatcgtaattttttgttaaaattaatatgatggttgtgttagtcagttttcatgctgctgacaaagacatacccaagactgggcaatttgtaaaggaaagaggtttaatggactcatagttccatgtggctagagaggccttacaatcatggcagaaggtgaaaggcacatcttaggtggcagcaggcagagagaatgagagccaagtgaaaggggaaacctcttacaaaatcatcagatcttgtgagacgtattcactaccaagagaacagtataggggaaactgcccccatgattcaattatttcccactgggtccctcccacaacatgggggaattatgggagctacaattcaagaggagatttgggtggggacacagccaaaccatatcgttggtgatatgaatggtagtttggaaaaaggaaaaactaaaactagagagacaagttaggctattcttaactgtttcaagcaagaaataatgaagctgtcaacttaagatggaggtcaacttacccgtttaagcattggttgtttagaaaatgtttaattttcttctattcccctatgtactatactcttcagctggtgatttgaaatcgtccttccttttctctactctcttctcttggcatatttttggccctttctctcttgtggagtgcctgtgaactttaaaaaccccatctcaaatgccaattcatccctaaagttctttctaatctgtattgctttgactctaaatatatgtcttttcctagtctaaagcccccaaagcacttatttttattctacaggatattacttttttggtccctattaaactatgtggcagcaagtcacaaaggaggaatcagaaagtaacctgctccccacccttggtgtgtagtccagttagcaaggtatgtatataagtaatataagtaatgataaccaacattgccatgcaaaagtgaggaatgccacaggagtaaattgttgcttctagtcagagtcctgtaactgagaagcacaggtagaacataggaggttatgtgagctgagctttgaaagatgagtaaaatttagatgggtaaaggatatttctggaaaagtgcatggatagaaaatgaatgtttttgtaggaatgtggtgaaggtcttagaaagggcaggaagtatgatgtgaagaaagctcttttagtgaaattactctagcagtgacatataaactatacatcattagagaaatgaagtgaggaggtagggagccgagtgaggagattgtggcactagttaggcataagctgatcagaattcaatcagggtggtgattgtggaaatagaaaagaaagactcaatgataaaggtattgcggcagaagaagggacaccgatgtgtgactagatgttggaaagagatgatgccgcctgaattttgagcctggatggtggggataatgttggcctcattagtagccaaggtaagttggatcctacttttctaaatgtagagaaacattaaaatttatgttttactgtactgttggtctcttaatttgtttatgtgcaacaagtttttttggcattatttttccagccttaacatattcaaagggagattttatgaaaaaagcaaagtatgacctcttttacaaaagcagtttttaaggaaataaactgtattctgttcatagttacctcttttgctatcatgttaaatgctatgtaagatttagtaaaacttaagaatgtttaaagtatttctacaggtataattcagacaccattaccaaaggatggtatcttgttttaatagaattaccgcttaaggaatggggacctgtgaaaaattcattcagtagaattcgatggttccatattaacagataggcattattatggtactgtccattagagaaatattgtacagtaaggcagtaagttaattatataaaactggcttttaaaatgcatttattaaaattcttatcaactgttaactgatgactgatttagaactttgcaatatttagaaacagtctaatactctctgttgaaaataatcactaattgttttataattataattatacatgtgtaaaactggaagacattacattattgaggaaggaaggcatttgtgttttgtttgttttttaagtcaggctttgtgttgaactattattttttatttatttatttatttagatggagtttcactcttgttgcccaggctggagtgcaatggcacaatcttggctcactgcaacttctgtctcctgggttcaagtggttctcctgcctcagcctcccgagaggctgggattacaggcacccgccaccacgctcagctaattttgtatttttagtagagatgaggtttcgccatgttggccaggctggtcttgaacacctgacctcaggtgatctgcccacctcagcctcccaaagtgagccactgtgcccagtgcagcatactctgtttacaagcacaagcagtgtagccagaggacttcagtttgaatcttgactttaccacttagtttgtgttcccttgaaagaagagcctgagaaaaagacttactggctgataggttatttgggagatgaaccaaaaagcagaagtgagagaatgggaaaagtgagacagagaagggagtgaagtttcattaagtgggtgatccagttccccctgcgggcagctgggcttcagccctgtgggtgtcttctgaatgtacctcactgttgtcccaccaaaggacagggagcctgagacatgcatgcaccaactttcacctgttgttaattgaaggttgctccgtgagctttaactccggcaggtctgtgcttgtgcctccatgctgttgagcagtctcccttaggtttgcaaagtctccgaggaacaaaacagagcagtgcctccactcccacttgagtcaggtgctgtgcatgccacatagacctgcccaccagagccacagtgcggagaggggtgagctgcagagcaccacgaaggtctgctgtggtctgccccttttaccagtgagactccctcatgccccattagatctactctgtcactgaccctgcagattggtggctgattatgatcactaaaagaaatatctaacaggtgcagtggctcacgcctgtaatcccagcactttgggaggctgaggcgagtggatcatgaggtcaggagatcgagaccatcctggctaacatggtgaaaccccgtctctactaaaaatacaaaaaattagccgggtgtgatggcgggcgcctgtagtcccagctactcgggaggctgaggcaggagaatggcgtggactcgggaggtggagcttgcagtgagccaagatcgtgccactgcactccagcctgggtgacagagcgagactccgtctcaaaaaaaaaaaaattatatatatatagatatatgtatatatctctgaaacaagagggttaaaatccctaccactgcagctggtcctgagctcttatttccatccttgacattcatatgagaatgctctaagagccctcagttgtgctggcagtagggtgttctctgggtagggaaggcaagcccgcatctggagtgttggttctgcaccctccttgttagctggcatttggcagtggcagtagttaggtcacccttcataagaaggagcccatgctgttgggcctatgtagagccttcctctctgtcactccacaggctccattgacgggcctggtactccagccttgggaagaagctggctgacagcactgacaagccatcctgtctgtccttggggtgtagttgaatgcctcttctgtgggaggtgccttgtgttgggcattcacataagataaagattggcactttgtgttccctgccttagggccgtcagcgtgcctcttctccaggcttctggtctcttatttcctttttggacccttttaatacaaaaattagccgggcatggtggtacatgcctgtaatcccagctactcgggaggctgaggcaggagaatggcatgaaccctggaggtggaggttgcagtgagccaagattgcgccactgcacttcagcctgggcgacgaagcaagactctgtcccccgccgcccacacacacacaaaaaaaattaaccacacacccacttgcttctgtagagaaacctagaactcctggtctcagaaatgtcatccaggtctcgctttcaggctttttgattattctgcaactccagaaaaagaggctgtttagtcccactctcttccattcagactgtctcctcttaagttttaaagatactattattttttcttaatttaagcttagcggatttacttctggttttgatccctctccagtttgggtgctttaattttatttatttatttatttagaggtggagtctcgctctgctctctgctaatttttgtatttttagtagagatggggtttcacaatgttggccaggctggtcttgaattcctgacctcaagtgatctacccaccttgtcctcccaaagtgctgggattacagacgtgagcccctgcgcctggcccatttggggtacttttagatgcagacggtggtttgggaacttgcagctccatatggtatagtggggagagcatgccacaaggttttcaggtaatatgaggttttctcctcatattctcttactacacttcaattcctaactttatcttccagcctaataatttctctcttgcactactgtcttatggtttcaactgtgaaaggtaatttccagtctcggtgtcacagatactccagtttaacctctgattatatcttatgtattctttcttccttccttttgtttctcccttccctgctctgtcttttatagggcaggggttagggaacgtctcattgccccttttgtttttctttttcctcattgcctctttttaaaatgatcttttttttatttttaaaagattatatattggccaggcacggtggctcatgcctgtaatgccaacactctgggaggccaaggtgggaggattgcttgaggccaggagttcgagaccccatctctatttaaaaatacacacacacgtgtgtatgtgtgtgtataaagattatgtaagcagcctattaataagttcctatataaaattttaaacactatgcaccaaagccttttagtccctcttccccacccttcaccccattgccctcctcaccaccctccttgccctccatcccactgccatcttggggacctctgtttcttaggttattggtctgtttgtgtattccattccctgttgagttaatttttgtattaatatctttatagaaaatgatacttttttttttttttgagatagagtctccatctgtcgcccaagttggagtacagtggtgccatcttggctcactgcacccttcgccccccgggttcaagcaattctcctgcctcagcctcccaagtagctgggactacaggcgcctgccaccacacctggctaaagttttgtagttttagtagagatggggcttcatcatgttggtcaggctggtcttgaactcccgacctcaaggccgaactgccttggcctcccaaagtgctgggattacaggcgtgagccaccacgcctggtccatacagttattcttgattttcagatttattcttataaaattatgcctaatgagaatatccctctcataaagttagtgtgaagattaaggaatttaacatatgaagtatgtagaacagtgcctggcctatagagctctaagtgttaactattatttaatattattatgcttgaatatttataattatttttggtaggcctccttgtacttcgtattatttatttgttctttatttttgtgcttagacttcctagggatattgaactttctagataatttcatgggtcttttcaaagagccagcattttggttttataaattaactccacttttttgttatatatttaataatttttgcttttaacatactaccttttcttcctgcctttggtacccattcttccatctcggttacacataatattcttctatttttaaacatttttctgttgtttctgaggatttaggagcagtaggaacacatttgtttattctcccagccttagttagagctgcttgtatattttcaaaagcttcttgcacctctgtctcctgatggtctgtaatttttccagcaacccaggatttaaatctgggaaccacctatgacaactgcatctctgctttctatcagatctagaagttgctaaattttatcagcgccccctctataatagttttcttccacttccctattctcattgcctcttggttgggatggttacttcttgtgtgaactactgtaattaccctttggcttatctacctcaccctgtccctttcatcccatgtaatgcttcaagagtgatttttctaaaccatggtgcactcacttctttgctctgaaacctccagtgatttctccttgtctgctgagtaaagttcaggctactttacactagcatttgagaatcttatgaattaattcctgcctacacttaatcattctttattcctttgttctttaggaaaaatcgtaattggtaagataaaccaaatataaaactatatagtaatgctgtttttcagtcttactgatctcactctattccttatctttaccatgcttttctgactttgtgcttttgcctctggatttcccagtctggaatgcctctctcacatcctagtatgttgaaatctgtccattattcaagtgtgagcttagatgccaacactttgatgaaggcttatctgatcccattgcctagaattaatcttctcttcccatgtctttggatttgaactgcagcttctgtgctctgttactagtcattccattttcgatagtctaccagtaacttctgtgccttagatccacatttacactggcttgtcaggattggtcagtgaatcaaataggtagtaagtataagcttctagaactacactctccgatatggttgtcattagccacttgtattttgactactgagtagccacatatggttagtggctactttattgagtaacatagagactttcatgattgcagaaagttattttgagcagtatctagaacaatgcctggcaaataatagacaccagggaatgttgttcctaggtatcacatcctcatagtagacactcagtaaatattagtttaactttcctttcctcatctgaattttattagcgtttacctgtgccatttaaaaagtaacagtttatggcagctaacacagtgtatgaacaataaatatattttgggtgagtaagtaaatactacgaagcatccagaaagcatcttgctctcttttggggtggggagagtaggggagtggaagttaaaaaaaattcactactcaggccgggtgcagtggctcatgcctgtaatcccagcactttggaaggccgaggtgggtggatcacttgaggtcaggagtttgagaccagcctggccaatatggtgaaaccccatctctactaaaaatacaaaaattagccaggcatggtggtgcatgccagtaattccagctccttgggaggctgaggcaggagaatggcttgaacctgggaagcggaggttgcagtgagctgagatagcgccaccgcactccagcctgggtgacagagcggactccatttcaaaaaaaaaaaaacagttcattgctcaataagtgaatatttccaggatgcttaaattaaacagggtagactaagcagctaaataaaggtggtcttatctactgcttttcaaatttagtgtacgcgcatgtcacctgggggtcttgttagaagattctaattcagcacggtctgggattctgcatttctagccagcttgcaagctagccagctctgcccagtgagggtgtaattcactagattggctacttaaacccattttaacatttcctagtctttagaactagtcctttaatttagctcaaagttttgttgttgttgttgttgttttgagacagggtcttgctctgttgcccaggctggagtgcagtggcatgatcatgactcaccacagccttgaactcctgggctcaagtgatcctcctgcctcagcctcctaaagtgctgagatggattacaggcatgagccaccacacctggcctaaagttctcctttttgaggtgataatttttaaagacagcccttatatgttcaggaaatataagcctgtttttacataaagtaggtgcattgttcagtaccaatatgagaaagaattatgaatacagctttatattattagatttcttatgtcataatataaaaaaccggtaaacttagcgctgaactattcatgatagttgaaagttttaagctaattcaaaatatgaaataaaccagaaatattttggaaagaagaggttttaagtatattcaggtcctccattttatgatgtgagtctaaatttctgttctctgatgtctagaaatcacaaaaggatggtgattttgggaacgaagttcttgagctagcactgtcagtagtaactggccgttactgtaagatctagagatatatttttagatgccattatacttacaaagaactgttagagtgcattttatggttttatggttggtttaattccccaaatatattgcccttagcaagttattactattttttatttcttaaatttatttattgaacatttttattcctttgtttagaaatgtgctagacagtggcaattacattgctgcaagataagtaaaaaaatcagctgactaagctttataagaggaggaatcatgtctcttttatttaccgttggatagtcactacatggcacataaccaagtcatcattaagtcatttttgagtgaacattgctcaagatctgcaaagcagctgtgatgtgtgcggggtgtactggaagttgaacgggactcctcaagcagcctaatgagttgggattgaggattgcatacacaagggaactcgcagatcaagtcctgaagagaacattgtagttactctggcaaagaacaacgaagacacaaaagctgtgcagagtaatggaagcctggaaggagtgcctgtgaagggagagcggctgcactgactttggtagagttggagcatcgtaagggtatggaggagaggggaggagagtagtagaggtctcagcagttgtcagatgacaaaaagtcttgcgttactaattttatcgtatgaaatgaggatattttttaggtttttaagcagagagaatggcaaggtcatttggttttagaagttagtccgagctaggcatggtgacagatgcctgtactggacaagctgaggcaggaggatggcttgagcccaggagctggaagctgcagtgagcagtgatcacatcactgcagtccagcctgggcaacagagcaagaccttgcctttaaaaaagaaaagtctgaaatacccctcacaactgttaaaaaaaaaaaaaagttctttcaagcacacgtggagtgttttatgaaagtgaccatttactaggctatacagcaagttcttatacatttcaaataaaatcaaccatgttttctggcgagaaagcatgtaggaagtgaataacaaactgtacacattgggaaatttaaaaacacacttctgtaaatcccacagattaaatataaaataatcaatttagtgaacacctagaacaaaacaatagagaaaataacagcctgagcaaaatagtgagaccctgcgtctacaaaaaaaaataaaaattagcccggcacagtggtgtccccctgtagcccctactcagaaagctgagatgggaggattacttgagcctgcaaagttgagtctgcagtgagccatgataacaccattacactctagcctggactacagagcgcaagaccttatttcaaagaaaaagaaacttaggacatattaaaacgtgtgtgaaaccctgaagccttaaatattcatatttgaaaagaagattttaatactaataagctaatctaagttagggaaagagcatggcagtaaattcaagtgaagtaaaatagagaatacagataaaagctaacaattctagagttcttactctattccaagcaccgttccatgttctttacaaaggttatctcatttaatcttcacaaagccatatgaggagggtattgttattatgtgcactttacacaagaggaaacttaggcacagagagaaacttatccaagcctctagctaataaatgtgatagaattggggcttgaaatgatgaattttttaaaaaaagatacattgaagaggattaacagagctgaaagttgttttttatgaaaggctaataaactatttgaaagattgatcaagaaaaaatataaagtacaaataatactgaggatataaaaggaagatacagaagaaagtcttaaaaataaaatatcttgaatcactttataccaataaattttacaatttaaacgtcaattttctagaaaattataacaatgaaaattgacacagagtaaatagaaaacctggatatttctgtaactattagagaaattggatttgtaattaaaagaaccacccactttcatatattcagagataagcctttggcccagatgatctttttttctaagaaaaaaaaaaacaggcctcttcagagacttcatttattatatgaagaattagtggaaactttgtcccaccattttaggctatttttacattagaaaaaatactgcacatttatgaaaatttactaggggcaaatttcaacttatctgtaaaatagtaatgccaactgtggagatggcactgtaaaccaaaaggcacaatgactaaagaaactactgaaaatttaacaattatctcttcattatccttccttattggggaacctgccccgatagtcatgtaggttcttttctattttccgtaagtgttggctggttagagaaataaagggacagagtacaaaagagagaaattttaaagctgggcgtccgggggagacatcacatgtcggtagattccgtgatgccccacaagccgtgaaaccagcaattttttattagtgattttcaaaaggggagggagtgtgcaaataggtgtgggtcacagagatcacgtgcttcacaaggtaatagaatatcacaaggcaaatggaggcagggcgagatcacaggaccacaggacggggcgaaattaaaattgctaatgaagtttcgggcaccattgtcattgataacatcttatcaggagacagggtttgagagcaaccagtctgaccaaaatttattaggcgggaatttccttgtcctaataagcctgggagcgctatgggagactagggcttatttcatccctacagtctcgaccatagaagacggccacacccaaggggaccatttcagaggcccaccctcaggggcacattctctttcccagggatgttccttgctgagaaaaagaattcagcaatatttctcctatttgcttttgaaagaagagcaatatggctctgttccgcccggctcaccggcggtcagagtttaaggttctctctcttattccctgaacattgctgttaccctgttcttttttcaaggtgcccagatttcatattgttcaaacacacgtgctctacaatttgtgcagttaacgcaattattacagggtcctgaggtgacatacatcctcctcagctgacaggattaagagattaaagtaaagacaagcataggaaatcacaagggtattgattgaggaagtgataagtgtccatgaaatcttcacaatttgtgtttagagactgcagtaaagacaggcataagaaattacaaaagtattaatttggggaactaataaatgtccatgaaatcttcacaatccatgttcttctgccatggctttagccagtccctccgtttggggtccctgacttcccgcaacacttcctgctccaagatttgctatgatgagttttccaaatgttaacgacctggaaaagctcattgtctttaagacgtatcccttctgagtcttgtgatttggtggtttcttcatccaaaacgtatcatcctctataaaactccctgatcctcagatttaacttttcagtttctttttccaagttctcatcagtggtttaatggctgtatctgagcacctaaaaggtaaagactcttccaagctgttgagactccctccaggcaggggaatgactatctgggtctgagattatgtcattaagttctttttttttctttttctttttttttttttttctttttgagacagagtctccctctgttgcccaggctgggatgcagtggtgcaacctccactccctgcaacctcagctgcttgggttcaagcagttctcctcagcctcccaagtagctgggattacaggcacctgcctccacgcccagctaattattgtatttttagtagagacagggtttcacatcaggtctcgaactcctgacatcaggtgatcaacctgctgggattacaggcgtgagccaccacaccctgcgtcgctaagttttttaaccagagaggcttcaggtttcagacacacagaagcataattctggccatacaaaaacctcagtttcttctgtcttccacccaatcaaagtctccttcaaaactttaagtaagtttctatttgccacttcaggacacacctgcactgaactagacactgacttagaaacttggtttgatttggcaaattttctgttaaaatgctccatacttttcttatgcctattagagttatttctgacctactgtatttactttcagaattttctgaagctataatctttcaggaaatagtactattttttgaaatagtatttctattttttgaaaatagtatttctattttttgaaatagtacttttcaaaaaagtactatttgaagaactcttgagtatttactttctgtaaaggaagttcacatgtggcagctttctcctgagtatctaatttgcaattgcctaactgctcagtgacatccactactgtctgttctttgtgtttggcattagctttgagaccagctttctttttcattatgcttttttggtgcagctgtcgtctaatacttgttgaatttggtctgtttcctggtagaatggaggaaacaaagtcttgctcattatcactgctgctgtcattatgagtgctggaagaacaattgctagaagattcatattgcttttcaaactggctaggattgttgatatctgatgttttaatggctttactgcataactatttcttttccagaatggccactttgcccttcctttagcagttgaaaatctggatgcctctcaccgtactggagttttgggaatttgtgcttcaaaaaactcagatgcttcataacaaaaattgctgcaaaaagactttctttcagtaatatcatagactttattggttttgaaattttatatttaattcccagcttcttgtgacataaaggataaccacagagtttgacaatagaatgttcattcactacatcgttgtagtgagcaggtgtaatgaacttccccttttagaagcatcttcttgtttcaaagtacttgtctgtttagtacctgtggcatttcgagaatggtgggagccctggccctctgcagcccagggcagtcagccatgggagagagtagtctgcgggtctggaccagctccagagtctcgccccgaggcaccatctccctacctggcccacgttatcttaagggtgaattcttttaaactgtccatgtcgtaggtatgtccagatttacacatgccattccagagaatagcaaattaaggaaagttcctcagtttattgtgactagtataactttggtaccaaaaccaagcatggctaatatgaaataaattatagaccagtcttgcttatgtaaaatctaacaagataggagcaaaagaagtccagtattatgtttaaatattttatatgtatatatctcatgtctacaatgctgactgtaatacagttctgacagagttagcatgaaactccacaggtttaagggtgcagttcccaacgagactgcccttgctgcgagtacaagttaaaagtttggtggtccccagaccacctgttattccgattaactggctgcaaatctgggggttcccatgaatcccctcaagtttgataatttataaattaactgactgaacttgggaaagtggtatacttaagttacactttaattatgaagaatacagatcaggaccagccaaatgagatacagggtactgggagggttcctaacatggagcttctgtgctctcttctcctgggatcagggtatgtcaccctcttgacacatcagtatgctcaccaatgaggaagcctacctgagctatggtgtgtgtagattttatatgtaggtgtaatggaataattggccatgtgattgaactcaaactttcagtgttctctcctttcttccttagaggcttggctagctcaaaccccatccttctacacatggtggcctttctggtgagcagaccccattctgagtcatcttgttagcataatctcccccattctgagtcaattgttagcataatctcaggaatgatccatgaggctcgtgagtaacaaaggcattcctactaccaaggaaattccatgaattagaggttctctcccaagaactagggtcaaagactgaatacattatttattatacaataatgacaaattgaaattatcccaggaatgcaagataagtgtgttaattatcattgctgcataacagtttatcccaaaacttaatgacatgaaaccctaatttacaagaattcaggagtagcctagctggatgtggttctaatctttatgtttcacaaggttgcagtcaggaagtcagcaggggctacagtcatctgaaagcctgactcggggagaatacacttccatgtggcatactcacatggtggttggcaggaggcctcagttcttcaccctatgggccttcccataggctcgagtatcctcacactgtgacagctggctttctccagatctagtgatccaaaaaaaaaaaaaaaacaaggagaaagctgcagtgccttttaagacctagtcattactttattcgtttcttttttttttaaattaaattgagatggggtcttgctatgttgaccaggctggtctcaaactcctggtctcaagcagtcctcctgcctgttcctcccaaagtgctgttattacaggcagaagcctgtagtttttcctgtatcctgtttgttagaagaagtcactcagtttaacccatactcaaaggaattagtttccacctcttaaaaagaagagtatgaaagagtttgtggacatatttaaaaaccaccacagatggtttattcagtaaagttcttaatatgaattagtattaatttattaattcatttgcacattttgaaggagaaaaactctgtgctcatatcactagatgaagcaaaagcacttgatgaaatttaactccatgatgaaacctctcagcaaactaggaagggaacttccttaatgtgataaagactttcattaaatttataattaatttaggaacagttgacataccttatattgaagctttctgtacgtaatatgattcatctatttgttaaacttattattttgttcttcagtattttaaaattgtgtttatatcagtgttttacatttggaattgcaaaatgatatagtgaaagatgaagactggaagtcctagctagagcaattaggcaagagaaggaaataaagggcatctaaattggaaaggaggaagtcgaattgccacgatcatatatatatgtggaaaaccctaaaaacttcaccataaaacttttagaactgataaatgaatttagtaaggttgcagagtacaaaatcaatatacaaaaattagtagtgtttctatacaccaataatgaactagcagaaaaagaagagagtaatccatttacaaaagctaccaaaaaatgaaatacatttgaccaaggaggtgaaagatctctacaaggaaaactataaaacactgatgaaggaaattgaagcgggcacaaaatatggaaagacatccatattcaaggatttgaagaattaatactgtgaaaatgaccatactaccaaaagcaagctatagattcaatgcaatccctatcaaaataccagtgacagtcttcatagaaatagaaaaaaaatcctaaaattaatataggaccataaaggactgcaaatgccaaagcggttctgagccaaaaggacaaagctagaggcatcacactaccagacttcaagatatactgcaaagctgtagtaactgaaacagcatggtactagcataaaaccagacagtagaccaattgaacagaatagagaacctagaaataaatccacatatttatagccagctggcaaaggcgccaagaacatgctttggggaaaagacagtcttcaataaatggtgctgggaaaactggatatacatatgcagagtgaaactgtacccctgtctttcaccatatacaaaaataaactcaaaatggattaaagacttaaatgtaagacaaaggcaccaaagacaaagtgaatcatctattttcttttattattattattttttgaagtatagagatggggtctcactacattgcccaggctggtctcaaactcctgggctcaagtgatcctcctgccttggcctctcaaagtgctggggttataggtgtgagccattagcgcccagctaaatactgtattttcagcccatgtttgcctgcaatatgaagagattgctatacttattgaaaagaagagaccggaagtggtggttcatgcctgtaatcccagcactttggaaggctgaggcaggtggatcacctgaggtcaggagttcgagaccagcctggccaacgccatctctactaaaaatataaaaattaaccaggcttgctggcatgcgcctgtagtcccagctactcgggaggctgaggcaggagaatctcttgaacctgggaggcggaggttgcagtgagccaagattgcgccactgcactccagcctgggcgacagagtgagactcgtctcaaaaaacaaaaagaacttgcatataaattgacccatgcagttccaacctgtattgttcaaaaaaaccaaaacctcccttagacctagaatcccacttctgcaaatccagcctacagttttatcagcccaaacaacaacaaaagcatctcttcaagtttatttattgccgcattgcttatactaaattattggaaatgatctaaaatgtccatcaacatggttgtgcactgtggcatgcacctgtagttgggactgctcgggaggccgaagcagtgcaatctgattgcacctgtgaatagctcctgcactccagcctggaccagcatggcaagaccctatctctaagaagaaaatgttcatcaacgagaatgagcaaatatgaccataagatatttataggataaaacactagataacaatgaaaatgaattaagaagaactacaagtatctatcatggaaatacttcacagtgttatgtgaacaaaattaaagcattatatatataaaaacagtaaagtttttatatatctgtagaaagtttaacaatatgtaaggcaatgctatatgttacttaacaatcctttctttgaaataaaaggcaagttgatgtgtgtttaaactagaaatcccaggaaaaaatcagaaaggtacctgggcttaaagaaaaatgctaaacggggctgggcgccatgactcacacctgtaattccagcagtttgggaggccgaagctggtggatcacccgagatcaagagttcgagaccatcctagccaacatggcaaaaccctgtctctactaaaaatacaaaaattggccaagtgtggtggcatgtgcctgtagtcccagctactcgggaggctgaggcaggagaattgcttgaacctgggaggcggaggttgcagtgacccgagattgtgccattgcactacagcctgggcaacagaatgagactccatatcaaaaaaaaaaaaaaagatgctaaaaggaaagcagggacaagtaaatgtcaaatccatttcatgccatagaacttttttttttttttttttgaggcggagtctcgctctgccgcccaggctggagtgcagtggcatgatctcggctcactgcaagctccacctcccgggttcatgccattctcctgcctcagcctccccagtagctgggactacaggcgcccgccaccacgcccggctaatgttttgtatttttagtagagacagggtttcaccatgttagccaggatggtctcaatctcctgaccttgtgatccgccatccttggcctcccaaagtgctgggattacaggcgtgagccaccgcgcctggcctagaacttcttacaacaccctaaaccagtacatttcaacctggaaaagatgttgtaacgcagaataaagaaaataaagtacagatatttcattcccaaggcggggaactcttctaggttcccaagttcttgagcttcacgtgcatacagcaggaatctgtcatcttgagggagttctttcttaaacctatgggtttgtaagattttagttttctatgctgtccttttttggtcatgcttgtcagggaagaattgttaaaaatctattttaacaccctctgcccttattcagggcagttagagacttaaattttacgtacacatactacctttgaaccttcagtgtgttgtttatgtactgaaagattgcagttgaatttagatcatgctttgaagttccctttgtcagaccacattgtttgtacccaaagaaagacttcattttctttttgtctgtaattatttccatacttatttaacttggtataacatgtggtactgtaaaagcataacccaagccattgtttgccttaagcaacattttagacattttagatttggggatgtggtgtttacttatacaagcctttcttaagcccttttaatttatatctcaaacttgaggatatccatgaaaacagcggaaactttttcctcaccggatcttgacacaagtcagggatggaagtgagcaaaaggaagtggtgtggtttttatatcatttcagttgtgttgagatagggaaatgggatagtttatccactgtactgctcttttgggaaagtctggtttgtatataaaagtgaaaggaattggcataatgttttaatttcttctgctccattcagtcattccctcaataaatatttatttagtatcgactctgtgccaggcactgttccaggtgctaaaaatataaagtgagtgaaacagactaaccctcctggcctcatggagcatatattctagagcaggtggcaggcaataaaatacagaaaaattatatcaaattatatagcatgacaaatgctaaagagaaagaaacagccagaaaggagaggagtgctaggcatggggatgggattacagttttaaatagggtgggcaggaagcctgtaaataagaaagggattttgagtaagtgcttggaaggggcaaggcagcagtcccggggaagaccattacaggcatagggatctgcacgtgccagggtcctgcagcaggactgtgagcggcaggtgcaaggaacacctattaggctggaacggagggagggtggaccactggagactttagctttttgtctgagtgagttggagcaccgttggagggatctgaatggggtgtgatgtggtttaacatgctttctcttaggatcactctggctgctgtgttgcaaatccatagtgggcacaggtggaagcaggaggccagttaggaggtgccttcagcaatccaggcaaaggggttagtggcttggtccagagcgagcagtggaggtagtaggaagtgtgtgggttctggacagattctgcaggtacaaccagtggatttgatgacaggaaatggaatgcaagaaggaaagagggagttgtcaagaatgacttgagattttaggcctggttacatcagtgtagcgatattctaaaaataaaaaaaaaaagattttagacctgggacttttaagattttacaccaagtaaagaggctgtcaacggaggtgggaaagacttaggatctagcaaatttgggagggaagaggcaaggaaagataaatagtgacaaattgtatagttgctgataacattgttaagtcaatatttatactatttgagctgcctttttttttttttccccctctgagacagtctcgctttgtcgcccaggctggaatgcagtggcacagtctcagctcactgcaacctctacctcccaggttcaagcagttctcctacctcggcctcaagtagctgggattacaggcacccaccaccaggcctggctaatttctgtatttttagtagagatggggtttcactatgttagccaggctggtcttgaactccccgcctcaagtgatctgcctgcctcagcctcccaaagtgctgggattacagacgagagccactgtgcgggccttagctgtcttaaaaatagcacttatagcagcctgtgttttcttttcagatgttatcaagtatcttttctggtaagacatttatttgcctttattcagaattgctaattttatgctaatctaacccagaatactcaagtgtgcctttccctttaatcctcatattagctatattagctagaatatttttggttgtaacagaaaaattgactctctctgacctaaaaaatggaatttattggctcttaagagttccaaagtaattgaggcttcagacaaggttgcttgagtggctcatcgatgtctcccgggatctggcttctttcagtctcctggctctgccttctggttctccttctgggcccaacatagctgccagcagtttctgggactgccttattcatattgagtctgagagagtgactttgtcactgcagggtcagtcaaagtcctgagactattagaccagctcgcccctgaactttttgtggcagggaagatagaatatgcttagtgtaagagcctctactcctgagatcttaggggaaatctttgtaccctgaattaaaaaaaatttttaaatagttacataagtggaaatgattgatttttaaaaattgcttttgcattgtacaagcaccatggttaacaaaacaattcctttttaaagcagtcaggtgggaagggaaaaaaagtaaaattgtattcatacattagtttgatcaagataatttttcttcttagagatttaatagtgttgccacttgaccagctggaactacaaaggaaccattagatagtaatgaagtatgatacccttttcagcactccttctcacctttttactttacatctccagttttgcctcgcacaaggtctcttcttcctctgtggatcctctacctacatgtgtctacctgctaattagacaggcacatgcacactagttttctttatccccaaaattcagtttgcaaatgggaccgaagagctccctgttcccctcatgacaccgacacgacaaaaaaaagttattccactaattcccttgatggtcggtttaggagtttctgcctccactattgctctcggtactggaataacaggcatttcaacctctgtcacgaccttccgtagcctgtctaatgacttctctgctagcatcacagacatatcacaaactttatcagtcctccaggccctagttgactcttcagctgcagttgtcctccaaggacaactccgaggccttgacttactcactgctgaaaaaggaggactctgtatattcttaaatgaagagtgttgtttttacctaaatcaatctggcctagtgtatgacaacataaaaaaactcaaggatagagcccaaaaacttgccaaccaagcaagtaattatgctgaatccccttgggcactctctaattggatgtcctgggtctcccaattctgtcctttaatacccatttttctacttcttttattgggaccttgtagtttctcaattcatccaaaaccgtatccaggccatcaccagtcattctatacgacaaatgtttcttctaacaatcccacaatatcaccccttaccacaagatctcccttcagcttaatctctcccactctaggttcccacgccgcccctaatcccgcttgaagcagccctgagaaacaccgcccattctctctccataccaccccccaaaaattttcgccgccccaacacttcaacactattttgttttatttttcctattaatataagaaggcgggaatgtcaggcctctgagcccaagccgagccatcgtatcccctgtgacttgcacatatacgcccagatggcctgaagtaactgaagaatcacaaaagaatgaatatgccctgccccaccttaactgatgacattccaccacaaaagaagtgtaaatggccggtccatgccttaactgatgacattccaccacaaaagaagtgaaaatggccagtccttgccttaactgatgatattccaccacaaaagaagtgaaaatggccagtccttgccttaagtgatgacattaccttgtgaaagtccttttcctggctcatcctggctcaaaaagctcccccactgagcaccttgcgacccccactctgcccgccagagaacaactcctctttgactgtaattttcctttatctacccaaatcctataaaacggccccaccctcatctcccttcgctgactctcttttaggactcagcccgcctgcacccaggtgattaaaagcttttattgctcacacaaagcctgtttagtggtctcttcacacagacgcacatgaaactaggcaagaatcagtgtttctctacaaattgagttgacaaaaagaaattatcttcccctgcccccacaaaaaaagaaccagtatttctcaacaaggagagtactgttagcatttggttctttattttgaaggattgtccctgcacattgcattttctatcctggtccctggtcaaactgtatgtcctgtcatatcccagacattattccaaccaaaaagtcacctacatatttttagatcctcttaggagggggtggtaacccagccactgctgatgcctgaggggagtgcaaagctgggtttttgaggagctgggactgagatcctgagtagtaggcaccactgggcctaaaaggattccatggggttggttctgggagtgtggaaggaagcagagagtgtagattgctgctgccaattgaatgccagtggcattcaggcaactgacaggaacagcgaaccaaattgggaaaaagaaagtcccttctcccctcttccagctttctctagttccccagttggcagagcctctccaggaaccagctggtgaaggacatattgtcagcagcatcccagctccagcatcagaaagcagaatctatagatagaagagggagctttttttttttttttttggctgaaaagcgatagtgtaaaaagggacacagtactttctgttttttaatctcattactttcctgccagcgccttaacaagtggaatttgggctttgtcagcagcaaacctgccacttactggttgtgttaagttgggcaagtttctttctttttttttttttttttttttttttttgagatggagtctcgcactgtcacctgagctggagtgcagtggtgtgatcttggctcactgcaatttctacctcctgggttcaagtgattcttctgcctcagcctcctgagtagctgggtttgcaggtgcctgccaccacgcctggctaattttttgtatttttagtagagacagggttttactatgttggccaggctggtctcgaacgcctgacctcgtgagccaccatgcccggccaactcaggcaagtttctttgcgcttcatttttttttttttcagagttatgaagatgaaaaaagatcttacagggttcagtaaaaaataacttccagtttcctgtttaacatatgtgctcatggtatacccgacaaaacactgcactttggattagaaaacctgggtgttagtttgtcatatatactagctacatggaattcagcaagttatttatctccttgaacctatcttttctctgtaagtaggaatgattttacttactgtaaggatcacagagatgggataatgcacgtaaaactaatttgtaagttataaaaatgacagtgacaatgggatgctaagcaggtaccattaaataccaccacatatctgagtttctctgatttaatctgcacaaaatacctagatcatctgttttaggctagactctgaactctttaccaccacattaaactgtttttttctctattcaatttaccagtaaaggttgagcatccctaatccaaaaatctgaaatctgaaatgctgtaaaacctgaagtttttgagtgttgacatgacgctcaaaggaaatgctcattaggtgttttggatttgagttgctgaaccagtaagtatagatagtgcaaatattacaaatttaaaaatccaaaatccaaaacacttctggtcccaagcatttctaataaggagtagtcaacttgtacccattgtatgcctatggggtgaccagaccctctccctttccagacagttctgcaataactgattcacttcgcctgtttttggtcatttctgcgtgttctagaggagaaacagaagagtgacacctaggtctcttaaatagacagctgacagacattacgaatctcttcgaagtacagatatgccaaagattgctgtgtagtacaatctagttgtaattgtgagacttttgttgttgttgttgaatacagttaaacaaaaaagctttggagaaactaggttagggaatttgtagtacaaggttgaatgatgttttgaaaacagattatctatttgaaaaatgtttcagaaacctggaagcatttcttctgcatctaatattgaggtcctggtgaagggtataaaacacacagcatcaactatatataatgctatactagattgtcttgattctgtggtcctggaagagtttatacttgtgttggggaaactatcttggcatagaaggaaagtgaaggttttgagtggggcagggacagttgagcagaaatacaaaggttaaatgtgggcttgttttgattgttaattaataattgagcatgggggaaaggtagagttggaaagtaatttcaggggtggcgatgaaattggtaacttcaaagtggtggagacatgacagtggaagttttatacagtggaacttccccatccctgttttaggtcttcacttagttgcatggttggctctctttgctcctggcccacgggcattattgtaaaactttctaaaacaccctgttatgaatgtcttacccatagcaagatctgacagcgtggacaccaaggcaggcatttcggtaagatttctgtgtattacctcagatacactcagacaactctttaagcaagttattttcttcagggtttatgtttagatttgcgggatattgttttctacactgatgtaaataactgcgagtggtgttgctccagttgtacaagtgtgtattcctctaaggattgatggggaggagtgtagagaacgggaaggaatggatgagttgcttgttaagggaaaagatgatattcttatgctaatccaggccctggataaggagcagagcagccatgcgaacaatggccttggagccaggaagtctgcagtgagtctattccttctcagaaagcttgtcagacccggcgcctggagctgcctggcggggagggacccctggaaaggggagttttctccttgctattttatggaattggctgctggccagcttgttggaaattcccaaacttctctactagaaagtgaaaatcaacggtggggggcttaacaggaagaggaaggaatgactttactctgtagtctgttttttcaactgacttcagccttttcctgtgtttttttttttttaagttccaattgaactgttggttcagttgtcttgctgtttgaggagttttaaaatcttttacttaaaaaagaaattatttatatttgagtaattctgccttaatgttattttcctgaaaagaaacagtaccagtctgtgtatatagcaaggggaagtaaatttatttagatgcccatttcgtctaactattcaatagcttttaaatggcagcatgattaaaaaattttgattatgcagcatgtcaaatatctgcatctccttatattcttcactttgcaagattagatatttttaatgtaaaaattccgatgaatcatttaggaatttaaaaaatatattttatcgttagatattacaattacataattttaagaatgattgtggccaggcacggtggctcacacctgtaatcccagcactttgagaggccgaggtggacagatcgcctgaggtccaggagttcaagaccagcctggccaacatggtgaaaccctgtctatactgaaaatagaaaaattagctggacgtggtggtgcgtacctgtagtcccagctactccgaggctgaagcaggagaattgcttgaacccaggaggtgaaggttgcagtgagcagaggttgcaccactgcagtccagcctgggctacagagcaagactctgtctcaaaaaaaaaaaaaaaaaaggctggacgttgtggctcacacctgtaatctcagcactttgggaggcagaggcgggaggatcacctgaggttgggagttcgagaccagcctgaccaacatggagaaactccatctctactaataatacaaaaattagctgggcgtgatggcgcatgcctgtaatctcagctactcgggatgctgaggcgggagaatcgcttgaaccctggaggcagaggttgcggtgagctgagatggcgccattgcactgcagcctgggcaacaagagtgaaactctgtctcaaaaaaaaaaaaagaattgttgaaaaataaggttaatattttgctatgtgattgtagaaacagttaatatgagacaaaggagaagtgctcagttattaataattacatctgtttgttgaaatgtttactgagatgtaatattactaactcttttgagttagtaatatccccattttgtggtgaaggaaaccgagacctggatagcttaagtaattccccaaaatcacacagcaaataaatactggagctgatttttaaaaattatttatatttattattttatcagtgaataccacatcagtgtatgtggtgttaacgcctttattaatgcagtttttagacgaatggtgttctggggccctcccctcttttcactctcttggaaggccatctccagagtcatagctgaatattaccgttcttttagcataaccgatttgtatgttcagccccaaatgtgtcctttaagtttcagaaccaaatgcccgttagacattccctttgggtaatctcagatctctaaatttgaacctttgatctcttcactcctgtcaaaatcactcattcccatttcagtaactgttcatgccacagatgtgggaatcttctttgacgcctcactttcccttaccctacatttaatccattgctaagtaccactgagttttgttttgttttgttttgagacaaggtctcgctctgttgcccaggctggagtgcagtggcataatcaaagttcactgcagccttgaactcctgggctgaagagatcctcccacctcagcctccctagtgtctgggactacaggtatgcaccaccatgcccagctaatttttttaagttttttgtacagatgaggtcttgcagtgtttcccaggctggtgttaactccagacctcaagtgattctcccacctcagccttccaaagtgctgagattacaggtgtgagccacgtacccagccaaaaattatttttgaagtatagcatgagtccatccactataccactgccaccctattctttttttttttaattcatccatctgcacacggattctgccctaatcttaaccaccattgtcattctcctaaatttccacaatattctgcttactcatctgtttgcttttgctattatcccctccagtccattacgtagaagtcagatgatgcccacttaggcttaaatcccaagtccttcatatgcccttgcctgatctggtctttgtcttctctgcctcttcaccctcatctcccactacactatctcttattctcaacatttcagacattgttctctctttgcttttctctccctcaagatctttgcccacggtgttccctgtgcttagaacttcccgtctttctttgcctgactgactctatttttcagatctcaacttaaaggtcacttctcagcattgcttccctttccgcttcatctagattagaggggggtcactgcccctattccttcaggacctggcacttttcttcctttgcacttatcatgagttatgattgtgtatcatttgtgttttcttgtttggtgtcttgagtatcttaattgttttgtttaaggactctgaacttcatgaaggctgggcctgtttggctctgaacagtgtattcttggtatctaatacagaatcatgcatagcacagacacttaataaacatttagggaataaattaataattcaacggcaagaacactgtttccataggactccagcattggaagggataacgtagattatttagtctagggccaggcggtggtggctcacgcctgtaatcccaacactttgggaggtttaggcgggtggattgcttgagtccaggagttcgagatcagtctgggcaacatggcaaaccccatctcaacagaaaatacaaaattagccaggcttggtgacacgtgcttgtggtcccagctactcaggaggctgaggtgggaggattgcctggagcccaggaggcagtgagctgaggttgtaccactgcacttcagcctgggcaacagagtgagactctgcctccaaaaaaaaaaaaaaaatttagtccagtctccctttctatcatgttggtcatgtctttgacaaagatgctctcaaactttattccttatgtactctgtgagcaaagtccctgggttcttttggttgtatctcaagtggagtggttgctatgtcctttgcattcctgtcattcttctctcaagtgcttaggaggcctggccaggtggaatacagtaagatggttgtcctgtttgattacagcagcatttcccttcattctcagactgcatgcatgtcttaggagttgtcatcaataccaatacgtattgagctcgtagtcagggaagatttgatggctgttctccatacaagttatcacagctttttttgtctataaaaatttcttgcagattgaattgttatggatagcacctgttagtgacttcctttgccaggttggcaagtgtgttgtaaacatggatgagaggaggaaacttctatttagcacctactatgtaccaggctctcctaaatagtttaaaatgtgtatttacattatataatatatataaaatcaggcagggaagtataggatagttgttaacatgtagaatctggaatcagacctccttgattttaattatgactctgccacttaacctgttgtgtgatctttgataagttccttaaagtctacttgcctgtttcttcatctgtaaaattaaaataataatttaacctttaaataagttggttgatggtttgataacttaatatatgcaaagcatttatgactactggcacatagaggttaatatgtgttagctattattttatatgagttccttaagtttaaaaatatttaaatttatttaattttttattttaaaaattattttaaatatgtgtttgctgttatctcatttggttctcaaaataactgtcagttaataaatatcattccagatttgtttgtttgttaagatggggtcttgctgtgttgccaaggctggagtgcagtggctcttaactgttgtgatcacagtgcattgtagcctggaatttctgggctcaagtgatcctgtttgagcccaggattacagctgagattacaggcggtcaccaccacagttggcctcattccagttttaaagatgaggaaactaattcagagaggttaagttaaaggcagatccagaatttgaacttatgccagggtagcagggtcgtggatgtttttgcggaaggaactcacacacagtcctttcctctgaaagggaaagcacttagagtctcacggccagccagctctgcagggtgccttggttgtggctctaatgagacaaggccacatattagctttaaataaaccaatgaggaaacagtgacaatgaaagatgtaacaaggcatagcggtcagtctcctgcccaagactgtgagttccttgcagcaggaacaaccatactcatatttgtatttctggtacctaacactgggtcggtaatacgtactccagatgcaggccagttgcagtggttcacacctgtaatctcagcactctgggaggaggccaaggccacaggattgcttgaggccaggagtttgagaccagcccaggcaacatagcgagacccaccgcccccacccctattaaattaaaaaaaaaaaaaaagatgttgttggtgaataagtgagtaaattaataagtgaaaatttggggaggggtggagacctagcaagggaggcaggaccaaagccagggtttctggcatggtatccactggagagtggtagccagtggaggagcaagaaagaaaggtgtgggtttgatttagacaggtggagtgtgattctagtagaaatatttagtgggaaaattgaaatgaggaagagagattaggattggaaatacactggaaacttctcttgaattggaaacctggaacatatatccttagaatgacagttgaattatttcaagaagttttcaaagaaatgctgttaaatcatgtggcagacattattctatagttattttagactttacatctttttctctcagcattatgtaatgggaaacaattttatattacagaaataagagattgcagggatttttagaactaagctacatataacatacacgtgtaaatgatacctcactgtaaaccttctttgcctcagtactgtgaataactttggaaagctaattaaagtgaaaattcttacttagatattataaagtagaaagctcaggttattaatgtagaaatcacaccagggtcattgtgtcataaataagcaagatctttgtcattcaggaatagttcaagctgaaagtcaataaaatcaaaccacatgaaacaatgggatgggggtaaagtagaatgatatatatcttgatactaattagccttttcccccgttatttatttaacaattttactttgaggcatttaaaagttcactgtctatattaataatcaccaaaccttaattggagagattatgtttcatgtcatccatattagaagttcagtttcatcttaataaagtcaaatttgcaatattttaggaaataatttctttaagatactgcttttttccctccgctcccctcccctcctctcctctttttttatgagattgtgtctcactctgtcacccaggctggagtgcagtggcgcagtctcagcttactgcaagcttcgcttactgggttcaagccattctcctgcctcagcctcctgagtagttgggactacaggcgcctgccaccacacctggctaattttttttgtatttttagtagagacggggtttcactatgttagcctggatggtctcgatctcctgacctcatgatctgcccacctcagcctctcaaagtgctgggattacaggcgtgagtcactgcacccgaccttcttttttttttttttttttttttttttgagatggagtctcgctctgtcgtgtaggctggagtgcagtggcacaatctgcaatcttggctcactgcaacctctgcctcctgggttcaagtgattctcctgcctcagcctcctgagtagctgggattacaggcacccaccaccatgcctggctaatttttgtatttttagtagagatggggtttcaccatgctggccaggctggtcttgaactcctgacttcacttcaggtgatctgcccaccttggcctcccaaagtgctgggattacaggtgtgagccactgcacctggctcctttttcttttttttcctttaatgatgaagcaccctctttaattaaatatgtgtaattttcgcctggcatggtgactcacacctgtaatcctagcactttgggaggctgaggctggcggatcacctgaggtcaggagtttgagactagcccggccaagatggtgaaaccccatctctactaaaaatacaaaaattagccgagtgtggtggtgcacacctgtaatcccagctactcagaaggctgaggcaggagaatcacttgaacccaggaggtggaggttgcagtgagtcgagatggtgccattgcactccagcctgggcgacgagcaaaactctgtctcaaataaaataaaataaaatgaattaatatgtgtaattttctaggtcggcttcctcttctatctatagaataaattatttattagaaagacttagggtgttttcattatatctactagaatttgcaagaatgttgatggttacccttatgttttaaatttaacttttcctgtttaagtcttaatatagttgggaattttcatgttattaataaaataattagaacagccagaaaggactattgagattgtttaatatacttcccttgttgtacatatggctaatctgaggtcaggagaggttgcagcctgttaactaaattatttgaagtttgaaattatagtgcctaaaaaaaaaaaagcaaggatacctttaatcttttaaaatgtatttcattgtttaaaggtgtgtttgggcatttgtttcccttttagtttttgaaaaatttccaaaattcagttgtattccttaccttttaaatatttttgtctttcaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggtaaatcagtgttcattttagtaatgtatgtgtgtatataaaaagcactatttcttgcttctgttctttcaactcatccctgtttgaatagttaggcccagcctactagggcagcttttaggaaagaagcaaagatgaaacacgtgccaaataattttttaacttggctgtgatggaaacattttcaagtatttttgaaatctcagtctgagtctgtcttctccttcacaacataggcgtaatgatacacagcattaggtcttgtgaggattaaatgagataaagtatgtaaagccacctcagttagtagctgaaagacagggtaataggtagtccaggctgagcttcaaaattcctctctcctttaaaatacaataaggagcaagtgtaaataataattgaaaaatcattttattggccaggcacagtggctcacacctgtaatcccagcgctttgggaggccgaggtgggcggatcatgaggtcaggagttcaagaccagcctgggcaacatggcaaaacctcatctttaccaaaaaatacaaaaattagccgggggcctgtaatcccagctactcgggaggctgaggcaggagaatcacttgaaccccgggaggtggaagctgcagtgagctgagatcgcaccaatgcactctagcctgggcgacagagcaagactcttgtccctgccccaaccaaaaaatttcattttattgttgttaaaagactttagaaagataactgacacttgtctgtgctgaatactaaaatttcttcatagagcactgacagtttgtttatgaccaataaagtaattttgctactatgtgttcacagcttagaactcccaaacaggaagttattgtgatgactcttaggaccagatggcctgtatttgcacataagctttttcctgtatggtttaagtaggataatattttaagctgaaaagacagtactgttttgcaagaggattttagataaaacttactggatgtcttcgttctcaagttttttacttcacaggttgctttttcctaatgttttgatcacagtgatctggattaatatctgctgttaagaagaaacatgattaacaccataaagcttttgatattttcatcttttttttttttttttgagacagagtctcgctctgtcaccgaggctggagtacagtggcgccatctcggctcactgcaagctccgcctcccgggttcacgccattctcttgcctcagcctcccgagtagctgggattacaggcgcccaccatcacgcccagctaattttttgtatttttagtagagacggggtttcaccgtgttagccaggatggtctcgatctcctgacctcgtgatccacccacttcggcctcccaaagtgctggcattacaggcgtgagccactgtgcctggctgatattttcatcttaaagcacaaacatagaatgaaatctatagcttctttttattttgccttagtattataacaatatccttagtattacaacaatatccttagtattaccatgctaagaatacagagccttcagcaaaagccacttttacttgtgaaacaccaaattatttagtacaatacctttacttcaatatctgttacatgccttgttgatcagcatcaaccaaagctgctatagttttgaagatgagttaaattcatagtaatattatatttgctacctcacttccaggtaatctccattttggcataaatttttttaaaatctgtttagatcacacgtaggcaatatgatacaaaattctcagtcttcgccccagttcacattgttctataataaacttttattaggtggaataagttggtaattagttactacgtaaaagcaaaagatcttattaagaattacatttctctgataaagagtgaaatttgttacatttcctttcaaaaaattattttgatagttgcttcaaataacacacaaatgtttgctcttaaagctaaaaccaatgtagaaaagttatttctgagagatcattaggaaggattgtagaatggtattaatggaaataacttctgactttagctctagctttatcttgttttgaattatgtctcaggaaaataaacttatctgtaccttggtttccttgatgtaaaatagaaataataatgcttatcctagatataaacaagaatgttttgaccatcaactgttagggtatagatttaagtgctttacattgagataaagttacttaggtttgaacagaaaaatgagtcatctgatattaacagctgatagatacttagttcttattttttaagacttggtcacaaattttacaacaggatatattaatgttggatagatatgtagtcccttttttggattttgtcacaaatttcagaaatggattttagttttaagtaactaataatgacttcaatagagatttatttttaacataggtggtagatgtttgctgtacattcagttattgagtagtgtcaaggctgacatgtctgtaattttcttgacatttcccttgtggttcccaagtggttactattatctgcatttgaggcaggtaaaacggggaaagggtcagcactggcctcaactagacctgataccaggaaagcaaaagtgtcacagattttgtcttaagtcttaatcattcctaatagcaagagctactggaaaacagagaaacaggattgtcacaattgtcttaatctatatccattgcctagggctgggtgtgttgttcccccaaacaaaatcagagtttggttagctgggaaaagggggaaaataggtatcaattggacaattaaaaggatctgggagagatttaattttttccatcaattagaatgttttcctctacaaataattaaaaaaaaattaaaagagcttaaacatgacattttgggctaggtgatttttatttttttaaaaaaaagtttgaacaataaagagcatgtagtaacacacaggaagtctgtatataaggggactgtagttggttatgtggctcatcaagacccaagttctttgtcttttcaactgtgacatctctaaatgtcaggttagccacagtgtcacagtgtggctgctgagagactagacatcacatgcagatgaggtaagcttgagttgacaatgctcagttaaagaagagggaaatctgtttgtgtctctttttaattgataaatctttccccattcactcacttcctctccccaacagacttccttctaatcttagtggccaaaattcattatatgctcttgtgttaaatcactggcaaggggaatggaactaaaattgttggattagaccaacgattatctctgctgagagtagagggctgcgcttccctgaatcacgtggaggaggggcagacccttaatgtgtgtgtacatgtgcacatgcctgttgccagcaagggaaggaggagaagaataagagtatctgttgctgggtaccacatttgttgacctgacatcatacatatgctaaaatgctcatgttgctatgaaattttcagttccttttcaaagggttctataccccagagttgcatccatttagtacatgcagctactaatccaggacttctggctggtgggaagccctctccttcgggtccaggtgcctcttcatggtccagcagtgtgtggctaaaagcaattatcagtgcacagtatatccagtatccagtgataaagatgaagtgggataagtactatataaaacttccattcagaggaagaaaaattggaaacaacctcagtattcactgctccatagcatgtagattaatgatgcttaacctgtttgtcagcctccagttttattttctgggaggatttgccttgtctctggtgttccttggctagtgtttctgtcttcatggtcacatctgagctggaattagtggaggatgatctttgtggagactgaacagctttagcggcctgctttctgttagtatggaggtctgattactggaaattgtcctatggattgaaaactcacagcctgactgagtcagcctgggatatctttggaagtacagttcctgtaaagttgtagtggtcctacattctgtttgctctgatctctttggtttcactccattaaacacagttaaatatcttgtcttgatgtgtgttctgagaatttctgacctagccactggcctctgctttgcctgttctcctggcctttggtttagtgacctccgctctgaggcactctgctcctttcccatgctagaaaatgacctgctttatttggtattgtagcacttacctatgaataaatattaaaatagtaccaaatgtcagtatttattcatctttattgtctttctccgtcgaagactgtaagctttaatagatatgggactgtgttttgtttactcttctagtcacccagggcttaaaacagtggctaccaccgtgtactcactcagtacattttggtttaatggatgaatacagttaaagtgaaaaaagcaagttgcaaagctgctttcttagccatatatttttacactgaccaacccagtaacaacaagcacctgtaacaacccagttgtagtatctgattgtcttttttcactaaggatctagaactccttggagaaatcactgagttcaagttcggcagggaaagagcaaggtgatcttggtattttggccagaaagcaaggaaaagttcaaaggattcagtgaccagtttgaattgaatactaattgtagtggattcaaacaaatcaaatatgtttaaatccacgtgtttgtaataacacttaagaaaaaaactagttagggctgagggctgtgacttacacctgtacatgccaacacttgggaggccaaggcaggaggatcacttgagcctcaagagtttgagaacatccacggctaaactgagagtccctttaaaaaaaaaatagtttgagaccagcctgggcaacatagagctggtctctacaaaaaaaaaattttaattagctgagtgtggtgatgtgtgcctgtattcctggctgaggtgggcgggagaatcacttgagcccgggagcttgaggctgcagtgaaccaatgatgacgccactgcactctagtctgggcagcagagcaagactctgtctcaaaaaaagaaaacaaaactagttggttactgttaaaagatgctaatgaagtcattaattttgaaaactggtaaatagagggagaaatcaaacattaatcttgcctttctaacatgaactgtgccacctgtatccaattagtaggtgagggaaagcatctcatagatgtattccaagtcataaaaaagagaaatgataggattagatacattattttatactatgccgattgaattagtgaatctagaccttaaaaacagagataagcaggcatttggttccctcctgcccacaacatacagagcagctgcatttcagcgctcaatagacacatgtgacttgtggctaccatattggacagcacagctctcgagctaattaccatttacaaaatccatagagaacaagaggacatgttaaatgatgccaggaggatgtgatcagaaattccagactgtggtaaatactatactagtaaataccggacaagttacccaatgtctacaagtaaatctcaaggacaggaagaggcagaagaaactggtagattaagagacttggagacaaccagcttatttggatcctgattcaaggaaactactaaagtaatttgtaatatttatgatacaattggaaattagaaagcaatttataacatttataatataattggaaatttgaacattgccttgatgtttgatgatattggtaaggataaggaattactattaatttttttaggtgtgataactgtgttttttttttaagttcttttagagatacacattgaaatatttacagataaatggacatatctggtattagcttcataattatatgaaagggggagggagtgaaacaagaagggccatgaattcatcattataaaagctgggctgtatgggtatgtgtgggttcattgtacagttttctctacttttataaaaggtttctggccaggtgcagtggctcaggagttcgagaccagcctggccaacatggtgaaaccctgtctctactaaaaatacgaaaattagccgggcatggtggcatgtgcctgtagtcacagctactcgggaggctgaggtgggaggatcgcttgaaccagggaggtggaggttgcagtgagccgagattgggccactgaactccagcctgggcaacagagtgagaccctgtctcaaaaaaataaaaagttttctggaagaatacttcatttcaaacatatatatgtaaatgaatagaaaaaggacaagaagcatatacatcaaacggataatggtggttatgtttaaggagtgggaaggggattagatgggcccaaagaggactttttggtttacttgtggggctcaatttttttttggatgctatgagaatatattgttgttttatttgagtattttaaaaactacttttaggaaaaaaaaaaaaaaagacccaacacggtggctcatgtcatgtctataatcccagcacattgggaggctgagacgggcggatcacctgaggtcaggagttcgagaccagcctggccaacatggagaaaccccgtctctactaaaaatacaaaaaattagccaggtgtggtggcacatgcctgtaatcccagctactcgggaggctgaggcaggagaatcgcttgaacctgggaggcggaggttgccgtgagctgtcatgccactgtactccagcctgggcaacaggagcgaaaacgccatctcaaaaaacaaacaaaaaaaccatcaaaaactacttataggaaaaatacttatttcaagcatatgtctaagtagagagaataatataatgaaactccatgaacttgtcactcagttttgacagtatcaactgatgaccaaggctgtttcctctctacccccatgcacttctccctcacccacgtcacccttggattatcgtgggtaattttgaaataatatttcagttaagtataagacaccttggctgggcacgttagctcatgcctgtaatcacagcattttgggaggctgaggcaggcagatcacttgaggtcaggagttcaagaccagcctgccagcactttgggaggccgaggtgggcggatcatgaggtcaggagatagagaccatcctggctaacacggtgaaaccccgtctctactacaaatacaaaaaattagccgggcgtggtggcgggcgcctgtagtcccagctactcaggaggctgaggcaggagaatggtgtgaacccgggaggcggagcttgtagtgagccgagatcacgccactgcactctagcctgggcgacagagcgagactccgtctcaaaaaaaaaaaaaaaaaaaaagaccagcctggccaacatggtgaaacaccgtctctactaaaaatacaaaaattagccgggcgtggtggcaggcgcctgtatcccagctacttgggaggctgaggcaggataactgcttcaacccaggaggcagaggttgcagcgagtggagatcgtgccattgtactccagcctgggcaacagagtgagactccatttcaaaacaaaaaaaacaaaaagcaaaattcctcaaaggccacatactgtgatcataatgcaataaaaggagttcaacagtgtaaactttgtttgagcgtatgactttttttttttttttctatttgagacgagtcttgctctgtggcccaggctggagtgcagtggcacaatctcagctcactgcaacctccatctcctgggttcaagcgattctcctgcctcagcctgctgagtagctgggataacaggtagacaccaccacactcggctaatttttgtatttttagtagggtttcgccatgttggccaggctggtttgaactcctgagctcaggtgatccacccacctcggcctcccaaggtgctggggttacaggcctgaaccaccattccctgccagcctgctgggttcttaagcgatccttccgcctcagccacccaagtacctggaactacaggtgtgctccaccacacgcagctaattttttaaattttttgtagagaccaggtctcagcatgtttcccaggctggtcttgaactcctgagctcaagcatcctaccttcctggacctccgtaagtgctaggattacaggcatgagccaccatgcctggcaaacacatgatttttttttttttttttttttttttttttgagatggagtctcactctgttgaccaggctggagtgcattggcgtgatcttgtctcactacatcctccacctccctggttcaagtgattcctttgtctcagcctcctgagtagctggattacaggctcacagcaccatgcccagctaatttgttgtatttttagtagagacaagagtttcaccatgttggccagactggtctcaaactcctgacctcaggcagtccacccgcctcggcctcccaaggtgctgggactacaggcgtgagccaccgcgcctggccaagcatatgatttttaatgcaataactatattcatgtttctagaagcttttttttgccattcagtgacattatggatgacactgcatgtcagtatgtgtcggacatgtgtcagcatgtgtcggaatgtatcaacccatttttgataatgggttcagaaccaagtttgattaatgttaactgatttatgcagtttttatgttcaactgaaatacatctaactataattttttattggccttccaaaagtgtcataaaataagcctaatcattcacatatcctatcagatgtgaaaagcccatttctatgctttctggccctgccgcaaaatcttttcttttcttctccctttgattttcctcctagaccaacgtagtatgacagaactttgtttggtgatggaaatttctatatcagtaatttgcaaactatagcccacaaactaaatccagcgcattgctgcattttgtgctgctcatgagtgaagaatggtgtttttgcatttttaagtgattgaagaaaaatcaagggaatatttaatgacacatgaaaattatatggaattcaaattttattatccataagtaattttattggaacacactcatgttcatttttttacatgttgtctggctgattttgcattgtgtcggcagaattgaatagttgtgacagagaccttggggcccacaaaaccaatacctgttttctatatctctgctgtcttgtgtgatagctactagccaaatgtggcttttgagcacttgagttgtgactagtgtgggtgagaaactgatttttaattttacttcattttaattcgtctacattttaagtcacatgtggctagtggctaccatatgggacagcacagttgtagacatgccaccttttccctagttcttgcttccttgtacttgactttccttctgctgatgtcttcctggtttctatttaattaatgatgcagactgttgttgcagaattcattaggctaccattgctgattatctcatatgtatagtgcatcagtagcccattggtctcaccaaccgtttgccatctgagttctgttgtagacattctatcttaaggttgcggcagagggcatttatttgctgtagaaaaaggaagccaataaattattgggaaaatatgaaaaattacttagccaggaataaaaatctagtaaaatcattgatgccaaaaattgctgttgatgacaaggacctgtaaatgtgcctgtgtatggtcatgtgtctcttgtaactgtttgtctctttgtatgtatatgttttcattttttcctgagatgttatacttaaacatgtaagctattaaatattttgtgtgtgtttgttttgaaatataacctatacccccagtccaccccagggctcgtagtttattctttgtaaatacacgggacttgtgggtggcgagagattgacatgttcagaactgacagaaggccatgtgccaagtaaagtgatgatggtgaggcctgcaggacccagatcctgttgggccctgggagcacacagtggaggttggattttattctgagtgcattgtggagccattgattggttttatataggagtgacagatttgtgtttataaaatgtctctggctgctctgtggaaaatggattgcagggaccaagagcagaagcagagggaacagttggagacttcttaccttagtagaggcatgatgtgatgggccttggtgacaacagcggagttggagaaaaatgaaaacaattgacatacattttggaggttgagccaaaagactttggtaagaccaggtttgaggcaaatcaagagttcatttaagacaagtcagtcaggagatgtctaagcaggtcatggctagagggggtacatccaggaaccatcaacagagtgggcgctgtcccctagggagagcacagagaggctctttcctgttacttttctttgtattcaatatctgcttggtgaaatcttgcaagtttttaagatgtagcttagatttcattacttttgacacctaagatcagtttgagtttgacacctaggatgagccttttcctttgtttacatgtaaacacctccgtattttgtcactttttttttttttttttttgagatggattttcgctcttgtcgcccaggctgaagtgcaatggcttgatctctgttcactgcaacctccacctcccaggtcaagtgattgtcctgcctcagccacctgaatactgggattacaggcgccttgccaccacgcccagctaattttttaatatttttagtagagacggggtttcaccatgttgaccaggctggtcttgaactcctgacctcaggtgatgtgcccactttggcctcccaaagtgctgggattacaggcgtgagccaccgcgcctggcctttgtattttgtcacttttcacattgtatttatttgcttttgtgcttattccccctctgctttccaccaagtttctcaaggccacatatgtggttttgatgccacatctttgcgtttctagcatttaataccttgcctgcacataatagacccctactaagtattctgttgaatatttggcaataacataagctccagatacaactactgtaattgagttttttgtctcatgaattcaaatagtattctaggaagtttcatataactttgagttttttcatgtatcagtgatcttttagtgttctgatctttgttattagtaacatcttcatttgtatactattttacatgtagttaagcactttagtaaatattcatttgatctacctataacctcttgatttgaattaggcaggaattattatccccattttctatagatagctgaggttcagagagtaacttatctgtgcccgtaactgcgacttgaacccttcacttcttgctgttatctcaagtgatatttctgccacactaaactgctttttctgtgtcactagatttttgaaaaatcagttgctgtgatatattatatactgtttgttttccagagctgaattgatacgtgtcttctgttaatgtaataggattttaaagctggtcaggttccctcacctgtcctctagtcctgtagccttatagagtaaatgaagcctggaaaggtgacatggcttgcccaagaccatccagctaggtaaagcggggtaggcccatggcaaaacagaatcccagtctcctcatttcctgctcagtggatttcttcccttcctgtacctcctgcttcccccaccccatcttttacagttgatgtttctaacataaaggaggtctttccgctttgtagcaatcagatccaacggaagccttgacattatattacggaatttatttctgaaaggagagtggtgtggggggcgcggggatgagtaatatatgtatgtacacaaacttccagctttttttttttttttttaagtgttttctctcctggccgggcacggtggctcatgcctgtaatcccagcactttgggagactgaggcaagtggatcacttgaggtcaggagtttgagaccagcctggccaacatggtgaaaccctgtctctaccaacaaaatacaaaaaaattagctaggcgttgtgtggggtgcctgtaatcccagctactcgggagtctgaggcaggagaattgcttgaacctgggaggcggaggttgcagtgagtcgagattgcaccagtgcactccagcttgggtgacagagtgagactctatctcaaataaaaatgttctctatactcattcagtagcaaattcttttactaaatattcggtataagaaagtgaaggttattggccaggcatagtggctcacggctatattcccagcacttcgggaggctgaggcgggaggatcgcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcagcactttttctgttacctgtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaatggcctagctgagtcagagagaggaagtaattactagaacagtttttttagttccgttctgcttccagcctgaaagatttagtaccaaatatgacagtatctgtcactgcaggctgctagactctagtgtaagaacatagttctatttctgtgagctaactgctgcccttctataaccttcagtttctgccagcatcgtctgcattcaaaccaatgacctcgaggtgaaaatctccagataacatgattggtccccatgctctcatgatttccttacttaagcaattaaaggccaaagcaagatgcttagtaactccttttccacatagaggcacaaataaaggaaagctggtcacaagttttgaaccaaagagttaaaagaagaatcataacttgtctctatttaatgattggaaactctcacagacttctgtgaagtctctcccccttttgtacctttcttacaagtgatgactatatacttttacctggcaggggagagaccacggtcacgaaggtggttttcccagggcgaggcttattcattgcactccagatgtgctgacccctgcgatttccccaaatgtgggaaactcaactgcataattgtggtggtgggggactgcgttcatgcttttccctggttaaattaaaaaatttttaagttattttaaaaatataaaaaacaagatttgactgtattctgccttgcgccactcttgtttgtctttcactagtgcaaaaattgtgatatagctgtcttcatgtaccccgcaatacctggtgcagtaattctgtgcataataatgtatgtctgtttgttgtatgaatgaaatttatatttctaaagaaacatgctagctacaattattgtgataagaaagcttaacaactttttctcattgaaaattgtcacgaaacaatgagcttttcagaaatgatttacttacaaattccatatttgaatgcaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcatgtaagtattttatgcagcccttcttaagagttaggagaatagagttgcatttagtgctattttaagaattattaaacttgtctgcggtttttttttcattcatatatagtatctttccagaaagccaaaaagccttttgttttgtatattagaacattattccattaaatgattgataggtgagttactatattagaattatgttataatgcagcttttaaaataagatcaaagggatctagtatttaacatctgagtttttaatgatcttttaatcttaaatttattgatgctcattttagaaaacttagaggttaccaaaaaagaaatcagaaaactcactgacaacctcctacttctttttaatttaaaaaaaaattttttttttaactatagacaggatcttgctatgttgcccaggctggtctcaaactcctgggctcaagcagtccttccacctcagcctcccaaagtgctgggattactagggtgagctgccacacctggcctcctacttcttaattagttgaaatattttgcagatatatataaatcatattgtgttaattaattttatgcttttttcttacctgtgaatttaccaatccaaatctgatttataaaatgattttaatttttctagtgtatttcgtgttagctgcacaacatgtttatatatgatcatgtaattctagtccatatttgttggaaacattgacatattgacttaataagaccaaaaaaaattgcctgaacaactcaacctcatcagtcaattaattgtctccttgttatagaggcaataatgaatgtcatgttttatacttttaataattgtatgttccctgaatggaccagatagaaagcatgaaactttacacgtaaactcttgaacctgcatgacggtcatcgtgtcttaggtttgctgcttgtcccctggtggtggtgggctctgcgtggctgactgtgactagttgttcatttttaccttggtgagagtttgccagcagggaactgctctctgctatgtcaccaaataatgttttgctaaacttcttgtctgtagtacctgcctgatgtaatgggctgtctgttagtagcttagtaacccagagtaaaactgaatcatccattttaacagaattctgccccacacttaacattttctcctaacagaaaaccaagaattctgcaaaattcttctaagtagaagcagcacaattcctgatattaacaataaataggagtacagaaaaagcttttagaaatttctcccatacctgttaaagtctatatgaatatattaaggggaaactccaggatgctaacactaaaataagaatttcattatatatgtatgtaaatttattgaaaatttattcaaaagtcctctccctgttttcccatcatattcagtaaaaggtgccttttagtccccttttttttggtcattaagcctatttgtatgtttcagagaaaagtttgtttttatctattatcatatacaatatggaagtactgaaaaaatgggtaaaaagagacaaagttattttaaagtatgttttcaaaacatgacataaaattttataaatcagctttctgtgatcacatgactgattagcaaagagaagtcacataactcctatgtggaggacttgtttaattgaaatccttttcttcttgacaaagggttgtcactggccttttagatcttggctcagacataactttcatttgtcttaaaacctctggcgttgccaataaatcacgtgtgaatgcaattctaagtcacaaaacaaagtattaaaggccatctgtacctgttcacattcagactcaaatttcgttagtactttctatgtgaatttatgttttgttttgttttgtttttttctgttttagaactaatggacattgctttgccatcatagaagaagatgaccagggagaaaccacattagcttcagggtgtatgaaatatgaaggatctgattttcagtgcaaagtaagatataatttgggacccatgagacaaagaagggaggggccatatgaaagcatcgatttcccccaggagaaacatgcctggtgtacacatcgctgtatgttcacatcagtaaatatattggaggaatacctactgtctagattctgtcctgtattcatatgtagaatttataactaaatcatttctgaaaagctaattgtttgattacaatttccttttttatttccatagacagcacctggctctgttgcccaggctggagtgcagtgctgcgatctccgctcactgcaacctcaagccagcctcctgcctcagccttctgaatagctgagactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctgattacagttttctttgttctctacttgggaggctgaggcagaagaattgcttgagccggggaggccaaggttgcagttagccgagatcgttccacggtactgcagcctgggccacagagcaagaccctgtctcaaaaaaaaaaaaaaaaaaattcttttttctttttttaaattttaaccgtctttggctactgattacaattttcaatgagaaaaagtttctaaactttcttatcacaataattgcagctaacgtttctttaaaaataaaaattttattcaagtaatatgattatggtaatttaagttccaggttattttaccttaaaaaaagttttaaatcatcctaggttgtcatgactgcaaaaaaattatattgtcacacttatttgtagattataaaatttactgagaagacttttaagatagtggcagtaacctttgtatcactctgagacaacttagaaatgttaaagatatactgcaaactctagggtaaccactaaagttgaaaaaaaaatgttaaggccttgtaaggaggtgtcagtggagctctttaaaagcagcagcaaaggaatcaggatggtaatagtttatgagcatcctgatggctctgggttataaacctgatctcttcaaaattctgcatagtgattttgtcccaggagatccttccagtgtttctgaaaaccagctccagatagaattgtttgtgcataatttaagtctcagctatgttagaaaattgttcctattatttggaaattctcaggatggaggccgggcgcggtggctcacgcctgtaatcccagcactttgggaagccgaggcgggtggatcacgaggtctggagatcaagaccatccggctaacatggtgaaactccgtctctactaaaaatacaaaaaattagctggacgtggtggcgggtgcctgtcgtcccagctactcgggaggctgaggcaggagaatggcatgaacccgggaggtggagcttgcagtgagctgagatcgcaccactgcactccagcctgggcaacagagcgagactctgtctcaaaaaaaaaaaagaaaagaaattctcaggatggatagaaaccttaaaggttatgtttcaacctctcagctaatgtttggaatcacccttgttgcaaatgactgcaaatctatcttcctttctgactctttggaccatagagaacaaacctaatctctctttaagatgacagccctttactaagtaaaaaaagtgcttcatcctactagtctttgcccagtgaaaataattgtccataatgacctcaactgctccttatatgatcagctttagagttattcagtctccacttcctcagtgtaatatgcagaattgagtgtgatatgaccaaggaaaaaagtagagaataaatagccctgttccctttttctaaacatagtcttgtgttagatatttggcagtcatgccatattcttgaaccattgagccttctgtccgctgaagtccctatgctactcactcatgctgctgctaagccacatctcctccactcttcattggtgctgttggtttcttcacacaaataagtagatgggaatggaatgaggttttcctatacagttgttacatacttgtctttatgaattttatcgtataagcattaatcctttgctctaatttgttgggatttaaaggatgctaatttcgttgttccagttttaggctatttgcgtatttatcaagcacacatactatacattttttaatcacttaaaaaattgaagaaagagctatggttagggtactgagcccagcagtaataaccagtgttcaacaggcccctagtgtaggcctgtcctaagctgaattcaccattataagttagttgttaaacttgacaagctgttcaaatctatatactatatatgtgaaccttcggacaaggtgctctgctctcgttttctcatccatgaaggaattactatgaggatcaaatgagatacatgtaaatagtttagcacaattagcacatagtaagggcttaatagatgttagctttgaccatattgattctttaatagagcagtcttcatgctgttacccatatccctgggtacactcagactgtgttatacaagggtaacgggcacgttgatagttttaagggaatcagtttttggatcctaaacttcagtaggtcctgttgctgaatatttctctgcctgagaacagaacttctcaagcagttctctttcccttagtcacttttcatagtcaacccctcctagtttacaaatagaaggcctgaggtgtaaaacttcaaggttccaaacggtgttgtaattcgaagtaaaggcatcagtgtaggctatgtcgggatatcaaataagtgtttacatgacagatggttttcaattgtttgctttcaaccaagttgctggatcattgaaaataattttcgatgataggatctttatggcacttttagcatatgctttggaaggactttaaacaattatgggctgatcgtggtggcacggtggccccagcctgtaatcccagcactttgggaggccgaggcgagcagatcatctgaggtcaggacttagagaccagcctgatcaacatggcgacaccccgtctctactgataatacaaaacttagtcaggcgtggtggtgcgtgcctttaatcccagctacttgggaggctgagacaggagaattgcttgaacacaggaggtggaggttgcagtgagccaaaatcatgccattgcactccagcctaggcagcaagagtgaaactccatccaaaaaaaaaaaaattatgggacaatggtataatagtctccttccgtgatcatcatcttgcttatgtgaatacattgtcttgatgatgacaaaaggaaaaataagaataagattaatgatgaatcttctcactctagcagtaatttttattcatgaattcgtgaactgatttgtttcaaaagtcccatccatatcattaagaaatgcctggccaggtgcagtggctcatgcctgtaatcccagcacttttggaggccgaggcgggcagatcgcttgagctcacaagtttgagaccagcctgggcaacacggcagaaccccatctctacaaaaattagctgggcctggtggctcacgcctgtaattctagcactttgggaggccaaggcaggtggatcacctgaggtcaggagtttcagactagcctggccaacatggtgaaaccccgtctctactagaaatacaaaaattagccgggcgtggtggcacactcctgtaatcccagctacttgggaggctgaggcaggagaatcgtttgaacccaggagttggaggttgcagtgagccgagatagcaccactgcactctagcctgggtaacagagcgagactccgtctcaaaaaagaaaagaaaaaaaaaaaaaaaagctgaggtgggaggatgacttgagcctgggaggcagaggttgtagtgagctgagatcatgcaactccactctagtgtgcggagtgatagctagatcttctatcataaaaaaaaagaaaaagaaaaaatgccctttccaataacattttcttaagtttgtatttaatgaagattgtaacatatatattgttttgatcaattttatgctaataatgattatgataaactagaataattttctaagacttaaagacatacagttataggaaataaaagaatttttatgtacttatctttgatgtggacagttatatattactttaggacgtaattatcatgggagatattgaaaggaaataagagttcaaggagaaataagagttctagtgtaaaatttctcattgctaaaagaagcatttgttcatttattctttaaaatgatgataatgggtatcaaattgcaatgctatttagattctactgaatgcattaaaaaatgatgtaacacttctatttcaaaatgaggtaacaattctatgtcaaagtgtcattatgtacagtaagccagaaattattaatatattgcagccatttaaatttatggtgaaaatttttaagtgtcacctgaaaaatacgtgaaggatacgttgcttttaagaattgggttacgccagcaagcattttgaccagcacttatctaactttctgtatttcttggtaaacgtcacccaagcacagcactcacccaagcacagctctgtcatgctcatcctaaccctttccccagtgtcttcacgcactgccatgtgtggcacagaacagatgtgagtgcctctcaccaggcctcgcgttcttccactccccaggctgcattggtaaattgtgcttattctgtttcctcctataggacaaattatttttcagaaacctcactgccattccttgtaacttggcgtcagttccttcctcatatactgtctccagcctgagcacactgaataagtttatttaagtcagaatcacttaattcatcagtgccaagtaaatttgtttcccacaaaaattcatattccccacataagtctagaaatacaaaattgacttgggcagagggtacgggtggagagtgcaggaaaaggaaaggctgtgtcacccaaattcataatctcgacaaacccaatttttgcctacccagatacatagttaacctgagtaagacagacgtgagatgaggcaggtgttgcttattcttagtgaagccacaatgggtctttagggacttagaagttttttggcttagtctagaatctcatctgggattcatgtcaagcaagaggaagggaagttaatttattgaatatttgttatatgtgtatagtatcctggggattcagtatattctaccttgtttccccccaactactctatagagcagatttttttaaagacagggtattgctccatcacccaggctggagtgcagtggtgcaatcacagctcactgcagcctcaacctcctgggttcaagtgatcctcccacctcagcctcctgagtagctgggaccacaggcgtgtaccaccacacctggctgatttaaaaatttttttagagatggggtctcactattttgcccagcctgatctcagactcctccgctcaagccattctgccacttcagcttcccaaagtgctaggattacaggtgtgagccactgttcccagttcatctttttttaacctgtattttttagcacactaaagcctagagataaattacttgctcaagttcacaaagtgaacaactggcaaagctaggattcagactgtttgattccaaaacccttgtattttctgtaatactatgctccttaatctgttggcagagtctatttttggcttctttttaaaaattattatttttagagatagggtctcactacattgctcaggctggacttgaactcctaggttcaagtgatcctcatgcctcagcctcccaagtagccaccacacccagtttaaagtctactttctttcccttttaaagaaaagggacgtatataacacatatatatataacatatatataaacatatatacatgtttatatgaaatgtttatataaaaatataacattccattatctattgtagtttccaacactccatctttctaaagtctttaaattacacctgtctttcagccatctctcttacaagggctttcatcttcctgggatataattcacctaggttagaatataggaactcataaggaatacaaacgcatcgtaagatctcttcgtacatttgggatgtcgtttcccacttagtagtgtttgagctaccttcgtcatccctgtcagcatccttcatagagaagaaaaaacaagacaggagttgaagaattgttcgtttttctccttatcatccactgtcatgtcagcagtacatctgttgcttggagaaaccccatgctgccaaagaaaccctttcttggtttttctttgcacttttctcttctgcaaggccaagctcattttagctttcctggaaccgtttttggatgcttgacacttctttcattcatcgttagttatatgattttcatttcctcctccatgtgttttctctgaatctgggattatttcagactctccagtttaaccctaacttttttctctctctccttatgatcatttaaaagtaaaaattgtttaaaagttattaataaaacttcatttaaaatataaaatatgtatttggacatttccaaatgctcttgaccatcttcccaacagaatctgaagtcacaggctcatgtttacctttttaaagtcatagctgattatactgaggcttttccttaatttccgcttacattcttgttacttgtgtagtgacaaacagttctttgctattcacatgttggtcagaatggcagttctccccaggctgcagcattcaacttgtcagatattgtgttgttaatccaataaaacatcacatgcaagtgctgctgcgcttccagtgactgtgtccttctctgtgctagctttctgctctcttagggacagtctccttgctggctggtggtctgtaatcagctctcaagaatgctttctgtagtttgtccttccctcaccatggatgctcaacttgcctctgcatcaggctcatgacttccgacgtggctggggtaggcagggtctgcagcgcctctgcacgctcagctgccttgctaaccagccttttctttggactacgacaccctccactttttagtctgatcttaaatctcatccacatctcagtaccacagtgagattatatgtaccagaccagtttatgattgtaattacctaagttcgggtttggtgttctaatctagtgtctaacacaccatccacatagatatgttcttaagaaaagccattttgcagtcttcactatttcagcacaaattttaatctttcaataatctgtttttacatataaaatttgcaggcccctttcactcactgaaatagaaattgtattttatgaatactaaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgtttacattgtttacttttattgtcaggtccgttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttcatgattacttatgattttcttattaatggaatagtgagctttctggcatctgaatgttttcgatctgtcccaagaaacccactgtgttataattcttttttttttttttgcgttataattctttagaaatttggagctccagaattgtttgcatgtagccatgatttcagaagacagttgccaaaaaagaagagtaataagagacagtccctaatggatataaactttaataataaaacatcataccaacctagatacattaatgaaacaagttagtaaacccataaataaacaaacccaagtacatacagcaatttagcatataataaaggaaacacttcagattactgaggaaaagacgttcgcatacctccttgtttttattataattcctcaccctcaacaatggggtaccacagttgagaaatcgtgttttgggtctttctagataatagacttggaatcttctgttagggaggtgatgcgaaagtcatatgattattcagagtaggagatggggtcgagaggagagctccacatctgaggtagccatcatcccaaatggcccccagtgattctcactgcctggggttcctccccttggggccagtcccctcccataacacatcagggctgatctgtgtgacaaataggatatggcaaaagtgacttccaagtctacgttataaacagctttgcagctttcaccatggtctctgggatcactcactctgggggaagccaggcatcatgctatgtggacactcaactctgagagaggcccacacagggaggaactgaggcctcttgccaatacccagcctgcagcctgtcggccttggaagtgagccaccttggaagtgactgcaagctcctgtcaagctttcacatgagtgcagtctcagctgacatctgaccctgagctacccaatcaagtcactcctgaatgcatgatccacagaaacagtgagataacaattgctgttttaagccactcagtttgggagtgatttgctaacacagtattggataatccagtgtccgactttctgaaaattgactttcaagcagtcttcttggtgttattgtcaccctcaactttacttccagacataaccacaatggccagttccgaagttcttgggggaactccatagtataaactggttgcttcttggttttctcaatttctaacctaagaatcagactttttgggtgtgcaaagtcactgctcattcatctgcttcatgaattccaacagtgtttactgttattttatctccttttctccttgcctgttagataaagaagtttaaaactctttattgctgttttagtggactagtaaaagcaagcaagtatgctcaatcggttattttaagctcaaagtccctttgtcaaataactgaatctttgccagtaagacaggtgataatatctcaaggtgattttaatttatattttcatattaaaatactttttttatacattggtttctttattacacaagggcactgtaatgtatatattattttatttatttatttatttagaaatagagtctcactctgtctcccaggtggagtgcagtgatctcggctcactgcaatctctgcctcccaggttcaagcgatactcatgcctcagccttgcaagtaactgggattacaggtatgcactgccacacctggctaatttttgtatttttagtaaagacgggggtttcaccatgttgaccaggctggtctcaaactcctgacctcaagtgatccacccacctcgccctcccaaattgctggaattacaggcgtgagccaccgcacctggcctctaatgtgtatagtaaaatattgttgagtatgcttttatttttcttttaagaaaagaaccatctatatttttatttaaatcatgtattcattttggggggcctgtttttccattgaattgcatagatttttttctctttgatttatagaagctctttatatttcagaaatcagccctttgtaatatgagctacctatacttttctttttttgtttttttttcatgctgcgttacctcagagctacctacacttttcactgtggtgtgtcttgagactgcctgcagtgccttcagccacatagtaaagaaccctatcagccaggtgtgtgctctctaagcaatgggtaggatgtttcttaaggaaatctgttcagcccaagagataaaacctaaaaatactgctgttagggcccagtgaaatggtccaggcagattatcttacagtgaagcttgtaatcagtaaaccctacccatatactaacagcttgccaatcaaggtgtcaggctgtgaaggatactgatctctgagaaaccagaaacaagtgaggtgagccttgtgattgcccaccttcttctccctgaacagagtttcgggttgggcatcacagggggaacccaggtgtagccagtagcctgtctcagttcgaagagttgtgaggaagctaccaagcctagggaaagagcacctgaaatgattgagaaaacagtgtttggtgctcacacaaggctgggagtaggatctgttcacaccagctgtgagagttgaaaaccccataattcataggttttggttgaaggactcaggaggattttgcctcagtggtggggaataattagccctagactaaacatggctctggtctcaccctaaaagcaagccccaaacagatcacaccatttctaagtcactgtatcctagaacaaactcaacagtatttataggaatataaaaatatctggcatccaacaaggtaaaattcacaatatctgccatccaataaatgaatactatgaataaatgaatacatatataaatatggtccataatgagggaagaaatgaagcaatcaaaaccactgacccagaactgatatagaccttagaattagcaattacattaaaatagttattataactgtattttttatgtacaaaagttaaatcaagacatggcagattttgtaaaagaccaaaatgaaactttaggaaatgaaatctataatatctcagatgaaataatatactagatgaaattagtgacagactgtagaagaaaagatgagtgaacatgaagacataggaatgaatagagaatagtgagctgtgggacaacttcagatggcctaatatagatataattggagttcccagaagagaggagggacgaaaaacatacagaaataatgatcaaatgttttcaaatttatctattattattatttttatttatttatttatttatttattttgagacagagtctcgctctgtcgcccaggctggagtgcagtggcacgatctccgctcaatgcaagctccacctcccgggtttacgccattctcttgcttcagccttccgagtagctgggactacaggcacctgccaccatgcctaagtttttgtatttttagtagagacggggtttcatcgtgttagccagatggtctcgatctcctgacctcatgatccgcccgccttggcctcccaaagtgctgggattacaggcatgagccaccgtgcccggcctattatttttatttttgagacaaggtcttgctctgtcacccaggctggagtgcagtggtgcaatctcagctctctgcatactccacctgctgggttcaagcgattctcgtgcttcagcttcccaagtagctgggattacaggcgtgtaccaccaagcctggctaatttttgtatttttagtagagatggggtttcaccatgttggccaggctggtctcgaactcctggcctcaagtgatccacctgcctcggcttcccaaagtgttgggactataggcgtgagccactgcactcagctttttcaaatttaatgaaaaccatgaatccagatatctgaaagctcagcaaaccctgagtataagaaacatgaagaaaactacattaaggcacatgataattgtattgctcaaaaccgataataaagaaatgttaaatgaaacaagaaggaaaaaaggcagagtatctacagaggcacaaagttaaggatgacagcagaccttctgttggaaacagtgcagtcaagaagatagcgaaccaacatctttaaagtgcccaaagaaaaacatcacagactttgaattctatagccagagaaaatatccttcaaaaatgaaggtaatgtgaagatttccagtcatacagaaaacttgaaagaaccccgcccccttagacctacccaacaagaaatgtgaagggaagttcttcgggtggaaagacaggccaggtgaagataagaatccacataaaagaatgaagatccggaaatggggatctaagtgaccctggcacaaactaacaatatcttttaagatgaacaaaaaagactactcatctgagactcaggccatggacactcaagtgagtgacctataacacttcacagaacatacaatcagacatcaggaactggtcatgtaggcttttttatagttctaaactaaatactacatagaactttgtgactgccctgtttatttagctttagaacttcatgtgctagttcagtctgtgaagattcattattgatcagatatatacaatctgtaatttggaatattcattcatatttagttgaactttaacaagtcacaagttgttctccatagcaaaccgtaaaagaataaaattaaagttaaagagaggtctgtccgtcagcatattaaggtttgtctgttttgtttgcctcattaatattttgtttcccttttttctgatgtgatcgttttcctccaatttagatacgtctgcaatttattcttcagtctcatttacattcatgacccatgatcctcaaaacctataccttctctaaaaccttatctggaaccatggcctccctccactgtggacgaggcatcattctgtaccatacgccagttcctggttgtttcctctggcatcttcttttgtagctcctttaatccttcagactgcttagatcctatgatctgcccccataacacttactaattttatcttgcatttttttacattggcaagtattcgtttacttactcatgcatatttgccaaaagtctgcatttccattcaacaggaatctcattggtaacagagattacttaaccattaatattgatgatcaactggctggctgtttaaattgccactttcctattgaattttgaagggtgcccatggtgaatcttgtgtgtccctcatgcttggcacacagtggatacttactcactcttgttgatgtttgccagccaccttggcccagaatttctgcttgggaaatagtatcacggatgcatttgtcagatgaaaagcctgcttctggctttataatggaccctttatcctcattgtctttaggggactcctggtcctagagtagttaaatagtaagaattgaatgatttttttaagttgcagtgattacagcaaaaaaaaaaaaattgccaagtaatgttttatttaataagaaagaaacattttctgaatacctaaaaaagaagctgccaatcagcttttaaagtgattaaaaataagaaaaaatgccctatatgtacacatatttttatcactttcagcactctccatgtatttaattccaagttttaggtccaagttttcatttgataccatattccttctgcctgaagaatttctttaacctcttggagtgcaggtctgctggctgtaagtcctctcagcttttgtctgcagtcttttgacttcattttcccaaggtattttcactggctatagaattctggatgggctcaagtttgtttcccttaaagctgtcactcattatcttccacttgcatgccttctgacatacattttatctttgatgtattatatgtaatttttttcatggcatcctttaatgttttccctttatcttttaaacagctacaatacatttagaagcgtgtgtgtgtgtttcttttttggtatttactctgctttgggtttcactgagcttagtgaatctatggtttgctatctttcattattattgcaaaattatctactattttttttaaaacactttgtccttttggctgggcgcggtggctcacgcctgtaatcccagcactttgggaggccgaggcgggcggatcacgaggccaggagatcgagaccatactggctaacatggtgaaactccgtctctaccaaaaatacaaaaaaagaaattagccaggcgtggtggcgggcgcctgtagtcccagctactcgggaggctgaggcaggaggatggcgtgaatccgggaggcggagcttgcagtgagccgacatcgcgccactgcactccagcctgggcgacagagtgagactccgtctcaaaaaaaaaaaaaaaaaaaaacactttgtccttttatctgtctcttctgtttttgagactccaattatacatattttagattatttggtgttgtgccacagctctttaattcttcagtttttctcacttgttttttctctttgtattttagttcaggtaacttctatttacctattttcaaatgcacagatttttttttttcttcacctgtgtccatctgagctgtgtattgttgagctcatcaaacattcttcatctttaatagcatgttttccctttctcacattcctgtctgacttcatttttctgctgagactctccatctgtgtattctgttaccaccttcaccagttgccttccccttttaatcacagttctgtgaaaggccctcctgacagcttcagcacaagtgctgtctgacacttggcctcttgattgcctgccctcttggcagtgagtgattattccttgctttttaatgggtctcataagtttatttggatgttgtacatcatgttaagaatagcagagattgtcacaatgagatatcaacctcaccccaattaaaatggccattatcaaaaagaaaacaaatgctggggagggtatggagaaaggggaaccctagcacactgctggtggaaatgtaaattggcacagctactatggagaacagtgtggaggtccctcaaaaaactaaaatcagaactaccatatgatcttgcaatcccactatttggtatatatccaaaaggaaatcagtatattgaaggcctgttcattcccctgtgtttaagcactattcataatggccaagatgtggaatcaaccgtgtccatcagcaggtgaatggataaagaaaatgtggtccatacagtggaatattactcaaccagaaaattaatgaaatcctgttattttcagcaacgtgaatggaactggagttcattaatgttaagtgaaataagccagtcatagacaaatattacatgttctcaatcatacgtgggagctaaaaaggttgatttcatagaggtggtaagtagaataacataccagaggttagaaaggagggagggaggttggatgaagatggatggatgaagagaggttgattaaggggcacaaaaatacaattactaatagaaggaataagttctagtatttgatagtacagtagggaaattatagttagtaatttattgtgtatttcaaagtagctagtctttaagagaagaattgtaatattcccaacacaaagatacagcctgggcaacatggtgaaaccacatctctacaaaaaaatacaaaaattagctgggcatggtggtgcacatctgtggtcccagctgctggggaggctgaggtgggaggattgcttgagcccaggaggcggaggttgcagtgagccaagatcatgccactgcactctagcccaagcgacagaacaaggccctgcctcttcttccccacccaaagaaaaacaaaagataaatatttgaggtgatggctatcccagttactctgatttgttcattttacatcgtatacatgcataagatatcacatgtaccccccaaaatatgtacaactattatacatcagttttaaaaagaacaacagacattgaaataaagacatactcctgaaaatgggcatacctcctcttaggctgttgataggcaggaggtgttcagtctagtacgagtcgatttgggttagggttttgttcagtgtttgggcctgtgccttcaatgcctcacaagtttcaaattccttcagtgatgggctgctgttcatttgcttcgagttggggtttaggtgcagaaggaagggtttttctctgagttcctacctcccctgtagctttcagctcttaccacgtcattgcacctctgtgggagtcactgtctatgttcttgttcctcccacagaggtcatctgctgttgcgtgttattcacattagaggacagttggaaagtgaggggggcgtgcctgttgtccttaggtaggttctgtgttgctagaccttaagggtgcagcttcctcagggctcttgcacctcctcccacagaggtagctgactgccctgtggtcctcctgtaggatcctatgcccacaaggagagaggaaggtgtcatcttctcctcttcctcagcatcagaggatcttagcctggtcagagcacagggagcatttcctctacatccccaagaggcagagggactttgctgcttctcctccctccaaagtaatggatctttgcctgtgctctggggcagggggaagagggtgtgcaagaaagaaaacaacagtcatgttatacagcgagggccttgtgtagatagagtttatgtagtcataataatgcaagcactgaatgttgagctaaacaaataatataactgtaaggaggatgtgaggatggaagtatttctgttttgggaagccgcagggtgttaaatgatcagttaaattgtcatattccccagtgtaaggtcaatagttaaagcctaagactgaaaaacttaaaatgtcaatgtaaggatgctatttagaaataatgagggccagctgtggtggctcacacctgtaatcccagcaatttgggaggctgaggtgggtggatcacttgaggccagaagttcgagaccagcgtggccaactagcggaaccttaactctactaaaaatacaaaaattagcctggtatggtggtgtgtgcctgcagtcccagctacttggggttcccaagaattgatcaaaccaggaaggcgggggttgcagtgagctgagatcacaccactgtactctagcctgggcgacaagagtgagaccctatctcaaaaaaaaaaaagaaaaaaaagaaaaaagaattaggtaaatattaaataagcttcaaaaagtcacaattctttattctaagaagtggaaactggataggaggaggagaggagacaaagtatggctttttcattaccaagccatggagaactgtatgacattcaaaggtaggcgaataaagatgcttgataaaattaaatattaagttctataaatataaaatttgatacatttaaaactgaattctaaaagtttataacacaagggtagggataaaggtgtagggaaaataggcattctcatatgttggtggagggattccaactggttcaccctttaaggaggtcagtagggcactccatcaaagttccaaattcagtaattcctactacagatatggtagaaaattgtatttcacacttgaatgcaataagactagaaaccatccaaatattaccagtaggtggccgggcgcagtggcacacatctgtaatcccagcactttgggaggctgaagcaggtggatcatttgaggttaggagttcaagaccagcctggccaacatggtgaaaccccatctctactaaaaaaaaatacaaaaattagccaggtgtggtggtgggtgcctgtaatcccagctactcgggaggctgaggcagggaggattgcttaaacccgggaggcaaagcttgcagtgagctgagattgcgccattgcactccagcctggaggacagagtaagactccatctcaaaataaataaagaaaaataaaaataaagattaccaataggtgaatggttagcagctatacagtggaatactatctagccattaaagaaaaaggtgacactttgtgtacttacgtggaatgataccccaggtaagaagcaagatgcagaacggcatcagtgtctctccagattaccagagaaaccagaagtagttttgtttctaaggaaacagggaaataattctcttctaaggaagtgaacttgatagcttagggatagagctgggaggaggatttttttttgccatatacccttttgtgtcttttggattttaaactatttgagtcaattacccatataaagttttaaaaataaaattataatggttaagtacattgggctatttatatggaaaatactttaatttgtttcttagtttccattatatattatacattctgaatggaccatatgactaaatgagagaatcaatatgttaaaaccaggccaggcacagtgggtcacacctgtaatctcagcagtttgggaggccaaagcaggaggattgctttgaacccaggctggtctcatctcgaactcctgtggtcaaatcaacttcctatcccaggagtttgagaccagcctaggcaacatggtgaaacctcatctctatgaaaaatacaaaaattagccaggcgtagtggaacataccagtagtcccagccacttgggaggctgaggtgggaggatcacttaagcccaggaggttgaagcttcagtgagctgagatcgtgccactacactctagcctgggtgacagagtgagaccctgtctcaaaaaaaaaaaaaaaaaaaaaaattaaaccttgagaacatatttcttgacattaggattggaaggttgtcttaagagacaaaagcatgtcaaaaagagtaaagatgaagtaatttgtctacactaaaatttaaaaactgacataaaaatgccataaagagaatgctgtgataatcatggactgagaagattgttgaaacacaattgtcaacatttggtatacagattatataatgaacgcctacaaatcaatgaggagaagagttcagggaacacttcaattgaataatgtgcaataaacacaaatagattgatcaggcatagtgtctcacgcctgtaatcccagcactttgggaggccaacatggcagatcgcttgagctcaggagttcgagaccatcctgggcaacatagcaaaaccccatctctactaaaaatacaaaaaaagattagctgggcatggtggcacgtacctgtagtcccagctactcaggaggctgaggtgggaggatcgcttgagcctgggtggcagaggttgcagtgaactgagatcgtaccactgcattccagcctgggcaacagagctagattctatctcaaaaaataagtatttgttaaaaatatgagtaggcagttcacagaaaaaaaaaagctgaactgtggaaaaaaattcaattttgctagtaaccagaggaaagcatattaaaagaaggcattgtttcatatctatcaagttggcaaaagtctgaaaatatgacttcgaggtttgggttggaatgtaaggaaatgtatattgtgattatttgaagtcgtatttttttatagctaggatgacacttcacatctgattttgatagtgtctttttacatgccaatacactatagacatctttctgttttaacatgatacatagaactctgaactccatttctagatgtatttaacaggatatattatccaatgataagactaatttggataggattctttctgagggaaggataatggtatagagaacctcaaggtttttcttagggttttatagtttttcatttttaatgtagattgttttctgcttttttaaaagacattattgcaagagcatctcaagcagacgtcgttacaatcgtgatttggaacaggatgaagcatttattccagttggagaatcactaaaagaccttattgaccagtcacaaagttctggtagtgggtctggactacctttattggtaagttaaacgttcctatagacatgaatggtgtgttgatttagaatgtgtcctcatgatggtggacagtataattattgcagatcagggaacaataatggacacatttttttctccttatttagaaagaggtatgcagtattgcaaggtgaaattagttaaaaataagaaatatgaaccaagaaaaatagaatagtcaagtaagatagagctataaaccaggttataggaaccaagtcctacagagaaaggcaggggaagttagatcacgaagtcctatatgaaaggcaagagttagctcacaagttttgctctaagcattttaccagccaacttaaagaggaatcaggtataagattccttgcatctgtaagtttaaactgattgattgagggaactgtaactatttcagattctgaaataaaaaagaagtttcaacagatattcttagagaggatgcttctctcaatatactactaccaaaacacatagttcaataaaaaataattttaaagggaattacaaataaattccaacaaatttggatggattcttggtatcagggaaaaaaaaataatcccagcaggttcatttatatatggaaatactcagttttgggttgaaggaactcttatttgagaggacctgtattatgaacactagatatccagataggtttaagtttttaattgtattagttgaaagaaactgatctcttcttattttattttattttactttattttattttaatcgtatcgagatagtcttgctctgtcacccaggctggagtgcagtggcccagtcttcggctcactgcaacccctgcttcccaagttcaagcaattcccgtctcagcctccgaagtagctggaattaccagatgcaccaccacaccaggctaatttttttttttttttttttttgagggatgaggtttctccatgttggccaggctggtctcaaactcctggcctcaactgatccttccaccttggctcctaaagtgctgggattacaggtgtgaaccaccgcacccaccctgatctctaattttgaaattcatcttattaaataactctaattgaattggaaaggtaaaagtaaaactgccttcataggcagacaacatgattgtttacgtagaaaatcccaagaatggtacaataaaactactgcagccagtaaatgactttatcaggttgcagaatacagagtcattgtacaaataccattgaatttataggctctagcaacaaacaattaggtaattataaaaacagtatttaaaatagcatcaaaaaccatgaaatatttagaataagcctaacaatttatgcaagacctgcacactgaaaattataaaacattgctgaaagaaattaataaagccctaaataagtggagatgtttataaatctgaggactcagtattaagatttcagttttcctcaaattggtgtgtaatttcattcgaatccaaatgaaaatcagagcaaacttttatagcaattgatgtatattctaacatttatatggaaatgcaaaggactagaagagccaaaacaattttgaagtagaagaacaaagaggaatcactacctgatttctggacttaccgtaaaactcaataatgatctcaatttggtactggcataaggatagatgtattgatgaatggaacagattatggagtttagaaaggaacatgcacttaatatggttaattgattaaaaaaaaaaaaacaaaaagatgcccaagtaattcaattggaaaaaggcagtccatttaacagatggtgcaggaaatatcaggaatccatttaccaagaagttaatctcagtccttacctcctcactctataccaaattaacttgaaatgtagcatagacctaaatgtaaaagttgaagtataaaacctctaaaagaaaatgtctgaaaaaattattctgaccttgggcagacttcttcagtacataaaaaacacaaatcatttttttaatgataaatcaggctttatcaaaatttaaaacttctgctatttagaagacaagaaaatgagaagacaagtcacagattggcaaaacagatctgatacagggtttttgtgcaaaatatataaagaccttttgcaactcaataataagataacccaatttttttaaaaaatggacaaaagatttgaacagacacttccccaaagaagatataagaatggcaaacaagcacatgaaaagatgctcagcatcagcagggatatacaaattaaacacagtaagatactactgcacatccactagtatagctaagactgataatattaagtggtgccaaagatgtagatcaactagaaatctcatacattgctggttggaatgcaaaatggtatggctattttgaaaaatagtttgacaattgcctggaaagttaagggcatactttccgtacaatgaagcaatccttctgctaattatttacccaagagatatgaaaacttgtccacaccagaggcctgaatgtgaatgtttatagcagttttatttataatagacataaactggaaacaaccccaaagctcatgaattgctaaatgaataaacaaatgctggtacattcatacagtggaatattactcatcagtaaaaaggaacaacttctaacacatgtagcagcaacagtgggtgaatttcaaaagtactttatgctacatgaaagaagccagacacaaaaggctacacaaaagtgattctcctgcctcagcctcccaagtagctgggattaaggcatgcaccaccatgcccagctaatttttgtatttttttttaagtagagacagggtttcaccatgttggccaggctggtcttgaactcctgacctcaggtgatccacccgcctcggcctcccaaagtgttgggattacaggcgtgagccaccacgcctggccaaaaagtgagaatttttttacgttattaaaatattctgtatcttaattgtggtattggtgattacatgatatagatttgtccaaggcttgttgaacttttctcaaaaagggtacattttatataaattatacctcaataatcttgacttaaaaacttacaggctgaggcaggcagatcacttgaggtcaggcgttcgagaccagtctggccaacatggtgaaaccctgtctctactaaaaatacaaaaattagctggacgtggtggcagatgcctgtaatcccagctgctcgggaggctgaggcaggaaattgttttaactggggaggcagaagttgcagtgagctgagattggccgccgcactccagcctgagcaacggagcgagactctgtctcaaaaaaacagaacaaaatttacaaaaggattctataataaatgatacataaagtcactttagctttgcactaaatctagtccattttagaagcatttccaacttggagcataatgttctttttaatttagaatgatcactaatgcttctgaaaatgaaagataacaatccatgtacatcttttatttaacaaatattaaagtacttctgatattgtcccaaataaatacttatattctgtgagcaggggatggaattcaagcaaatatatatgtaaataagaataaagttatgattgtgttaagcgcagcaactgagaggttttgtgtgctatgaaggtgtttaagtgagaaaatagcactctaagtaaagggaactggatattcaaaaaaacccagcgacaggaataagcttgagtgaattctaaaagttgagataagtcaaacgaggtttgtgggtgggtggtcaaagcaaataatgggaccaggccagatcaggcagggtcttatagatgggatttttaagatctttaactgttatttggactttgctgcataataaaccaccccaaaacttagtgatgtgaagcaacaaacattatttctcattctgtgagtctgtggggcagttcatttgttggacttgcttagctagagctaggtggtgtagttcacacccttggccgacagttcatgctgccattattttttggtcacagggttcccaaagcagcaggaagggggcaagccccagtccacaaacatttgtcaggtctttgcttgcatcacgttcgctgttgttcttttatccaaagcaagtcatgtggcctaagccctgagtctgtggaccaagactacccacgactgtgtgcactgggagggtaattattatgaccatttttgcaaacagccagccacttgaataacctgtttatgatttcagaatacattgtacattgtttcatactttaaagtacattatggccgggcatggtggctcacgcctgtaatcccagcattatgggaggccgggggtggggtggatcacctgaggtcaggagttcaagaccagcctggtcaacgtggctaaaccccatctctactaaaaatacaaaaaaattagctgggcatggtggcgggtgtctgtaatcccagctacttgggaggctgaggcaggagaatcacttgaatctaaaaggtgaaggttgcagtgagccgagatcgcgccactgcactccatcctgggtgacagagcgagactccatctcaaaaaaaaaaaagtacattataagtttttaactggagttggttgggtacaccatgctttttgatgagatggactacccctttgccagtcttaatgggtttctttcatcaagagctcaaaccttttacttttttctataaaggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtgggtacacactgattcagtcaatttcatttttgacaaggctagtgaggtacaggtggaagcctccatatgtgctttgaaaatgtgtgagttcaactatatacatttggctaaaggaaacctagtagaatacacggtttgaataaaacatagtccggaatgccaaccaagatctttctttactaaccagctgaagaaacagcagtgagtttcaaatggaaaataatactagtttattggacttactcccatagtaatgaaaacccagtcttttatagataacttaagcagtgatttagggtaacattaacatatgtgccttttccctttcataagctcaacagcccaacatgcagtttcattgtacgttctgtgtttaatgtgtgtttccccccatctccacatttacacaatagcaaagtaatttaggtgtgagctggtcagtcaggtacataagccgatctggctatcctgagttttcttttcccttcacctcttgttttcctccctttaatttggagagcccatagcatgttgccaagcaggcaattgtattagtttcctagggctgctgtatcaattaccacaaactgggtggcttcaacctccaaaacgtattcactcagttttcgaggctagaagtttaaaaccaaggtgttggcagagctgttgtgtctctgaatactctagaggaggagccttccttgcctcctctggctactggttggtggccaggaatttttggtgttccttggcttagtatagacaacactctagtctccatttctgtcatcaggtggccttctccctgggtgcctgggtccacatttccaccttacaacatcaccagccattgaattcgggcccacgctaatcctgtatgagtcatcttaacttgattacatctgcaaagaccctctttccaaataaggtcacgtttatagatgacatggattttagacatgaattttgtcggggagcactgttcagctcagtacatagcactcactgacctttttctggagggaagagggtaggagagaaaggaaaagagcaggactgtgggcctggcagtcaacgagccagactgaaaaggcagctgtgatgagtcactgatgggcaaatgggagttggcttaattaggagctaactcttagttgaacattcttaattttataaaagtgtccactttttgctttgaaattgagagccttttctactagagaatcatgtaggttgataatattctccaggttatttgtataatatgtcatctttttcttttctttccttttcttttcttttttttttttttgagacggagtctcattctgtcgctcaggctggagtgcagtggcgccatcttggctcactgcaacctctgccgccaggttcaagtgattctcttgcctcagcctccagagtagccgggaccacaggcacttgccaccatgcccaactaatttttgtatttttagtagagacggggtttcgccctgttggccaggctggtctcgagctcctgacctcaagtgatcctcctgccttggcctcccaaagtgatacaggtgtgagccaccacacccagcatatatgatctttttcttaatcctattcactttcatgattattaagattattataaatttattgtagaagtacagttatatgtgtaaatgtagaaatataatttttagtaacacattcacgacttggtgtcaggcgaattaaagtttcactatctgcacatgatacctaagtttttctcagtatccagaatgagcattacttctccctagcctatctctgatgataactaaccttttaaactcatcaactggacaggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacaggtgagtggttctttgccccactgttttgaaattattttaatttccaaaagatatttccctatttgtattcaagataatggaattctaaaaatgtgcatatgcttgtttttagttacataaatgtatagttgggggggattttgttctttttacaaaaattgtgtcctacttctcctatacataattcttgatatatatatatttttttggtgtttttttttgtttgttttttgttttttgttttttgttttttttaaagacagtgtctcactcagttgcccaggctggaatatagtagtgtgatcttagctcactgcaacctcgacctcatgggctcaagcaatcctcccacctcagcctcctgagtagctgggactacaggcatgcactgccacacctagctaatgtttttattttttgcggagatggggtctcactgtgttgcctaggctggtctcaaactcctaggctcagctgatcctcccaaagtgctgggattacaggtgtgtgccatatagtcttagccatccttccatttcagctgatgtaaatctacttcattctttttaacagatgcagagttttccatatgtggaggtactgtagtttattcttaagacccaactgatgaacattaaaggtgtcttcagttgattatgaaaaggttttttaatgaacattgttgtattttaaccatatattatatatttgatccttgtgcacttgtacaagcatttcttcatgatggattcctagagaagggcctgctgaggcagtgagtttatacatattaaactatggtatgttgcatattatttctttcagcagtgtgcctcagtttacacacccgtaagcagtagagataaggatgtcatttttctgtcaccacttgatagtgtcagtattttaaaacaaatgcaagtgttagaaattacaaatttttaggaaacctttgaaaccattttaatcttgtaattctagaatggagtggctgctttacatttcagaattcattttaggctgtaatataaaagtaccagtctttaaaacaactgtaagagacatttaaatctgttacagtgttctgagtcagtgtagtatttgttggctcagatatttatcagatgctataggaaaatacaacgcattatattgatcactgctttagagtaattattactaattgtcagtatgatcatgtaaacattgctaacaacagaactctgttgatgggacccataaagaagaaaatgtaatcctatgtcacaaagccttagtgtatcatatgagagtggtaaaagcaagcgattcctcttgtattttcatattcaccacttctcagacataattatctactactttatcttttttttttccttttcttttctttttttttttttttttgagagagattctcactctgttgcccaggctggagtgcagtggcatggtctcggctcactgcagtctccgcctcccaggttcaagtaattttcgtgcttcagcctcccaagtagctggaattatagtcatgtgccaccaaccctggttaacttttgtattttatagagacagtgttttaccatgttggccaggctgatcttgaacacctgacctcaggtgatgcgcccgccttggcctcccaaagtgctgagattacaggcatgagcaaccgtgcctggcttaactttatcttatattcagtgttgtcctctttcttagacaccagacttatttagtgacaaaacctgacctgaacggatgtgaggtgtgtattgcccttatccagttgaggaggactatcggacttagtgttttgctgtagacacagtactgagtactgagttggattaagagtgctgccccaaccctgctgaggatgtcatgtagtatgtagcatgtatttaaagaaaaatctgaaaaatgctaaattccacaatgcatctggccccaaggagaaaaagaagcttttataaaataggacaaaaatacaagataaactattttatttttggccctcaacttggaccttggctttcttttgtttcagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggaggtgggagtttgagtagtttctgattatgttgatttactcatcattttaaaaataacagctccagttatataactttttagtttttaatttttgtgggcacatagtaggtgtatatattattggataaggagttattttgatacaggcatgccatgtgtaataatcacatcttggagaattggatatctgtcccttcagacatttatcctttgtttcaccaaccagttatactccttgagttatttttaagtgtacaattaaattattactaactgtagtcctccccgttgtgctataaaataccaaatacttattcattcttctattttgtctctacttattaaacatccccccccatctgctgctacccttcccaacctctggtaaccatccttctgttctccatgagttcagttgttttgatttttagatctcacaagtaagtgagaacatgtgaagtttgtctttctgtgcctggcttattttacttaacgttatgacatccagttcctccatgttatttcagaaggcagaatctcattcttttttctggctgaatgatactccattgtgtgtaggtgccacattttcttgatgtgttcatctgttgatggtcacttaggttgcttccacatcttggctattgtgaacagtgctgcagcaaacatgagggtgcaggtatctcttcggttagctgatttcctttcttttgggtatacacctaggagtgcaattgctggcagttacgtaatttagatgtcacatacgtcagagtccccaagaccacccccaggttgtgcgatttcacttgaaggaccacaggactcggcatgtggttgtcccaatggctaacatttatcccagtgaaaggatacaaatcaaaatcagccaagtttagaaaaccaggcgaggcttcccagaatcctgtcccagcggagtcagggcgtgtgcttcattcctcttactagttgtgacaacacatacaaagtgttctcattcgggaaagctccttagagacttggcacccagagattttactggaggctggtcacataggcatcctctgcctggcatgtaccagaattccagcaggaaagcagacgtgcagtacacaccacattgtttgcacaagcagcccaggagtggtgagttaccctcaccgtttccggtaagttttatatccatgtagggaactgtttaccatttgtgtacccgggcactggccaaggccaaaccttgcaagccgcctttcctaagggaaggtctcaggcctgctgtgtgaacccttatctgcacctcataagtctttctactgcagagcaaaatgaaacaaaataataaaaactattcattagtaggaacaaccatataagtaaataattatactttagggtaaatggctgatttcgccttgcttattttttttaaggaagattgatatgccctttgtcgatggactctatcacagttgtgatgacatccctggtggaggtagaggaaatagttggacataaataagagaaaaacatacatctactattaagagtgaatcatagtgtctatattttttcttgtgtaagaatccgttttagttccatagtttagcaaaagatgcttactagattggtatatcttgtccagcaaccatttttgtgcccatgttttctcattcccttatagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaagtgagtggaactcagtcccctgaagaagtgattcgtaaatgccaccaaatatattctctgctcactgaacatctctttacttttcagtgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccaggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccatttttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttatacttctttaatgctttttaaatatttattctgagcaaacaattcatgagtacatcaagtgagatagttttatttgattataacataaaataaatgtgattatatcacatcatcatcaaaaaggtttaaattaaatgggaggaaatcagcatatgtccacccattaccaaaatttgactatcatttaaggttaaaacttacaaatttgtctgcacatcaaatttcacaaatttgaaaattgccttaaccattttgattaataagtttcatctgccataattaaagtctgaagtgttcatcaagataagtaaatttgcatatggataatacccaataacttgttttttcagaatttttcaccatatgtatactgagaaatacaaatattttaatctgcgttgccatatgatatgattgcacttagaacacccaatttacttaaatcttggtttacttttgacttgataccataatctttaaaatcatttgtcatgttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaatcccaacactttgggaggctgaggcgggtggatcacaaggtcaggagttcaagaccagcctggccaacatggtgaaaccccatctctactaaaaataaaaaactcagccaggcgtggtggcgggtgcctgtaatcccagctactcgggaggctgaagcaggagaattgcttaaaatcagaaggtggaggttgcagtgagctgagatcgtgtcactgcactccagcctgggcaaaagagcgaaactccatctcaaataaacaaacaaataaataacaaaaaacaaaaatgttgcattaaacttagttcttgtctctcctttccactcttattcttaaatctgaagctcatcgactaagtgaaatatttaaagaatatgataggccagcaagaagaagtattatgtagtaccatagttagtaaattcgtaaaaccttggaagccattatttggtcccacttgcaatttagtgtttttgaagtgtgtagcttcattcagatagc

SEQ ID NO: 12347 - DNA, 30418 bp, Human
tttctctactagctatttagtgaaattgctagactaggataaaaagaatacctaatacttaaatgtgattacaatatgacaaccaaggtcctaatacatatatatgaattcatctcacaaaaaccctataaggtaggtactattttcttcccattttatcaaagagacggactttaatctaccaatggtgggtaaatgttgccaaagcaatgtgaaatccaggcagaatgctgcatttttagtcaatgatttaaaattttgagcttttctgttcccctcaggcctgatcgtaccccaatggaatcacccaaatacttgatgctgagcctttctatggatttatcagatgaaactttggaaagggacttttttttttttttaagacagggtttcgctgtcacccaggctggagtggagtggcgcgatcttggctcactacaaccgccgcctgccaggctccagagagtctcccacctcagcctcccaagtggctgggaccacaggtgcatgccaccaagcccacctaattttcttcttttctttctttcttcctttctttctctttgcttctttttctttctttctttctctgtctctttttttttttttttttttaagagatggggtctcgccatgttgccctgaggtctggcgatctaccgactcggcctctcaaagtgctgggattacagtcatgagccagcacgcccaactgagagagactatgatgttctccaaacaaatctcatttggttgaaactctacagctgagtatggtctaatttgagtagtttaccttgagtactctaaccatggtctatagacctgggctcttctgagaactgtttgcaaatggttcacagagagagagtagaaaactctatgtcaattttgcaggtaattttatggctgttaactctaacgataaaaagttttgacttggactttgtatgtcttttcatttttctgttttattaacttgtcaaaaactaattgaaaattgaaaaaaataaaccgaccgttcccccagtgaagagaagcactgctgtaaagcttttcacactcaaatattaccaaactctaaggtcgcttctgaggcctaactccccaaaatgatgcctcggatatttttcctcgccttatttcttttttttctttttctttttttttttttttcctttttccttttatttgagacggagtttttgctctgttgcccaagctggagtgcaatggcacgatctcggctcactgcaaactccaactccgcctccgcctccgccctcgcctcctgagtagttgggattacagacgcgcgccaccacgcccagctaatttttgtttgtttagtagagacgaggtgtcaccatgttggccaggctggtctcgagctcttgacctccggtaatccacccgcctcgccctcccaaagtgctgggattacaagcgtaaaccaccgcgcccgacctcctccccttatttcatccattttataattcacattattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacggatccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggtgagtgcggcctgggagaactcggcacggtggctccggagctggactgggaaccggcctaggggcgaaagtctgtcgggcgcgtgcccacgacgtccggggagaggaaacccagagagttacccttggtagggggagccatagaacctgctcgggaggtgcttcctggatccccgccctgcttaggtccccgcccttggcttgggtcctgtttgtatttggcagtttggccccccaccccgtcgcttttccgtttctggtagttgtgctcgggatggaaccttgcccctcctccgctcccccacccttttaccctggtgtgggtgaagtggctgggctacgatggttcagtatttatgaccagcgtccgtcctggtacagaacaaagaaacttggacttctggtatgcctcgtaaccgcggggaatagacacggaagcagcataagtaatcagggctttaatagatcttccctagtacgctaaaccaaatacagagtgtgtacgtcaaaagccgagtccccgcgtgaatctagacacaaccctttctgtttaaatacctggcaaaatggtttggatttctggatgcatttcatgccgctggagagttacttgtctgtgtcttgtgagctctttgacgaaacagcttttccggtgttgcatcaagatagttacggtgcctcctatttatttaattgaataaactatgtgattgcattttagtgttgcttttttcattctcaccttctcttgattaggatctctatttcacctaatacctgatttcgtattttcaattaaatgtagtttttctaacattttataggaatctctgcaattgtagaaacaaattctgtaatttgtaaatggatgtttcctcaaagttacaactgaccttacccaattaagttacccctgcagactagtttcttgatcattttgcacatattcttagttctttttggtttacattttctctaaactctattcctagtcttcatattctctagtgcagcctaatactgctgggcttagaccggaagtatgacagatccacttctgcaaacggaacttgaactagattatcataagtcagtgctattatggtcttcaggcattacaagccctttgaagctaagtgcggccaaatcaggcattacaggcttcttctgtataaaattgccagtgcactggagacggtgtgctgtattagaaacagttccggactagatatggggaccaggatgtagtgtcattgcctcatatataagataaaatgatgataacacaagtgtcatgcatcccaaagttgctggttggaacatgagatgatggatgtaaaagtggttagtaaatgtgaaaagcactctggaaaagttctgttcattctatctggagtaatgctggtagaaggagcaatagggaggaaggtgtcagagaaagtatatgtaaccagatctagtaagttaccgggctgatagattgaaagatgtcttgttactttgggtggccaaggtgggcggatcacctgaggtcaggagcaaaaaatgataaagcaatgagatgagacaaacctggccaacgttatgaaaccccatctctactaaaaatacaaaaattagccaggcatggtcgctcgtgcctgcaatcccagctactcgggagactgaggcacaagaatcacttgaacctgggaggtggaggttgtagcgagccgagattgcagcactgcactccagcctgggcgacagagtgagactccgtctcaaaaaaaaaaaaaaaaggatgaaaagatgtcatgttacatcctataaagtaagtttacatcctataaagcagaatactagtataatgtggtgatagtaatattccacgattatagttttattttgcaactaatatttctaactacaacaaactgagacatcagttagtagattatctttttaaagatctcagcattttcaagtgtgttccgcatagtgacaataaatgtaacttttgtaggtggcacagtcatcttttgatttattttcacaatttcgagagaactcagcaccattctagtttttcctctaaattttgtgttaacatttattttattttatttagcttttttgagatgcagtctcgctctgtcacccaggctggaatgcaatggcgcaatctcggctcactgcaacctctgcctcccaggttcaagcgattctcctgcctcagcctccctgatcgcttggattacaggccagtgccaccactcctggctaatttttgtatttttggtagagatggggtttcaccatgttggccaggctggtcttgaactcctgacgtcaggtgatccgtccgcctcagcctcccaaagtgttgggattacaggtgtgagccaccacgcccggcttgtgttaacatttctgatagagcacttcatttcattgtttgaaaactaccctcatgggagcaatgacaagcacatgtctaggattttttcaagcatgtttggtgatctcctaaacatacaggctgttggttaaaaagtgaacataaatgtttagaatgaaacctttttgtttaaatggggaagtgaaaggcttgcccgggcgtttccatctgcctactgtaattgatttccgcataaacggtcattactggcacctattgcagcaccagtattaaactgcatatagtaaaatcactgtgtaaaattgtgttataatctaaacagttctaatgcgatcttaaaaaaaattgtagagacagatctcactgtgttgcccaagctaggcttgaacttctgggcttaaaccatcttcccaccttgtcctccaaaggtgttaggattacaggagtgagccactgagcctggcctaaatgtgatcttaacatttaatttttgcttatgttgctaaactgcctggggaaagctgcttcatcctggttggatttaccagtactcctcccccttgaagctatgtcagaaggaatcaattatctctttgatttttaacctaaggtcaacaactgttttgaatttatctttatgactgcaacaagtaagtggcataaggatgtgccaccactaccaagagtcaatctattgagaaatcaagttattcctgtgccaacaggttattttaacaaatatcatcttaaagtgttatttcccattctaatttccaaaaaaaaatacatgaacaagaaatgggaagcaacaacagttaacttgtgagtcagcagtatcctgattttcttcgaagaggttgtggttatattaactcctttcttgtttgtttcctgttcttaacagctgtttgatgataaagtgcttccaagaaacagtactccctcaattgtttaaattgttttgatctacctagtgtacttttcccctaaaattcatgatgaaatggtagagtaaatctatctatatctccctccccaagttctgtttaactagataattgattatcctcaaactaaatatccatgtctatgtgctgaggtattaacacatgattcaatatgatattaaggtaaaaatggaataaataggctgagatagctgaaagacttgggctgcctgtgtttcgaggagctatttagtttttgttgttgtttgttttgttttgttttttgagacagagtctccctttgtcacccaggctgtagtgcagtggtgcaatctcagctcactgcaaccttcacctctggggttccagcgattctcctgccttagcctccatagtagctgggattacaggcaggcgccaccacgcctggctgattttttgtattttttgtggaaacggggtatcaccatcttggtcaggctggtctcaaactcctgacctcaggtgatccgcccacctcagcctcccaaagtgctgggattacaggtgtgagccaccacgtccggcctcaaggagctgttttcacagagacaaacttgttccattggttaagcagctgaaaggaatggattgtcttctagaatttcccaagataaacctttcctcttaccagtgaggaacaattttacaaatagaaattaatattgctggtgtgtagtttcccacagaatatttttgttacatttttatggggtaacacgtgacaaatcctattcatgtagtttaataagcaaaataagcctaagagattgagcaaaggtttgctgaccagtgtccataccctacaggtaagtattatttacttaatttttataggcctgttatgtgctaggcaccatggtaggtgttgggaatatattgggtacaactttcagtttctgcttttatttttgaaatgctaaatatttttctgagtatttgagatatttgaaaaagacacccagacaacatcctggtgtttttttcaacacacaataaaaaggtacgacaagataatagaaagcttttctgattattgaatttaggaaaatacatcattcgctttagagtgagtaccaaagacttaagaaaagttaaacattgggaaatacagtaaattaaacatctagaaaagacttagcagttttcagcctttagtcatagaatgctttggtctcacttgagcattgtaattctagagtagtaagtattttcaccatttgggcttgttgattgtaattgtgggctcctttctactatttctgttctaaacagaggggattgtttggtaaggtaggtgtccctctttttgtttatttttccctcccaacagagaaagtgctaaataagtaaagattattttaaatgtttttcattaacttataaaaactgcctagatcattgttttcccagagaattaaaaaccttactcctatatgtaaatgactttttcaagcaaataagttggtgtggaaaagtcagcatctaccattttttttctgtggtaacaagtgtatcatcaaacattgaaaccttttgggaatgtttaaaaccttctcttgagggtaagtaaaaattcaaactgggaagagagtcttccagccttggcagagatacaaatttagtttaccttgtgaaatctaacacttcaggatatttccattgtaattttgtcattacggaacataaggcttttttctttgtaactttgtgcatcttttgaatgttgacgtagcagataagatagctataggacatgaccacatttttcttttagaagactggttgatgtgaatggctgacataattgattttatttaataaatatcttttaaagtcacagatagtattgttttaaaaatcaaatggtatagacggacttactatgaaaagcattagtcattttctgcatttcaccctctttcctctgctactggttttgctctgtcacccagactggagtgcaatggtgtgacctcggctcgctgcaacctccacctcccaggttcaagcgattctcctgcctcagcctcccaagtagctgggattacaggcgcctgccaccacatccggctaatgtttttgtatttttagtagagactgggtttcaccgtgttggccaggctggttttgaactcctgacctcaagtgatccgcccacctcggcctcccaaagtgctaggattacaggcgtgagccaccgcgcccggcctagtgtcaacgacttttaactttatttttagtactgctagtgatgctccgtatctcttaaatatgttactgcaaaaagaaaagaaaagaacagaaatatgttactgctgtttgttgaataactttagacatctattgacttgaatgtaaatgaactaaatactcgtgtatacctctttccttctatagttttcactgttttgttgcattgttaaccagttgatctttaccttacctcaacttctatttcttactccatcaccagagggagtatctctagatttcttacttttaaaatgaggatattggcactcacgtgattccttggaaaaactaaaactaaagttcatggcatatgttaaaatacgtagttgcataaaagggcattcaccaagttcagtgtttgaaaacatatgccgagctatatgagaagggcatagtatagatatgaaacaaatcaaaagattgcataattcatttacgggacaagttattgaatagacttctttaagtggctcaggaattgtggcatcaaactattgagaaggaaatatgaaagacagcacaccacctgactctgctgaatcatgagtttaaatattattgatttactattatttacggtctagaatcaacctctatccaagggacagaaaatttaattatgagtctgtaataaagaacatttttatttcttaccccacttcaaattttttaatataatccatagtatgaaatatattttcaatcataacctgagatactatacatgcaactgaaaacaagtattttcactgaacagtatccttactataaacagtatttaactttcccagaatatatgtagtctgagtattctcttttctttaaaaaaaaaaaaaaattgcaaccctgtaaatgaatttcatgaccagaccattgtactaaacatcaagtatgaactaatatataagattatcacgccttttcagtggataaaaagtaaagtggaaattaagttatacatttttctctcttcataggacattggctccctggattatcaagagtttgtagttgacattgaatccaggctgaggatggaaggtgtggaacttaaagaagaatggcaagatgaagattttccgatgtgagcaatgcttttaaaagaaaacaattttagagcaaaacttcaaaatttctttatcgagatgttactttttttttttttgagacggagtcttgctctgttgcccaggctggagtgcagtggcgcgatctcagctcactgcaacctccgcctcctggattcaagcaattcttctgcctccacctcccaggtagctgggactataggtgtgcgccaccacgcctggctaatttttgtatttttaatagagacggtgtttcaccatattggccaggctggtctcaaactcctgacctcgtgatctgcctgccttggcctcccaaagtgctgggattacaggtgtgagccactgcacagctgagatgtcactgagaaactcagtaatacaaggcgatcatttgatactaggaagtaaagtttcttcggaacagttagattgattctcttgtatcttactttccaaccaagtatatatataatcttctataatctttcatttttgttttggtcacttaagtttgcaaatttttgcttttataataaagtgttttagtgtggtttgtttgttttgttttgtttttgttttcatttaaacaagatctgagggattcctcagagaaggaggtctttagttgtctttaaaatgtttctttaattttgtggccaggtgcggtggctcacgcctgtaaccccagcactttgggaggccgagataggcagatcacttgaggccaggagtttgagaccaacgtggccaacatggtgaaaccccgtctctactaaaaatacaaaaaattagccaggcttggcgctcgcctgtagtcccagctgcttaggaggcagaggcacaagaatcacctgaacccaggaggcaggggttgccgtgagccaaggtcgcgctgctgcactccagcttgggcgaccgagcaaggctctatctcaaaaaaaaaaaaaaaaatttgtgggttcccccccaccaaaaaaaaaaaaaccttactaagtaaattaataaggattttctagcttatctggccagccaccttgacatgtttgcatttgtatttacaattatattggcaccaggtaggctaatgaaaaagagagcaaaggcagaccttaagtttaaatagtgcttccgtgccgtacttgtcagaagacatcctagtgcataatcaggtgccttagcagttggatagcttagcagttggacagctgatcggagacctgagtcactgttgcatatggtggtgatagtaaatataggaatgctgatctcagaagaattgaaccattgttactgtagtctcgtgagtaaaaattgagcttcatacattgcatcatacatcacattatatttgtgcatttcagtcatatttgtttaaaattgttacctgttttataattgtataagagctgttgcataaggaatttatatctacttttatgtgttacttatatataataagtgtataagtcagctctgacagtcagaatttttactttgaaagtgtagccaggcatagcagctcacgcctataatcctagtgctttgggaggccgaggcagaaggattgcttgagaccagcctgggcaacatagcaatacccggtctctaccaaaaaaacttttaaaattagctgggcatgttggtgtgccactgtagtcctagctactcagaaggctgaggctttatcttaaacactgctaggctgggcacagtggctcatgcctgtaatcccaacacttagggaggtcaatgcacgagaatcgtttgagcccaaaagttcaaggccagcctgggtaacatagcaagaccctgtctgtactaaaaattagccaagcgtcgtggcacgcacctgtagtcttagatactcgggaggatctcttgagcccaggagttaaggctgcagtgagccatgattgtgccattgtattccagcctaggtgacagacagcaagaccctgtctcaaaaacaacaacactgctttattccattttccaaataattatttctataagctgtatgtttaatagattgaacttcaaaaaaaaattctttcttaatttctggattaaaaagtatgcctgtgtcttctagacctttaccagaagatgatagtattgaagcagatatactagctataactggaccagaggaccagcctggtaagagcttgacacttactttcattgaaattatggactttgtgttattttttaaaacacgtttctttgtccaaaaaaaaaaaaaacttgagtttttattccatcatagaagtcaaagtataagttgaacattgaggaaagcatttttagaatgctttaaaaaaaattccaaaaacatacacttggtttttggaaagttttacagtaaaggggtggaggagatcatttttagtggtaagaggtatctataaggtctgcctctatttaaaagacattgatactttattgatctcttgccaacgatgtagaagcaataatgatcagaataaaaattttgtgaataggtgctttgaaattatgttcaattaatattattttttcccaagaatggggtagttaaaatttttcttattcaactttagcatctaagcattccttgttacgtatctttttctttattttccaattccaggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaaggtaaatgtttcactgtttttaatctgatctttattaatgtactaagggattttgtttgaaatacatcattctttctaaagttcatatatttgttactaagataggaaattgtgctaacccttgaatattctcaaggacttaaaaagtgtgtatagggtacaccagtggcttttttcccctcttatttgcccactgctctcatgtttttttcatagctgtttcaaaaatatttcttgataattatggcatgctcttttttagtcaatcaagtaagaaacttttgaagagacatatagttaacagtttgtgggaagggagttctgaaaggaggcatttggggtgactttttaagtaggtttgcctgacattgctctactttgtgaaatgaccaacttaaattaatgtatacttttagcccccgaacctagtattccttattacttgtaattcaaaggaattgtgctgttttactttgcatgctttctttaattacaaaattgtctacagtatcttatatatagttgttataatttttacatatttttttccatcttgaaaatgattttgttttcatagtagtgtttagcattcagtattttactgtaataaagtgtgatatgctatatttttggtttcttttttcttccctgttttactggttcaataaacagtccagtagtaagcaatactttgtaaagatactgaaatagttttgtgcctatgtgttttgtctcttctttctttaatgctgctgtagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagatttaaaattgtgcagatggtataatgaaaattctctgtaaaatctaggtagtaaagtggttaacgtataatttgatttttgttgtgtaacaatttgtgattcaaaaactttttattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggtaagagttactgaggatttttcagattgtttaatgcaatatcagaattcttttttttttggaaggatatctgtttattaagagtaaataagccctgtacagaacacaggcgctaggttgagagactcgtcttttgtaggacatttcttcctgctaaccagttcctggagggcttgttttttttgtaactttacacaaggggcactaatggaaaatatagctttctcaagacatctgatgtcagtttcccattgttttgcttcacaaacatcaacaaagtaaacctgaacatgcttagcaatttcccaatgttctttgctgacattacttttgacatactgtgtcaaaattcttaaggtctcccctcctttggtaaagtaggcaaaaccttacaaggaaaacactataatacgtggaaatatactgagttagatttccagtcacctgctctatggctctgagatgcactatatccataatggttcctaggactgtgtccacctgatggtttggagtacggaaaaccaacccttatggcttaagagtcatctcccatggaagacaatgctggccttctgaacgctggggctcatgggcttgttgatgtggctttctggtgtgccaggatcccctggcagctcctgtatacttcagtcaagcagtccagccggggcttggcactctggaagacgggtactacttgggatatcccatgtggttccactggatccttcaataagatgcagaggtagtaaatcaccttctgcatgtaaatagcctcattgatgacaatatccttgaccttgcccatttctatgaaggtagtgctttcttagcctgaagcataagatgaagtcatctgaatgccaagggaatcaatgattaacagtctcctgatcaatcttcacaaaatggagataaccaagcagacctaagagggtgatgaagatggcagcagagaggatcatgctgttctcgcagagggtgaagagtccgtaggctgccagccacaccgtgcaggtgacagcggtgagcgaacgcagcgagagcccagggcagctgaggcagaattcccggcaggaagggaagtagtagcggcgctgcagggccaggcggccaccgcagatatccgaaaagctccgctcatcctccatgacaccccaactctgccgcccgcaccgcaccgcgcggcactccactgcgctcgcctgccctagccgtttcatgcaatatcagaattctaaatacttttagaaactctgcctagagatattatgtaattttgaaagaataataagcatttctcattcattttagaaacatgacaggtttaaagtaaaagaataaaagtaccatttaaaaatgattatatgcatacagtaagttgaaaaagtacaaaagaatttgtagtgaaaactgtcaggttgggcacggtggctcaggtttgtaatcccagcaatttgggaggctgaggcaggaggattacttgagcccaggagttcaggaccagcttgggcaacatagacctcgtctccacaaaaaaataaaaaaaataaaaaaataaataaaattagccaggagtggtggcatatgcctgtagtcccagctacttaggaggctggggtgggaggagagagagcttgagcttgggaagatgaggcttcagtggccgtgatcatcccactgcactctagttttttgttttgttttggtttttgaccctgtctcaaaattaaaaaattttttaaactgtctctaggctacccaaaactgggactgaacagtctccctaatttataaacagtgaaatgctctgatcttaagtgtgcagttcaatgagttttgacaaatgcctatataaccatatatacccatatatataaaacccatacccctgaaaatgtagaacattttcattgtcccagaagaattatttagtacccctgtgcaatgaatactcaccttcggtagccactgtcatatctaccccctgattagttttgcctcttctagaatttcatatatagtaactaaaatcatcctatgcactcttttgtttacttttcagcatgaagtttttgagattcatccatgttgttgcacgtatccacagtacattccttcttattgctgagtagttttccattgcttggataaaccataatttgcttatccatttttttttatgtgcatgtgagttgtttccagcttgggctgttataaacaaaactgctttgaacattcttgtagaagtcatttatggatataagtaaaacttggactctttttgttttgttttgttttgagacagagtcttgctctgtcacccaggctggagtgcagtggcgtgacagctcactgcaacctctgcctcctcggttcaagggattctcctgcctcagtctcccgagtagctgggattacaggtgcacgccaccatgcccagctaattttttgtatttttagtagagaaagggtttcaccatgttagccaggatggtctcgatcacctgacctcgtgatttgctcaccccagcctcctgaagtgctgggattacaggcatgagcaccgtgcccggccctaaaacttggactttttaaccttaactcttaatttgccttaaaaccgtgaacaaatttttttttcttttttttttttttgagatggagtctcattctgtcacccaggctggagtgcagtggcgcaatctcggctcactgcaacctctgcctcccaggctcaagcgatacgccagcctcagcctcccaagtaggtgggactacaggtgcacgccaccacgcctggctaatttttgtatttttagtagagacggggtttcaccatattggccaggctggtctcgaactcctgaccttgtgatctgcccgcctcagcctcccaaagtgctgggattacaggcatgagccacagtgcccaggccaaattattttttaatagagaactagttcactccacacttctatacagcacccactttccatacttatgggatatacaaaaatacaaggcttaagtccctgcccttaagaaataggaaaagccataaaagtttaagttataaatcctttcaatctaacagtaccatatatagaagttaacctaggcacattgtaaatagtgctagaatgttagtggtaagtcagaacacaactcactgtagagcatgacatactaccttaaatcctcctaacacaggacggagggcatatgggtcaagcagattgattttttttcagggtcatttccacttgatttactctctgccagatgcattcccctgcttatttctacagtcttcattcatctgaaagcaaatcacatgaatatttgtagttgcattcttctgcctaatttaatcgtactcagatgaagaaaatggcgtaatctgcatcaggaagtccacagacatacattattcagctagttcacaggaatcaaattataagacctgatttatggcttaaatctcttatctttcagaaatagcactttttttataggggaaaataagaccaccttattttattgcattaccacacttaatatattttgtgactgagtgattaagaaaggtagtgaagattctgatgttcttgaaatgttcaaatcttttcatgtgcaaatttgtaagcaatagaaatgaaggttaaagcagaagtatttgctactaaatattggcttaatatctaaagactgctgttgaaacatacatattttagcgctgttttccattactgaaaattatgtcagagatgtaatttagtttgtttttttgtttttgttttttttttttttttgagacccaagtcttgctctgttgcccaggctggagtgcagtggtgcagtctcgactcactgcaacctccgcctcccaggtttgaatgattgtcctgcctcagcctcctgagtagctgggactacaggtgcacaccaccacacccagctaattgtttatatctttagtagagatggggtttcgccatgttggccaggctggtctcaaaattcctggccttaagtgatctgcccacctcagcctcccgaagtgctggaattacaagcatgaaccacctcgcccggcctaatttagttttaatgtcctaatttctacaaaatgctagcatttttaaatataaacttaccttttaaaaatcacccacttatggctctggcgatgtggctcatgcccagtgctttgggaggccaaaggaggaggattgcttaaggccaggagttcacgaccagtctgagcaacacagtgaaaccctatctctacaaaaaaaattttataaaggttaaccaggcatgtttgtgtgcgctgtatccccagctcctctggaggctatgaggtgggaagatcccttgagcccagaagttcaaggctgcatgagctgtgattgtgccactgcactccatcctgggcaatggagcaagatgctatcctctaaaaaaaaatttaaaaaagcacccactttgccgggcacggtggctcacgcctgtaatcccagcactgtgggaggctgaggcaggcagatcacgaggtcaggagttcgagaccagtctggccaacttagtgaaaccccatctctactaaaaatacacaaaaaattagccgggcacggtggtgtgcgcttataatcccagcaactcgggaggcaggagaatcgcgtgaagccaggaggcggaggttgcagtgagccgagattgtgccactgccctccagcctggacgacagaacgagactccatctaaaaaaaaaaaaaaagcacccactttaaccataagcatcatagaaataaataaaaatacattgcagttattgtattgtgtctgtattgtattgggttatatcactatatttgtctacctgctaaaatagggctggctttttaaatatgcgaatttaagtggtcttgggtttttttgttttttctgtccaccgtcctctttaaattttactgttctctttttgggaagaagacattaaaattctatataagaccatataagatttacaaaacatacatttaatacagaaatctgtgaaaagtaaactcttatttataatttactaatcatacagatgtcttctaaaaatgcctaagagtaaaatcgtgctggtgatactgtctttggtttcttttttaggatattatggggatggattaaatgccattgttgtgtttgctgtctgtttcatgcctgaaagtagtcagcctaactatagatacctgatggacaatctttttaagtaagtatatattaaacaaaaacatttggacagaattctgagctaattagatctacaccttaagaaacttaaccttttcaaaaattataaatattccagttctttgggagactgaagtgggcagatcacttgagtccaggagttggagaccagcctaggcgatatgacaaagctctttctctacaaaatcaaaaaattagccaggcatggtagtatgggcctgtagccccacctactcaggaggctgaggtggaagtatcacctgagcccatgaggtcaaagctgcagtgaactgtgattttgccactgcactctaccctgggtgacagagtaagaccctgtctcagataaatatatatcccagatctgttcacgtgcaagtttgtgacacagaatgaaggttaaagtaaaagtatttgttactagatacaggactagatgagccttattctttgatattatgaacgatagtttccaattcaagagaaaaattgtcattttaaaactgggaaatatatctcagattatttgttccaactttgtatcgatttgttttgagatggagtttcactctgtcacccaggctggagtgcagtggtacaactacggctccctgcagccttgacctcacgggctcaagccatcctcctacctcagcctccctagtggctgggactgcaggcacatgtcaccacatcctgctgacttcttaatttttggtagagacagagtctcactatgttgccagggttggtctcaaactcctgggctcaagtaagccaccatgccttacctgtcccaactgttttatgttaacatttgcaggcacattaagtgtaaagaagtgatttttgtctcaaaatcatgtggctaaattacatttacccctagaaggccaatataattgagccaaatcagttctttttccacaaggtcattctatttctcaggttagtgcagtttttaaaaaccgtattgtggaaagtttcagacatacacaggggtaaagagaagtatatcaaatcttcatgtatcagtcacttcaacaattaccaatttatactttgttcccacttctaacccccagtttacaagtttgaagcaaatcccaggagcaaatcatttcacctagaaacatttcaaaatatatctctaaaaaataagataatcgtaatactagctaatgcggtttgagcattttcattgttgctctcattgtaggagagaggaaggaattgtataatggtacaatttagagaacctagttcagttatgcacagtgatttttaaggcttaaacttaatttgttttttacagatatgttattggcactttggagctattagtagcagaaaactacatgatagtttatttaaatggtgcaacaactcgaagaaaaatgcccagtctgggatggctcaggaaatgttatcagcaaattgatagaaggtaatacaaatacaagttgaaagctagtctgaaaaaattttataatggctttaggaaatcaaactttgtttttcgttgctattttttttttttaactttttttttttttgagacggagtttcactcttgttgcccaggctggagtgcaatggcacaatctcggttcaccgcaacctccacctcccaggttcaagcgattctcctgcctcagcctcccaagtagctgggattacaggcatgcgccaccacgcccagctaatgttgtattttttgtagagacggggtttctccatgttggtcaggctggtctcgaactcctgaccttaggtgatccacccgcctcggcctcctgaagtgctgggattacaggcgtgagccaccgcgcccagccttctgttgctattttaaaacaccatttattttttaaattttatttatttatttcatggcaggtttctgttttctaaagatagcattttagaatattgtgagggaaatcaattttgatttttctataaagaataaccttaattcttcaaacttacaaagtagctttatatttctccttatttaattgaagactttctccttatttataagatgcaattttctccacattgaacactttttttcctattatttacgtcttggcaaaggatggagaatgtagtatgtttcctatttcattacattgagttttgcctaatttatagtgcttagcatgttttatgtttttgtttttgttttgttttgagacagggtctcactctgtcatctaggctggagtgcagtggtgcaatctctgctcactgtagcggcaacctcccaagctcaggttattctgccacctcagcctcccaggtagctgggactacaggcatgtgccaccacacccagctaatttttgtattttttgtagagacagcgttttgacatgttgcccaggctggttcttgaactcctggactaaagcgatccacctgcctcagcctcccaaagtgctaggattacaggcatgagccacagcgctcagtatttatgttttttaatggtgcttatttagttgtaatctttctttggaacaagctttagaagtgttttgtcttgggagttagtcatcagtacttaatggaaggaatgtgatcttccgattggtttgatcttgctgtggctaatttaaatcaagtcagacccattaataggtttctcttcacatctaaatttgacattggctagctcttatgattatatatgtatctcactttatgtgtgaaatatgcataatacaaagagtatttagtcatttaaaaaggagaagtctaggataaaacctttaatttttaatcaaaactttaaattccttaagaataggagttagatctgatttgtttttgttcctgtggtcatcttctccactcacacttctctgcctgcacagtgcttttcatggttttgaagaacttagcaccaatttctccctagtcttggaaaatgagaatagtttacttttacattcagtattggcctctttccctgtttacagagtcctgaagacaagtgaatgtgtatgctaggagacatttagtaacaggctatactgtggacgtaaatctggccaaatgaagtaaagttcatttcatagcagtaggagggaccataagaatttaagagtgcattttcttgtctacaggggtatcacacctaattgagaacttttgggtgagatttttcaactattattttgtataaacttgcagcattagaatttatagaaatttttaattttctttgtgtgtgtgtgttttttttttaaactccaggttacggaaaaatctaaaatccctaatcattgtacatccttcttggtttatcagaacacttctggctgttacaagaccatttattaggtaatttttgagagccattgactttaattttattttttttatttatttatttttagttaacacataataactatacatacttatgggatacagagctatattttgatatgtgtatacattgtataatgatcaaacctgggtgattagtacatccatcacctcagacatttatcatctttttgtgttttgaacattcaaaatgacatgatttttgtatcttgtaaacattgtatccattgtatttgtcagaaatatggaagtaattatttttattttcttccatagctcgaaattcagccaaaaaattagatacgtgtttaatttggcagaactagcagaacttgtccccatggaatacgttggcataccagaatgcataaaacagtatgttttgttttatttccttaattgtattggatcttaacattttgatgtgcaatggataatacttttcaatactcattctttatgtattatattttataactgtgcgcgcgcgcgcgtgtgtgtgtgtgtgtaacaaagaaaaagaggaagaagccattttcccacaccatccccctaagttagcattttcttcaggctgtcagttgaagaactaggataaattatttccggttgtgattcatgttatacttttatagactacttataatctaagagatgatttctctaattgatcagtactaaagagcattctccaaacttgaacatagtgctcaacaaatttgagtaaactgatcatcaatattattattgaataatcatattgctaaataaataaaaatatttaaatcatcataaccttaatgttttccagtgactgaaattctgttctgattatcagattcacattcttccatgtaacttcttggacttggtagaaggctgttaacataaataactgagtattacaatgcatgtggaaaagtttctttgttctgctcacctgaggttttagtctatttaatgtatgaaagtcagatttattaagtaaatttttactttctacatcatgtagtaaatatttttggttttgctggaaaatttaaatgagtttatttttagtagcttttttcaagtttttattcattttcataacatgtatatttactgaaataactcttccctacaaaggtatgaagaagaaaagtttaaaaagaaacaaaaaaggtatatgcacaccttgactgggttgcatctagactagtccatttgcattgcagactaactcttccttattggttggttagcttgtagacaaagataatagcatttgcaaatataaatgtaccccaacttccaaatacagggtgaacccagagttcctaaggctgaatatgacttggattcaccatgttttattgccatatatgatgccaattagcaattaaaaaccacagacccttctctctccttcttagtctaagtactaatggtgaaaccagagaaattactaaaaatggtatttggaacaccaaataattttaagactttatctgtttcaccattttctttaaatcgctaacttgtgcttttgaaatatttttgcagactttttaaaagttctcaatttatttccctggggttgattattatatttgcaatgcatatatactttggctaaccaacattggtttccttttatgcttaaattaaatggcttgctaaccagtcaaattctacatgtgataaaatacctaaaatctcagtgtcccatttaacagttaaacacttcactttctattttaaatttaattttgaacacttctgctttgagcataacaaactattatctattgataccttgacatagatgatgaaaggcaagggtataaaatacttagaattttgtataataatttagaaaaacgtagaatttagatctagtttgttagatctttaaaatattggcaattaaattagcaaaacatagtttaatacaatcttaagagttacggtgagagatttatatgtaattatcttgaccattctaaggagccaactgtaactaactggaacattcttaactttgaacacattttgtttctgttgatgagtgagaatttagtagactttgtgatagaatcagttttacacttctatatgacacttcacagtttaaccaacactttaacatagaaatgtagacagtgattttagatcatgctgatttcacattcctttctaggcattgctgtgcattcgacagacaagtggctgaaattaaaaatatgatttgtaattgtagaatattttgaagccagctgcttcatagatttcacagtgaattgcctttgttgataaaatatgctgtattaagcctttttaaaaaaagtttttaatactgttaagtaatttagacatcagaaaaaatatggaatttgtactttttatttaaatatattgtttgaaacctgtcactattttatcttgattttttttttacttgtgtttaaccataaatagaatgattacatgtatctttcaaaaacgttctgttttttgtagtttctttagtcttaaaaaataataaatttttgtcaatctgaaaatgataaaatttaatttttaaattaaatttaggtagagaggcatgttttgttttgagacagagtttcactcttgtcacccaggcaggagtgcaatggcccagtctcagccaactgcaatctctgcctcccgggttcaagcgattctgctgcctcagccccccaagtagctgggattacaggcacccaccaccatgcctggctaatttttgcatttttagtagagactgggtttcaccatgttggccaggatggtctcgaactcctgatctcaagtgatccacccacctcggcctcccaaagtgctgggattacaggcgtcagctaccacgcccagcctaaaccaaactttacagaagctaggtgcaagggagcttatttaaggtgacaactgcatgatatgataagtagtggtgctaagaagagtatgaagctatgagtccctatggcaggtttttggggagcaggggaagaaggggcaaaaccattttcttgaggggcttgtggggaagagggttgaagaaatgttgacaacagggagatccagtgtccccagtgacagaaaaaggatagcagtttaaatgtttaaaatgtttctttcaaacaactggatgcaagtgtggccatgcagatacagattgttaaaatgtttcaggggagtttaaaaataattatgaaattagttggtaaggatatttcagatgttaagaggatttgatatattttgcatgccttatcagaaatacattccaaattttttataacaatattttaaatattttaaaatgttactttggctttaccacagaccagggcttttaggtctgtttcactaatattcaggtgggcatagtaatgggtgatgagaataaaaacatatgaaaaatatttttctttatctaataccggattgttttaaaggtcccttcatcagttattcagaccactacaaatgtaatagtaatagactgttagctttgaagggttgtctgtaattattatgtggtaattatgtaatccttctaatgcccacatgcgtaaattttgatatgactgatgtccaacccaccactaaataaataagctttttgatgggtttttgttttgtttttttgagacagggtcttgctctgtcacccaggctggagtgcagtggtgcagtctcggttcactgtcgcctccgtctccagggctcaagcaatccttccacctcagccttctgagtagctgggactacaagtgcacactaccacacctggctaatttttgtattttttgtagagacggagttttgccatgttgcccaggctggtctcaaactcctggtcaagcagtccacccgcctcggccttccaaagtgctgggatcataggtgtaagccactgtgtctagccaataattaatttatattagatatttttgaatgttaaattctttttttttattttatttatttttttaagacggagtctcactctgtcacccagtctggagtgcaatggcatggtctcagctcactgcaagctctgcctcctgggttcaagcggttctcctacctcagcctcccaagtagctgggactacagacgcgtaccaccacacctggctaatttttgtatttttagtagagatggggtttcactgtgttggccaggctggtctcgaactcctgacctcgtgatccacccgcctaggcctcccaaagtgctgggattacaggcgtgagccacggcatccggccttgaatgttaaattcttaaggcttcttactgtcaaaacaaatttaaggcattcacaaactgtgtaccaataagttttggagaataattatgggttctataaggatgcattttttatcactgaattttaaaatattgattgataattggtggccttcatggcattttcatattttagttaacagaatcatttttgagggagttgtttttcctgccattttcgtaccacctggatccctaccacagccaagttacaggtcaagattttaatatgccatgtaatttgaacttttaagaaagtttatggctgggcacggtggctcacgcctgtaatcccagcactttgggaggctgaggcaggcagatcacgacgtcaggagatcgagaccatcctggctaacatggtgaaaccccacctctactaaaaatacgaaaaattagccgggcatggtggtgggcgcctgtagtcccagcaactcgggaggctgaggcaggacaatggtgtgaacccaggaggcggagattgcagcgagctgagattgtgccactgcactccagcctgggtgacagagcaagactccgtctcaaaaataagaaaaaaaaaaagtttatatgcatttgtatgtaaagtattttataatctttaaagaaacaacggtcacatttcttgccagtgtcctcctgcctttaaaaattctcttttctggttggggaaatgatgtttggtaactgtttttactatgtctgcttctttgcaaagctttgtctttaacagagtaatattctatgctaaaatagtcattatttttagaaagaaaattgttcagttgctggtttcttattttatatattcttcattaaacagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaaccttttaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctctcattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgctcaaaatgggctgaggtttttaataggtggttttctaccacattaagtacttggttcttcagtttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatttcccatattattccattttaatttcccattactgaccaaggtgaaagtatatgtgattgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaactaggaagtaagagaaagcaaacctttataaagagataaagacatagttgttacctaagatgccactgtatgtgtgccctctcttttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactcctgacctcatgatctgcctgtctcagcctcccaaatgcttggattacaggcttgagccaccacgcccggccatgtgtgtccttttaagggaagtaccatatgtgactgctgatggtaacatttcttgtatgcagcaggaaaacctgcaggctatacgcaaggtatgtgaataaagactgtggattgaagggggaaaagttgataatacatacccatgataagaattcatattttctctttctttgtctcttcatacagaa

SEQ ID NO: 12348 - DNA, 38239 bp, Human
tgcgccattgcactccagcctgggcaacaagaccaaaactccgtctcaaaaaaaaaaaattgtgacaccaataacctaaaactcagtgctaccgttttttattagcacaagggtaactggtgttgaaactgtacagacagctatttttatcatttctgagatgaaaccccaatcaacatatcaggaaaaaaggaaatactgacctcaccaaagatttctgaaagtcaaacgatattaaactcaaacattatatatgtctctttccttttatgcaggaattaatgtgatagatttatgttgagagtagaatatgaaaacttttgcatagtctgtatttaggccaaaactgcctttactactcaagaaagtccaatgggccagtgaggacactgcaggtgacagaaatttctatgagtgtaacacctacaagcactgtgctcacaggactgactgttacaccaaaaaggtctcttggaggagaagaaatgcaatatgcaaagaagctgttgtctccaattattcaagccaaggctacaacagtagccacaaatctgccagttatttccaattaaggcagaacgattgacttaaaaagcaatagttgttttttttctccactgagctttcaattagataatgtctataacctttataaagctgcaattatacagccaaaagaaaaaaaattaattgtggtaaaacatacataaaacttaccacttaaaccacttttaggtgtgtagttcagtggcagtaagtacactcacaatgtaatgcaggcatcaccaaaatccatccccaggactttttcatctctccaaactgaaactctgtccccatgaaacaccaactttccattcccccttccaccagccctcaacaacccccattctattttctgtccctataagtttgactcctctaggtaccttattatataagtggaatcacacagtatttgtctttttttgactggcttacctccctcagcatagtgtcctccaggttcatccatgtagtagcaagtgtcagaatttcgttctttgttcaggctaaaaaatgttcccttgcatgcacagacaacattttgcttatccatgtatctgtttttggacacttaaattgcctccacccttttggctattgtgaatagtgccgctgtcaacgtgagtgtaaaaacatttcttcttgtacaccctgttttaaattcttttgggttatatacccagaaaagaaaatgctggatcatataactgatttgttgaggaaccgcagtattgttcatcacatggctgcaccattttacattcccaacagcaatatacaagggcttcaatttctctacatcttcaccaacactaatttctgggggttttgctagtagccatcctaatgggcgtgaagtggtataaacaaaatttagatcccatcatctccgaaaagcaaatacacttcctagtactagtcagtactaaataggtgcacagcgtttagaactttacttgatccaacatagcagcctgcctagagccggagccccgcccactccggagtcccgcctggacgccgacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcgctcccggcagctacgcgacctgtgaccatggtggctgtgctgggcggccggggcgtgttgcgcctgcggctgcttctctcagcgctgaagcccgggatccacgtcccacgggccggacccgcggccgcgttcgggtaatggcggccacctcgccccggggatccccagcatcggcgcgctcgaggggcggcgggaggggcgcgtgccgacagcaggagttcccggcgcgcgggcacggggcgtgggcgcggcctggctgccctgtcgccctttgtgccgcgagaccccgatcctgggggccagccgcgcttggtgctcgagcccctcgatcgtgcatgcgcctcggtcagcctcagttcaaggagtctggagccgtggaggcttgggctatagagtgcagccccttcagtgtgcagaccagagagacccagggagatacatttgcctgtagtatggactcacccgtgacggagcacggactagaatcccaacgccctcattagtccattgctctgtccagagtccacactaagggcataaggacaataatctcttctttctcttatgtcagaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcaggtaaaacaataacaaaaaaactggattaatttctgaccttctgtcttgaaaatggatactcttggtcccaagagatactgggcagaaatgtggatagagcggcatgaagcttgttttactttattctctacatacatccctacacacatgcaaacacacgtatacaacgaacgtacacagtgcatgtgcgcagttgactgttgatgggctactttcataaagtcagtactagataggtacacagcgtttagaactgtacttgatccaacatagaaacttttagtttgaaaacttgatttagaaggagaaaagagggcaaatctgaccagcttttaaaatttcatattgcaattgactagctcctttaattttagaattattataagatggtcagggctattttgatagatggaaaaacatgttaatggctacagctgtataaattaacagtgaaaatgattattttttccagtttcctgtctgcagaaaggcatcgaaataagttactgtgattgtaccaatatagttctttttttttttgagactgactctcgctcttttgcccatgctggagtgcagtgttgtgatctcgctcactgcaacctctgcctcccaggtttaagcgattctcgtggcctcagcctcccgagtagctgggattacaggtacctgccaccatgcccggctaatttttgtgtttttagtagagatggggtttcaccatgttggccaagctgatctcgaactcttgacctcaaatgatccacctgcctcagcctcccaaagtgctgggattacaggcgtgagccaccgctctcggcctaccagtatagttctgataggttatttaatggttgaggaaggccccatccatctagttgcattgcagatcattcttcctaaaatatctctgaagaaacaggtttttctggattttgtacggccgttttataaatgcagctgcaagttgatatgacatataatctgggaaaacaagcagtggtattagttaatcctgaaatgcagctgtagctcagtgtcagtaggtaaaaggattcgtgtaaaaactttgcttcagaatagccagtgcccaacctacaactgacttttgttccaaaaacttgtttgtaagtctgctgtttggaactttgacccttatttcaaaatccgtaaggtgatttattcctgggtcaggtcaagaaaagccttttctacctgaaattggatattatgtgcagttataaatattaataattcacataacctaacaatcttcctaaaaaatattttccaagttcaaccttgggatgccctgccagagaatcagagactgtccttctgctgacgcttgccaccacgctgtatctggcagtcagagtgtggccccggtgcctgagccctcttaggactctgttcagccatgaggttagagaggaatcatggcctctggagttctaatggccccgtggccacttcctagctctgtgagtgtgggcagattgttcaacctctctgagcctcctgccttgcagcgtttttgtgaggatttgaaacaataaatgtaaaagcctggggatataataaacatgaagtaattagtaggcacaatgggaatatttatataatagtacaatatataagagatgtaaaaataattcatcaagattcatgcaaatttcaagccctgaaggtagcaaatactttattgtagataatggctacttcacaaaacatacacaaaagaaatagctgaacatacaatatgataatagcagtttctttttttttttttttttttttttttttgagacggagtctctctctgtcaccaggctggagtgcagtggcacgatctcggctcactgtaatcttcacctcccaggttccagcgattcccctgcctcagccttctgagtagctgggattacaggtgtgcaccaccatgccgggctaatttttttgtgtgtattttagtagagatggcgttccaccatgttgggcaggatggtcttgatctcctgacctcgtgatcctgacctcgtgatccacccacctgggccgcccaaagtatcgggattacaggtgtgagccaccacacctggccgatcctaagctatcttaactgtagaaatgaatttctcagaggaatagggcagtaatcataataagtaaatggcagagtcagtattgccattgcttggtggcttcattgatgcccctttaataatatttctgtagataaggagcttatagtttagtcagaccttattactacccaattctgtcttttatttttccagaaatggtatgttaagagtagatgtacctgtattcaacacatctgtttccacgtttgtttcttttttacttgagactggcaaataagattaaaccaaaagataaaacaggacctcattttttcaaaagggctgtgtttcagttatcctttgactaagggcagaggtaggagtagagagtatgtagaagaaaaaggagatgggccgggcctgtaatcccagcgcttagggaggctgaggcaggcagatcacgaggtcaggagattgagaccatcctggctaacagggtgaaaccccgtctctactaaaaatacaaaaaaattagccgggcgtggtggcgggtgcctgtagtcccagctacttgggaggctgaggcaggagaatggtgtgaacccgggaggtggaacttgcagtgagccgagatggcgccactgcactccagcctgggcgacagagtgagactccatctcaaaaaataaataaataaaaataaaaataaaaggagatggtggttgatttcattgtattggcactccaccaggagaagagagcgcctccttctggcatctgtcctggcttgccatcatgtccctcctgtgcttcactcagtcatctgtctgataagctgtgggaaggctgatggagcctggtcctggtgcaggggccgtctgtgtgccccactggtatatatcccaggacagtctggctgtcctcgaagagcagctgaggagaggttaatcagaacacctgtacggcacccataattcaggcagcacagacactggcattatgcctgtcctgaggcgttgtcctgtgctaagtgtggtccagttagatgctggatcctaggaggtcttaggccaaggcgggtgagtggcaggaaggagggctcttgagatggaggcttatggacagggctacttagcagttgacacagacatattttaacatcttaaaaaacagtaggatttatccgtgcagatgggcactgttgactatggccctcctgcagcaggccagacaacacaggataccctacagctaaagaacagcctggagatcgagaccttgggaccagtctcatctttgggaatgtcaccaaggctgctgaaggtctgggtaggtcctctgggcctgctgagtgcagacgagtgactccagggtctctgcccctgatgtccaccctcgtttcacgccagcctgcacttgaggacccttggcttccagctcaccggcgtgtgccatgagcctctgtggccattgattgagcaagccgcctagggtttttgtagggtgagccccaggctgggcacaatagcgtattcaagcatgagggcacagttcagatcggcagtctagtaaagaaaattcaaactcatgtcactgttcagaattggaaaaatcgaaataacccaaggagactgagaggcgttctggaggcgactcattcatatacaaagacagttttatcatattaaattcgtgctgttaaatgattttcctctgggggtggatttttaaacatttttcaaattttattttttaattgacataagtgtacctgtttatggggtagatagtgatgtttcgatagatacaaggtgtagtgatcagatcagtgtaattagcatatccatcgtctcaaacatttatcatgtctttgtgttgggaacattcagtatcttccttctagctattttaaactatcgcttattgttagccgtagtcatcctacagcgcgtagaacactaacacttattcctcctgtctagctggaattttgaatcaactaagaaatcttcccatctcccctttccccctgtggggatgtgttttttctcttctagcacctcggtaacctctgccaaagtggctgtgaatggcgttcagctgcattaccagcagactggagagggagatcacgcagtcctgctacttcctgggatgttaggtctgggtactttttaatggaatgtttttgcatgctgtaaaatctatgatgcattcacaatactagatgccaaatactgatgattaattttagtgcttttttgaaatgttttcatatttgctacaatcaaacttaaatgacttagaaaagtaggtaactttctactgctgttcagaattggattttttattcctttagtaaagtacccagtttttcctattgcaagtactctgtgaaatcacagttgcccataatttgggagggtgacaggggtcaaggaaaggggtgtgggaagaaggtaaaggaggaacgtgagtgggtaatcagtcatcctagtttgcttggcgttgggggattttccaggatgtgggactttcagtgctaaaactagagtgaattgatcacttgttgtggttgataatatattccgttaaaataagaggtaagaaaaaaaaaacctcagtttgattctttttagaaatcagagttagattggcatattaccctctctcaatatatgggccataataaagcctactggatctcaatctcattttgcagaactggagttcagatgtagaaagttcaagggaaaaatttgcagtgattccagtacatccgaaatctggttttaagggtgttagtattgttgctttatttttgatttagttaaataatcctaatatttaatctcagtattcctgggggactggatccaggaagccctcagatcccaaaatctgaggatcctcaagtccctgatataaaatagctcaatgtttgcatggaagctacgcatgttctcctgtatactttaagtcatgtctagattacttaccatatctcatgcaatgtaaatgctgtgcaaataattgttattttgtattgtttagggaataatgacaaggaaaaacgtctgtacatgttcagtacagacccaaccacccatttttttcccgaaatatttttgttccgaggttggttgaatccacagatgtagaaccacggataggaaggctgactgtacttatttctttgtgatttgcttctttctaaaagtgaagtgctaaaaaggttccacttgactgagcctcagcggatcgtggcactgttgcacgtgtgtctaaatggtgtttggtacctttgttttccttaacctgatgaacaaggacactgactctcatggctgatggggagctaaagttatctgtaaaaacattgcctatcttagctttccattatttcggtattgcagtcattgtccaggtgctaaaaacttaccaatttaatttttttttttttttttgagagggagtctcactgttgcccaggctggagccagtggcactatcttggttcaccacaacctctacctcccaggttcaagcgattctcctgcctcagcctcctgagtagctgggattacaggtgtgcaccaccatgcctggctaattttgtatttttagtagagacgagatttcaccatgttgtccaggctggtctcaaactgctgacctcaggtgatctactcgccccggcctcccaaaatgctgggattacaggcatgagccacagcacctgtccccaatttaatttttttttatgtaaagtattagcatgattccaatattaaaaaaaatggaccagaggagattctctctcctgtcctatcctcagcacccagttcccctccccacaggcctctcaggtgttacatgctgataactatgtacatgtattccttaaatgtttttttaagttttatattcttggcactggtcttcaaatgtgtacatgtgtgccagggagcaaatgccttcttgtttctgaaattggtcttttagactgttcttttttcccatcttctcacctcctgcccctccttcagggtacttccgtggccagaacccctccaggtcagaggcagaagagaagcctcatgggtcacagcagcagatgtgggctggagatctattcatttggttttggcttgaattttctgaatggtttacttgatcttgggaaagatatatcttgccaggaaaaatgataggccttgacaatgttgaatgatcctgcaccaccttgaaagacattttctaatatggtttgtcaggcaaagtggttagtagtcatttgtggcctgaggtagaagtcctcagaaatcagcagacttcactgataaaatgctgacttgcccctggactgggctctgtgagagtggccttctgcactgtgcacagtaggtgtgaacacaccacacctacagggaccacgtggtgggctgtggactagcggccaagctccctgcaggcccactaatagaattcagcttttagcatgggctgtttcatactgttctgatgaaactgatttggtttctttcctccataccccttctgcatttcagtgtttttgtttagttttcctggtttttaattataactacaaaataaaatctttaggctattcaccttagcttagtaaaaaaaaaaaaaattaaaaatctggaattttagaattctactttgaataacttggaccaaatctcataaatttctttgcagatattatagagatccctctcatgtgtaagtcattgttttaagaagaatagataacccagaagcatatctgtgaattaatttgtatacagtttcattaattctttcctttagaaaaggaagattaagccaaagaggtttcaaaagtgctgaaataatacagaagcaaaggaagacccagggcctctgtctttctcaaaatagccaccagggggaggtcggaggcaggcctgcactccgccgggaaaggaagcgcgcctcctttttttttttttttggtggagggacagagtcgcactttgtcaccagggtagagtgcagtggcgcaatctccgttcactgcaacctctgcttccctggttcaagcgatccgcccgccttggcctcccaaagtgctgggattacaggcgtgagccaccgcgcccggccccttttttttttttttttggagactgagtcttgccctgtgctcaggctggagtgcaatggcgcgatctgggctcactgcaacctccgcctcccgggttcaagcaattctcctgcctcagcctcctgagtagctgggactacaggcgcacaccgccatgcccggctacattttttttttttttttttttttgtattttagtagagatggggtttcaccgtgttgcccaggccggtctcgaactcctgagctcaggcagtccgcccgcctcggcctcccaaagtgctaggattacaggcgcacccggtcagcctgcctcctttcttcgagtggatggattaagtcattgcaaggctgctttcctgattacattctgaccactttgagtagaaactactttgcttttaagattgttattgcttctgttttcactgtaatgtgtttgatagtgaaagcgatcacctgagggtaaccaagtggctgtttttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggtaggtctctgagggaagggccaggggaggaagggtggctgggcctgtcttcatttattttgtttaaattttgttgttatatttttctacaaaataataccatgtgattgctatagaaaaccccaagagttcaaataggtataaagaagaaagtagaaatagcccacagtccagctctctagagacactaccaaatcttggcggctctgctttctggccagtcttattacatcacaaacgcagtttcatattgatggcatcgtgctacacctaacgtttttctaacttactatttttgttgaacaatttttcaaggaaataactttcatgtcaataaatatgcatttatactagttgtatgataggcacatattattccattgtatggatgtactgtatcttatttcaccaattttctttttttttttttgagacagagtgttgctctgtcacccaggctggagtgcggtggcgcaatcttggctcactgcaacctctgcctcccgggttcaaacgattctcctgcctcagcctcctgagtagctgggattacaggcacatgccactatgcccagctaatttttgtatttttagtagagacagggtttcatcgcattagtccggatggtctcgatctcctgacctcatgatccacccaccttggcctcccaaagtgctgggattacaggcatgagccaccacacctggcctatttcaccagttttctaatagtagataattaacttaatttttaagttgcctttttctgctgttataaatagcaggcagtgaacattctgttgctcgtgggcattttcatttttttgccactataaacagtattgttgtggacatcctggactgagctcctggcacacagggagaatttcatacacatttaggagacaatttgctaggtgatggaagttccagatgttcattttgcaggatagtgccacagtagttacaccattttatggtccgggcagcaaatatcttggagtaatattaattctttacctttaattttccagtcattccattcttttttcttggcggcctctctaagatgtaatctttgtccattttccctgccaaacgcatgtccagaccctctctgattcacccgcggactcacacaacctccccatgacgctgttctctgacagcctggctcttgccagttcttcccacagttgctttaccagataccctgcttcactccatccagcagagctcagggtcccctctctgatctacagaactgttctcaaggtccttgctcaggcatgcatatgcacacacgtgcacacgcatacacacgtatgctgtatttgtcatatttaagtacttggtctccattgattctagttccttgagctttttatccaaccagaagatgtagttccctcctaattcaaacccataccgtatgctcaggtttttgtgacaatttccactaaaagtaattaagagaaaacatgatgtcatcaaatggtggactctagggtttttcttttctgactaattgatactccagcctcacacctgtattgattctgataattagtgattcagtttcttttaacagagaggagcaataacccgtgccgtgcattttgtcgtatgatcataggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggtaggttctgcgaaggggagatgccgggacggcagatccttcccctctctccgcatctcatctcttattgtgggatatgttgacaagacacatctctcgtgcttctagttctcaactctcaggtaggaagaataacgagttctcagaaaagtaatgcagtttaaccagtctgagttttaaagctttctgtttccaggagtgaaacttccatggctcaggaaaaggctaagtaaaatcactatttctatttactactactgataatgaacttcagggaaggagggggtggtgtgaagtgttattaataatctcatttaaaatactgtgaggccaggcacagtggctcatgcctgtaatcccagcactttgggagctcaaggcagaaggatcgcttgagcccaggaggtcgaggctgcagtgagccatgattgtgccactgcacttttgcctgggtgacaggagtgagagagagatgggggaggaaagaaaataatgttgagtgtggaaaagaatcactggatacaaatatgaaaccttttattttgattaaaagaatttctgtgctatttgcatgctttaacgttgtccttcaagcctgtctttgaggttttttttttttttttttgagtttgagtttcactcttgttgcctgggctggagtgcagtcgtgcgatctcagctcaccacaacctcttcctcctggattcaagcgattctcctgcctcaccctcccaagtagctgggattacaggcatgtgccaccatgcctggctaattttgtgttttttagtaaagacggggtttctccatgttggtcaggctggtttcgaattcccgacctcaggtgatccacctgccttggcctcccaaagtgctgggattaccagcgtgagcccccacgcccagcctgaggtctttacaggcactggaataggggccagtgaacttcagcctgtgcattacacctagcctgcctcccacttttgtgcagcccacgtaccaatcgaggtggctagtgctgtgagtcacagagaccaagctggggtgtccctttaccacccagcattgctgccccagacctgcactggtggtcactacacaggggtgactgttggcaatgagcaggcacccagccatggaatttcagtcagcaactcaggagttgcttagcctccagcaagctgccccattgagatgaccaggctcttgggaggaaagaagggtgcaccaggatctaggggttgctaggacaagaagtgaaactgacctgcgttaccctactacccccacctgccagcctggcccaccaggaccctcttcctcaggccactagctttttgtccaagtgtgagtctagtggatcccagatggcctgccccagacacttaggactaggtgggtcaggtgttttctctcctcatgtgtaagtatctacataatgtctttgattttgcttcttggccagcaaaacctaaaatatttatttactctctggccctttacataaaaggtgtacagatctcttcgctagaatatcacaagtctagtctttttcagctattcgacaattcacgtgacttttaagtacgctacttagtggcagcgttctgttgtagaattgtagttcttcacagtctttctgttttttaaatgaatatgaagctcttacggtgagtctgatgtggttgccagtcctgtctgtgctcctgcttgtccttattttgctcctgcctggtatccatcttgtgcacagtaggccattccgctctgtgaagggtctgtcccctcccgcggcctctaggacaggctgccttgagttcttcctccctctcctgtatccttaaattctctccactgggtcagtcctctcagcctgcaaaagtgggcacaattcttcctccagaaagttgccactcctacctgtggttactatcttcccattctttattctttcccacaaacttatggaaagagccacctgcattccctgcttctagggatcctcctttccttccttctttagtccattctgccccatctccctctctggcccattctagccccctctactgaaactctcctcactgacccctgcccacttgttctttcccataatcactatctcagttcatggcctgcagatgacccggcatccaggcagagtcccagatgcatccctcgagggcccagtcctcctctgccctcttcatttgcccaccttgccctgttcattgaactgtgatgctttctgttgttacataatacccctccagttatcctcacctctcttctttccccacattctcctggtttaggccgctagcttcatatggtagtttgttctccataggagagtttcctttgtaaggcaaaaatctaatcacttaattccactagaggacttaaaatccttcactaaccagcaaagtccgtgcagtttggctggcccctcctgccagcccctccccggacattctcccatctcccctttctcctcatccttccggtgcctctcccacgtgggataaatggccattcctggaacaagcttccccctcatgcctcttcgcctttgcaactgctgctgtgccagcttgcaccagccttcccctcagccacatcctctgccagggcatattcacccctgacacagctccttgggcctccgcgtctgggatggcgtcccggagccctgagacctggcggtgctctccctcctggaccccgccacaccttgcacgtgcctgtgtcacggcccttcaaccccgggcactgtcagcacttactcccttgcctcggtcaccgcagtgggaactcactgtgtgcagttgctctgactttcctttcttgatgaaagcaagagtctctcagtagcgcagcactctttactctctgacgtctcgctacttcccctcctggctactctttctttttcatcccccatcctctcctaacttgtgtcaagatggctgtggcccgccagtgtgctagagaccaagcccccaccacgcacctcctcttggctccttggtcattctgcagcgtttgagaacatgctcatgatgtgtgcgccattggttacacccctcttcttgaagctttctctgtctggaagttcttgccaccgtgttctcccgacttccctcctctctcaggctgttccctggctgacacgtgcctgctcccccatgtgggccacagtgttggggtcctccaggcgtcaccctcagtgctctgctcccctcttaccctcacacctcacacctgagtagcttcactcagctccttgctccacctaactcccaaaccccacatgttcgactgttgtttttttttaagagacaaattctcactgggtgtggtggctcacacctgtaatcccagcactttgggaggctgaggcaggaggatcacttgagcccaggagttcaagaccagcctgggcaacgtagcaagaccccgtgtctacaaaaaaatacaaaacgtagtcaggtgtggtggcatgtgcctgtagtcccagccatttgggaggctgaggtggaggatcacctgagccggggaggttgaggctgccgtgatctgtgattacaccactgcactgtagcttgggtgacagaggcgagaccctgtcccaacaacagcaacaacaacaaccaaaagaaaaaaacagaaagaaaagaaaaagacgagttctcactatgttgccttattcaactttttattcaattttcttatctggttgtctcacacctactttaaattcagtctgtctaatactgaattcatgatcttctctctaggcctgtcccttctgctaaatttcttgtcattataaataatactctttctccctgaaaataatattttaattactatttattgagtgcctgccgtgagctaaagtctttaacaacgtgatatccatgtaaggtctctgattctcagcctgcttgtcaagtgaaaaacgggggctcacaaaagtgaggaaaccttccagaccacatcccccacactgcggcctgcagctcactgcactcttctcttctgctgggctctgagtggccccatcttgccctccccctctctccctcccaccaggctcccgccagcctcgttggtcccgtctgggctgattctgtgcctctccaaccggtccaggtccttgcctcctaccagtctgccttccatgatgctctgatagcaattcagcaatatgtgaatctcatggtgtcttactttaagccttccaggactccccacaactttcctgataaagttcaggctccttcactttgctcacggaatgagtggcccggcctctgcctctccaggtcccctccccccactttcccctcccaaccaccagtgtccagccatccgagaccacctgggtccctgcagcaggtggcgggctcctgcctccttgtgtgggcccttcccgctcccttcccactccttcacttgtttgctgacttctcttctcccagaatggcccaagcattccatcttctaggaagccctcaccgccgccaccccgtgtccactgcccgtgtgagcacacaggccactctgctacagatggacggctggttcttgtacccgtctcctggggtgtaggagcaacagtatctctctagggtctaagtccatgagtgaaattgctgagtgttgtgggcaggtagactacattacaagtgacagattattttccagcaaaataaatttacacttccaccagcaatagatgagattcttaacttttagctcttcaacaaaaacttgaaattctcagacttcttaattcactagccaatcaaatgggtgtaagatattatcttattggggtcttaatttgcatttcgtattactaataagattgaaaatctgtgtttatccaccatttgagtttcttctgtattatatccatgtatttttattggtgaaaagttttttgttatgtaataattgatacacacaatacagtatgtttgggtatacagtatgaaatgtaacaacaaaacgaccccgccgctgtccacccaactcagcaccagaacagtttcaatgttatcccagtgttactctaatcctagtcagtaaccccttttagggtaactgtgttgcaagcacctcttcacagtgggtggcttttgcctttttctttatgggcagaactacttaatgtaaggaaatgccacagtgttttgtttttctttcctttttctttttcttttctttccttttttttttttttttttgagacagggtctccactattgcccaggctggagtgcagtggcaccatctcagctcactgcagcctgcttgctcaacatcaaactatccttctgcctcagcctcccaagtagctggcactacaggcgtgtgccaccgcacctggctaattttttttttttttttttttgagacggagtctcgctctgtcacccaggctgcgcagtggcgtgatctcggctcactgcaaactccgcctcctgtgttcacgccattctcctgcctcaacctcccgagtagctgggaatacaggcgcctgccaccacgcccggctatttttttgtatttttagtagagacggggtttcaccgtgttatccaggatggtctcgatctcctgacctcgtgatccgcctgcctcggcctcccaaagtgctgggattacaggcatgaaccaccgcgcctggccaatttttgtattttttgtagagacggggttccgccacattgcccaggctggtcttgaactcctggacttaagtaatccacccacctcaaccttccgaagtgctgggattacaggtgtgagccaccatgccgcccggcctcacaatgttttattttctcattggtttggctggttttgtttgattttagatccaccaacatgtttgcccatttgtttactcacctgttctttcttctcaaatgttccttctaaaagcatttatcttctcttcttcctgaagttatttttagaagttatttaagggcagcctgttaatggtcaactcagtttttaccaacaagtgtcttttctttcatccaccttttctgtaagtctgtttagctgagtgtggaaatggaagtggaaaatcattgtctcccccattctgcagtcttctgccttccatccttgctgttgagaagtttcctgtccgtctacgtggttcctgcttcggagtgatgtgtcttaactctctggctgtttttcagattttctccttacctttgatatattgctgttttaatatattctgtccaaatgcagatttcattttacttgtcctgtttggaatacattgcgtttttgtttatggattctttgattcattctgaaaaactctcccacccattatttcttcaaataggcatctcgttcattcttattctcttcttctgagacgagcggacttttgtaaacctcgtctttccatcttccttatctcttctgcatcgtcgtgtctctctgcgtggtgttctgcataatttcttaagatttgtcttccaattttctagtttttttattaactttataaaaatcctgtttgttttgtgacctttggttaggagctaatatttactcactcttaatctgaaaataaacaaagcagtgagcataaatcgagagcgctttccttccgggaagatttgcatttgttgctcttgggaaccacaggatcataccaggttggggccatttttagctcagcttgatccaggagtctcaggttgggccccggcctgcctgcgaacactgcgtctccacccagagcaggcctgcctttggagctggcttacttcctttgctgtattttcagggttctgtttctcatgtgcagacacactcatacacactcacaccccggtttccattaaccactgcaacttcagcaatgccacagaattctgttttgtgaaagatctagttattcccctgcaagaaggcctttcagagggtatggtctgccatacggccaaaagtagaagcatgtgcagggacgttttgctagccatcttcacactgtcttgcttgcttctctctcccttaccctccgcccccaaatgttttcttcttcctacatcttctccccacctcttcaggctgtctccacgtacctcattcaagtcttttcattcttgtgcagagcagttcatcctcttcagcctttatcttcagctcacacggggcctacctctgaatatttaagccagtcagcagaagcaaaggcaggcaccaggcactgtcctgtaatgggggatccgccctcctcagaaggcagttgtgattgtaaatagcagtttttcctccatttggtgatttgaattcactaagcacacagtgagtgcctgccaggtgcctgacgttgtccgggactctgtagagattgttgctcatgtgagttcatgccattagtgttatatttcttccatgtgtaacgtgtagctctcaggaagcaatatttaatatgctcaagagcattagaatctttacttatcacagtgtatttaaagaaatatagaaaacattggcctaaggaattgcatttgttgattcatgttaatggttgtttttagctattcttccctactagtgaatcatctataatacagtttgaagtttggtacttagccttttacacccatatttcttcggtagcagaaattagaatgaataatttgtgtgcatttttcaatgtccatacaaatgcaatgcagaaaaaaactcctcttttgcaaacattgtcgctcttcctcaggtgaccctgttagggtcatattttcttttatcttgtatctttaaaggaaagcggtaagtgcagctctaatttcatccacttggtaagcattgatttgtgggcctgtattgtgggaggcactagtgtaggccctggggtacagtggggagcaaagcaaagtcccttacactgcacacaggtcctagtgggaggcaggcactcagccctgggtccagaaggcaccgcaaagcagcaaccagggctaagccgagcagagggagggagggaggcattccaggcagacgagacagtgagcgcatgggctcagaagtggctcttgctcagaatacttaaagacaatactttagtatgaaattaaacctttcttcgcctacacttctgtttttcaggcatccgagatgtttccaaatggagtgagagaacaagaaagcctctagaagccctctatgggtatgactactttgccagaacctgtgaaaagtgggtggatggcataagacagtttaaacatctcccagatggtaggttactgggcttgaagggctctctgcctgttatagagggtgctcgagttcctccccagtgttctggaattgctcagtgattcatgaatctgcccatcgccctcacacgctcatgtgtgagcagaacagagaatactagttcttgtgtactgtgccagttcttgggcagtcaatctggcttaacggagaggtaggactgcgtgtccaaaggttcacattgttgagtctttaatagcagactgctcttttttccttctaatccttggtgtgtgtgcgatgacaaaataattatccagaagccttaaaccgtttctattttctaattccagaatgagtaattcgaaaataaataggccacaatgtgtacaatattttttcctttttacacatttagatgtgtctccccacgaggacactgttaatctttaatctcaacggaattaatatgaggaagaaaatattctgttttttccatcttcagaactaagtgatatgactgtaaccatgaacaatgcacaaatgtctcctattcttttttttttagatggagtctcactctgtcaccaggctggaatgcaatggcatgatctcagctcactgcaatctctgtctcctgggttcaagcgattgctctgcctcagcctcccaagtagctgggaccacaggcgtgcaccaccacacaggcacattttttttgtattttagtagagacagggtttcaccatgttggccaggatggccttgatctcctgacctcgtgatccgcccgccttggccctcccaattgctgggattacaggcctgagacaccatgcccagcctcctattctttatctgaaaaattaacaagatttccagttaaagtaagaattgacatctttaagagaaattctgaattatagtttattttcatacagctgtttatgtttataatctcatttttttttaattactgagaaaatagagtagctaagatctaatcttggagtgcattgttacaaaatggttgtgattgaaggaccaatttgatccattaggtaatcatttcctgcatgaatcatctgccaaaactttcacaatgaaaaggacatttggaaatgttactcttctggtttgagttgaaaacagcaaatatatcaaatgtatgccttataatgtttctgttcagatgcagcatccacccatggagacaggccctggaaatctctgctcttaaaacaaaaaaatgccatgaaacgatgtttgagacagttctccattaaagagggcacatttgtaaaatgtaaacttggatgttttgttgaagagagtagtgaaaagacaggaagatttaaaggtggaaatagggttaaatcagcaattcaaaaatacgttcatgatacagaggctgtagcagtgtataaactgtctcacagcgaggcccttcgtgatgcgtcccccttctgtgctgactcatttggtaggagccctcttttccgactgtcctctcaggtttatggatgcttggtatagtgtagggattcattgcattgcacggctctggagtgcgatggccctgagtgtgagttctgcctgtgtccccggcttgctgttagaatggatctgggcaggtaacttagcttcttgaagcttcggtttcctatctgtgacctcgaaaagctgttgttgtggggattaaatgaggtattatctattcagctttggtgcaggatcaaagacagagtaagtgtctagtgaaaggttggtattactgttattacagaagtccttaatgaacaaacatttttatatgctgaatgagttaaaacatgtaactactgtgtttaacagatgtgaaattgtttaaacagttgctggcaccaagtgagcactcaggcatgttgactttgatcatcacgtgatgatgcagctggccggtgtgtgtcatctcgggacaggagagggaagtgtcagagacctggagaagtatttccctagtcagcaggtccgcttctcacttagcaggcagtgacttcccactgaagaggagggaaaggcctggggcccgtgcagggcgggggagcactgccccgtcggggcagctcccagccttctcagagctgcagtgccttcctcttgacacacacggagagggaatggagaaggaaagagctagcttagggatgccaggaaccgcagacgcaactctctttttagccccacaacagccccggggaactgtgattgttcctgtttgtggctgaagctcccagtggttaaggagccaccacagcctcacagaggcaggaaactgcagtacagggactagggcccaggctgtccatcattgcctcaggaaagttctcataaatgggggtaagtccttacagtctctccaaagtatgttagtcaggagtgtcacagatgcatcagcgataaggagaagctgctttaccgtgcgcaagttgtataattaattccttgtgaggttcatatgctttgagggctggccggggcccctacactcatctgaaacgtgatttccagggaaaagctctacaggtgtcaagcacctaccactgttttcacggtgggaaccgccactgtggaatatagtggtggggtgtttatttgattttcctactattttatgcgaatttaaatcaggctgcttatttactagtagaactcagaaacaggcaaacaaacaagaaacagagagaaacagaaaagggaacccaaagaatgttagagctggaaggaatcccaggcacggtcaaatccaaaacacagtttttacggatagggaaactgagggccaaggaggggcagggctcgccgagtttcgcctcctctgaccgcgtagaatggttgcactaaagcagattcctcgtgctgtgtatccgtcaggtaacatctgccggcacctgctgccccgggtccagtgccccgccttgattgtgcacggtgagaaggatcctctggtcccacggtttcatgccgacttcattcataagcacgtgaaaggctcacggtaagtcctgtcaccgccttcacactccccccgagagcctcggagtcaatgggcaaagctactggaaggaaaataaccaagaggagttggagttttagagtgcacagccccccttttgccaatgccagtcagtagcaccgctttatttagggtaccacggaagagagaagccctgaactgtgggtgactgataaccagaaggaaaggcatgttcagatagacagctcttactttcatgagtggcaaacatgctcataggtgctaagccctgtcacttggtaatagtttagatttatttccatcagtattaaccgaaacagtttcacacaatttgggaattttcagtttagttttttatcattataaaagcactgaccacccaatttaaaaaaatctgttaaaccaaatttctgatgtctgctgacagccagccctactcagcacagttaatggtagtgttccctgtccctaaagcccccaggccagcagggaaagcaggcacagaaacagctccactgctcccttctcgctctgttctatgatgtatttaacaacagatttctcagagaatttttaaaggaggaaaaaaagtttcttttctataataaaatacaattaccataaacctttataattactatatccataatggataatgctatatccatttagcattttttaagttaacaggcatctctttattccacacattcctcctataccacttcaaccatgaatcaaaaatacacatgagcctgtataacaaataattcatttggtaagagcatagagtcagtgaagagcaaaggtgggagttaggcaggattatactgcgggtggacaaagaggtttaatgagggagttggtttttttttggagtcggagtctcgcactgtcacctgggctggagtgcagtggcacgatctcggctaactgcaacctccgcctcccaggttcaagcgattctcccacctcagtctcccaaataggtgggattacaggtgtgcgccaccacgcccagctaattttttgtattttcagtagagacgggtttcacaatgttagccaggctagtctcaaactcctgacctcgtgatccgcctgccttggcctcccaaagtgctgggattacaggcatgagccaccactcccagcttggagtttttaaattgatttagtaggggctgggcacagtggctcacacctgtaattgcagcactttgggaggctgaggcaggcggttcacttgaggccaggagttcaagaccagcctagccaacatggcgaaaccccatctgtactaaaaatacaaaaattagccgggcatggtggcgggtgcctgtaaccccagctactcaggaagctgagtcaggagaatcgcttgaacctgggaggcggaggttgcagtgagccaagattatgccactacactccagctgggtgacagagtgagactccgtctcagaaataaataaataagtataaatttatttagtagcgaataaaaggtattttcaaactagactttataaaattataatactaagttatggtcatggtacaaaattccagtagtatactttcttattaatccttgcaaaagttttttttgtttgttttttttttgaggcacagtttcactcttgttgcccaagctgaagtgcaatggcgcgatctcggctcactgcaacctctgcctcctgggttcaagtgattctcctgcctcagcctcctgagtagctgggattacaggcacccgccaccacgcccagctaatttttgcatttttagtagagacggggtttcactgtgttagccaggatggtctcgatctcttgaccttgtgatccacccaccttggcctcccaaagtgctgggattacaggcatgaaccaccatgcccggcctgcaaaagttttttatacaatctcagtttttgtgcttttgattgtatacgtttgcagtgtacaaagtgatatctccatatagcacttaatattttaaaaggtattttatatatagtatctagttatagtttatgacatatttatgaaaaatattatccattttacagatgagaaatcatggctgagagatgttaagcaatctttcaaggttgtatagctagtaaataattaatcttagatttttctcctaatatggtgcttttccaccatagcacagctgccacttatctcttaatatgtatgatggtaacatgcctagaataagataccaggtgacctggttaattgtcttccagcttcagaaatgacaggttttgcacagtgacacacatagtaaatgtgttatgtgcccttaaagagccaggttcaattaaagtcagtctacaagaaagtttaatttaggaattaaagtttaatttaggcccatctcctagcaacacagtacatcagtataggagaaaaacacccttacaggctcacacctgtaatcccagcactttgggaggccgaggtgggcagatcacttgaggtcaggagttcaagaccagcctggccatcatggtgaaacctcgtctctactagaaatacaaaaattagccagacatggtcgtgggcacccgtaatcccagctactcaagatgctgaggcagagaatcacttgaacctgggaggcagaggttgcagcgagccaagatcacgccactgcactccagcccgggcaacaagagccgaaaccctctctgaaaaacaaacaaacaaacaaaaaaacacttaaaggcacagactatcccttcccagatttttaccaagaaatacagattatgtgtgaagcaaacaccaaactgcctttcttgcctcagaaggaggctgaacaaagggtggagttgctcagcaggtctgcttccagcttatgttaatttgtctctttctctcttctctctttgtggtagaagaaaaataagaatcgcttatttttattttaagcaaagaggccttagagatcattcaagctcagtgattttaaaatgtgtttttagtcggttgaagcccttccgctaacaagcacttgtgctgcagtctgagatacgaaacacactatgagagctgctcagacgacagcagtgatggggagcaggctttgcctttctgcctcccgtgtccacatttcctcctataagtacagcggtcgtaatagattaggacctactcatatgacttcatttcaaatcaattacctctttaaacactctacccaaaggaggtcacactctgagatgctgggggtcaggatctaagcatatcaatatgaggggtgcaattcagcccatcacagtgcttctgaggaggtgctccgatctcaggagccagaggcccggttctgggtttcagactcgactgcaaacgatgagtccctcgcctctcgcctgcggcccttctccacccctcagctcctgcctttgcctgcctgggtgtgtgcccaccccttaggccaggactcaggcggctcctcagcgaggcttcctcgcctctgcatgcgcctccagttgctcgctcacctatctgaggtcatgtggctccttataccttttttcttcctctttttttgtttttgagacagagtctcgctgttgcccaggctggagtgcagtggcgcgatcttggctcactgcaggctctgcctcctgggttcctgccattctcctgcctcagcctcccgagtagctgggactacaggcgcccaccaccacgcccggctaattttttgtatttttagtggagacggggtttcacggcgttagccaggatggtctcaatctcctgacctcgtgatgcacccgcctcggcctcccaaagtgctgggattacaggcataagccactgcacttggccttcttcttttttttttttttttttgtttttttttttaagagacagggcttgcactgtcatccaggctggagtgcagtggtgtgatcacggctcattgcagccttgaactcctggactcaagtgatcctcccacctcagcctcccaagtagctcagacataggcacgtaccaccactcctagctaattttttgtgtatgtattttgtgtagagaaagggccttgccgtgttgtccaggctggtcttgaactcctgggctcaagcaatcctcctgccttggcctcccaaagtgccgggattacaggtgtgagccactgcacccagcctctttattcatatctctaacagctgctaacgtgaatgcaattcttcccatgttgaacactccaccgcctatcccaggatgtggtctagagcatctgaacatgctcagtgcatgttgaaagagagagagggagagcaagaggtgcacagagggccatgtctctgtggatgggctggggtcaccagtgcaggaccagccgcgtgttctgagcccaggcctgagggccagagccggtgggaaagtccatgtggcacagagttggcatcttaagttcgtgtcaactaaaggggagggagaggggttaagagcaccagcaggggactcagacctcggttggagtgctggtttgggtttgaatgctggtgtgggttggagtgctggtgtgggttgcagtgctggtttgggttggagtgctggtttgggtttgagttctggtgtgggtcggagtgctggtttgggtcgagtgctggttcagggtggagtgctggttcggggtggagtgctggttcggggtggagtgctggttcgggtccgagtgctggttcgggtggagtgctggttcggggtggagtgctggtgtgggttggagtgctggttcgggtccgagtgctggttcggggtggagtgctggttcggggtggagtgctggttcggggtggagtgctggtgtgggttggagtgctggttcggggtggagtgctggttcgggtccgagtgctggttcgggtggagtgctggttcagggtggagcgctggttcggggtggagtgctggtttgggtttgaatgctgattcggggtggagtgctggttcggggtggagtgctggttcagggtggagtgctggttccggttggagtgctggtgtgggttggagtgctggtgtgggtcggagtgctggtttgggtcggagtgctggtttgggtcgagtgctggttcgggttggagtgctggttcggggtggagtgctggtttgggtcggagtgctggtttgggtcgagtgctggttcaggttggagtgctggttccagctggagtgctggtttgggtcgagtgctggtttgggtcgagtgctggttcaggttggagtgctggttccggctagagtgctggtttgggtcgagtgctggtttgggtcgagtgctggttcaggttggagtgctggttccggctggagtgctggtttgggtcggagtgctggtttgggtcgagtgctggtttgggttggagtgctggttcgggttggagtgctggttccagctggagtgctggtttgggtcggagtgctggtttgggtcgagtgctggttcggggtggagtgctggttcgggtccgagtgctggttcgggtggagtgctggttcgggttggagtgctggttcggggtggagtgctgatgtgggttggagtgctggttccggttggagtgctggttcgggtcggagtgctggttcgggttggagtgctggttcggggtggagtgctggttcggggtggagtgctggttcggggtggagtgctggtgtgggttggagtgctggttctggttggagtgctgattcgggtcggagtgctggttcgggtcggagtgctggttcgggtcgagtgctggttcgggttggagtgctggttcgggtcagagtgctggttcggggtggagtgctggtgtgggttggagtgctggttccagttgagtgctgatttgggtcggagtgctggtttgggttgagtgctggtttgggtcggagtgctggtttgggtcggagtgctggttcgggttggagtgctggttccagctggagtgctggtttggggtggagtgctggtttgggtcggagtgctggtttgggtcgagtgctggtttgggtcggagtgctggttcggggtggagtgctggtttgggttcggggtggagtgctggttcagggtggagtgctggttcgggtcggagtgctggttcggggtggagtgctggtgtggtttggagtgctggttccagttgagtgctgatttgggtcggagtgctggtttgggttgagtgctggtttgggtcggagtgctggtttgggtcagagtgctggtttgggtcgagtgctggtttgggtcggagtgctggttcgggttggagtgctggttccggctggagtgctggtttgggtcggagtgctggtttgggtcggagtgctggtttgggcgagtgctggttcgggttggagtgctcctttggtcaccatgtgctggatgtaatatttctgtactactgttacctcttgtgtgaaatgagcatgacaatacctatcatctcaagatagtttttgaggaatgaatgaggaggtatttgtacatttggacttaaatttaagacttaacacacccagcctgggcaacatgctgaaacctcgtctctacaaaaagcaagaaattagccaggtatggtggtatgcacctgtagtccaagctactcaggaggctgaggtaggagaatcaccagagcctaggaggtggaggctgcagtgagccatgatcatgccacagcgctccagcctgggtgtaggaatgagaccccatctcaaaaataaataaataaataaaaaatactcaacagacagtagctgccacttttgaggatggaatgctggcatggatacaggtgaatagggcccccagaggacattggggcatagcttgaaattaggtcaggcaagttgccatctgttccaactttcagcaccattattatttgtgttatttttaaattttttaagagaaggtctcgctctgttgcccaggctggagtgcagtggcccgatcatagctcctggcagcctcaacctccttacttcaaaggatgctcccgcctcagcctcctgaatagctaagacaacaccattattagtgtaggtatatgggcatatttgggttctccaaaaaaaaagaaccaacaagacgtatatgtgtgtatgtatatataggtagaaaaaagagattcattttagggaattggttcatggagtatggaagctgacaagtcccaaggtctgcagagtgagttggccagctggagacccaggagagctaaaggtgtgattccagtctaagtctgaaggcctgacagccaggagaggagatggtgtggttctagtgtgaaagccaggaggcttgagacccaggaagagccaatgtttcagcctgagtccaaaggtaggaaaaagccaatatcgcagactgaaggccaaggaattccctgttctcagccttcttgttctactcaggcttttagcagattggacaagacccaccacactggggagggcctctgcctttattcagtcagtggattcaaatgctaacccatccagaaacaccctcatgaacacactcagaaataatgtttgaccaaatatctgggcaccctgtagcccagtcaagttgacacaaagtgtacagtcacagggtgaagggctgatggatgccatctctacagaggtctgggccttgtgttgggttcaccagagggtgtgctggcaggctggcagcgagggatcaggcctgggatgtctgtgcagtgggctagttactctcctctgtctggaccacagaagggaaggaagggcctctttctgcagcttccttggctgtttgggtctggccaccagtggtaagatggccctagtcctcccaggcaggccagtgggagccttaccactaggtggagtgaaatgaattggcttaggtggaaaagattcacaccagtgataatggttcattttcagctccatagaaaagtgaagccaggttctggtggggaggtagacgctgcaggcagccagggctgcagcttccgttctggactgcctccagcctggacgcagtggtttgccagctcctctgctactgccccaggtgacagttccccaccactggcatcccagccctcctcttcccaggtgctgctttcagctcctcccagctgctgctcaggtggaagggaaaaccatcagctccacacgctgcttgtgggctcgttacaggatttactgcacacagaattagccagtgcttatcaagttgagtcttttgtattaatatttcaaaaacagtgtggtctgaacctttccagacaaatcttacatgcaagattatattaaaacctctcttaagagaagaaacctccagttggaggtgttgtgttagccaacaaatgtagattaattgtgctcccctgagtcagtcattgtttaatatgctgcacagattaacaccttcaggaattctgcacattgtaaagtgcaatacaaatatactaataaaataacagcagacatttattaagcttaccacgtacccgcagaccctatgctgcatacgttgaatctactatctcattcatcctcagaatgattctatggggtagattctattactgtccgcattttccagatgaggaattgtgactcagggagatggatgtagcctgtcagtatggactctgtgctggttagacaaaactgtcctggccccgtaaagccagtgttttcctcccacgatgatgcctccagtttacatccaaatgtcacaggaagaaagctttcctgcagtccagggcccgactaggtccccacagtcacagcagatttggaaaggctttgtcctccacacaccacttaaaagcaccaacccaagcagcccgagggtcctctagcagcccacttcaagccgccacactgcccagaaagtagcctccggggcagttttgcttctaatgcttgtgtctaatgcttgagacatggttgcttttgagaaatggagctgctcagtgagctgtcgcccccaccatccccaaatgcctggtcagccctaaccagaggagagcctggccagccagggcagcccccaacttcatcagcagcaaggagcttgtggtttgaccattacctttttgtttgtttgtttgtttgttgtgagatagagccttgctctattgcccgggctggagtgcagtggcgggatctcggctcactgcaacctccgcctactgggttcaagtgattctgcctcagcctcccgagtagctgggattataggcgcgcatcaccacgccggctaatttttgtgtttttggtagagatggagtttcaccacattgaccaggctggtctcgaactcctgacctcaagtgatccacctgcctcggcctcccaaaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaagatccagcggcctgctttgggttccagtaaacacaaaagtacgtactggcactctgcggattacagactcactgacaacttcatggattcatagatcaagttttgttacattgatccaaggtgaaggcacgccacagcaggttacttgtggccttgttactgtctgtaactccttgagttacagatgaaagttcagctaaagatgaaaagggctccaggcggggcaggaaaggtagcatcgtgaggccagcatctcacctatggcattttgacctaaaagagctgtatcaacagaggtaaagtgacccatacatttaccttggggttagacagcttctagttccttggactatctggaaccatgtctctttctgaaggtgccacatgcagtgaggaacctgccctggcagaggaactcgtgttcatcctctgaggccccttcgtttccaactgagccatgtgcttagcagttgggggtttcctactaatttttcggagaatgttattgtttgaaaagtgctctccacagagcatgtgattagatctttttgttacttgggtgagaatctagagctcctgtcttgccttgacagctaatattcatgcccatctattgtggtcctgtttccaaagaggaacacacaacagagtttctgtgcagtgaaacctgtgtcagacctaaaggaggcaagggctgctgaggagcttgaaatgacccttaaaagatatcaaggagaagagttgtcttcatactctcttctatctgtctgtccatctgtctattcatccattcatccatccagcattcagagcaggtctcccatattttaatgaagggaacctcatttttatttccccaagatctagagattaggaagagtgcagacagtgctgaacggctaaaaagaaacgattcacagcgaggttctccttccttccttatgggaaaccaacaaatcatagccagataggctggactgtctacagagaaagacttcacatgtggcaggctggggattccctgcctcccagtccagcttagtgcagattaggggatgcaatttagcctatacgtgaccttctatgacctcgcagcatccttggcaattcgttctttcctgtttcctgaaaacaaaggccttgagtgtccctgcaagccctgttccttgtgtaggcaactgggatcctatctctggggtgggtgcaactcatccttcttttctgaatagtgttaaagttgaatttagaatgtcgtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcgcacctactgaggttctgagctgtcagccccccagtattgaaactcaaaaaattagggaacatgataacgcattctgccctaatattgtccttttaatgtctaattatcattgtagacaaagtggcttgaacttaggctttcatcctagaagctttaccacttttactgtttctatacttttgtagctaataagtcaaatgtagaacaaagagaaggctgcatttgttcaggaaactgtaaatctgtcccatttgatcacaatcctgttgaaaggaagaagccttacgaggacagtgtgtttgctacaatgctgagccgtgacagctgcagcagcggctcctggagcacagggctgctggcatgggctcaccaccctcacagccatttgtctggcggcttgtattcagatgtatttgttcagtaatccaaaaatggaagggtgatttggaaccttgagcagcaggctggggatggctgtgaattctgctttgcacttgcccactacatcaacacgccaagaaactcacctgccccatcccagtgcattctgaacatttcttatttttatcttcttaccaaccttctctcttaaaatcagcttcattaaaatggatttttctagagtaaccaccagatcacctcccccactctcagtccgttttccagtcaaaccatttgttacttgattcagttccaaatataatgtgtgtctgctactgttaagtcattgccttatagtcaacctcaagggtagtcataaactccaagagtttcacgtgtctgactatattcttaggagattgatgggttacatttttctcctcgatagtggtcatgggggaaatgtgttaatttttcactttagatgtttgtgaaatgttggggagagtgaggggtttgttcttaagtggtgggccattgacccaaagtatttttaattccttttttaggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacacagaccacaaggttttctacacatgcttttttattagtatagataccttcacagacaatactgtaatttttagaggagttccacatcattacatcaacagtgtgaatttctaacagaggcaaaactgagcaccatagtttacaagtagaaagaccatgcttgaggacaacagaagttcactaaggatgcacgattgatctgagaagtttttaagcctcgtcctcgccctcctcctcctcgaactccccttgttcgtcggccgtggcgtcctggtactgctggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccgatgaaggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcaggtagcggccgtggcgcgggtcgcaggcggccatcatgttcttggagtcgaacatctgctgggtgagctcgggcaccgtgagcgcccggtactgctggctgccccggctggtcaggggcgcgaagccgggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtaggtgggggtggtcagcttcagggtgcggaagcagatgtcatacagggcctcgttatcaatggagtaggtttcatctgtgttttccaccagctggtggaccgagagggtggcgttgtagggctccaccaccgtgtctgacaccttgggtgagggcatgacgctgaaggtgttcatgatgcggtctgggtactcttcccggatcttgctgatgagcagggtgcccatcccggaccccgtgccgccccccagagagtgggtcagctggaagccctggagacagtcacagctctctgactccttcctcaccacatccaggaccgagtcgaccagctcggctccctctgtgtagtggcccttggcccagttattcccggctccactctggcctgccagagggaaagtgaacattagacactaaaacataaggaatttcaaaatctgtcattttgactatggaggagaaggtaggactggtcttagactggcagattcttctcttttgaatactc

SEQ ID NO: 12349 - DNA, 28198 bp, Human
cagaaattattttagataatttttgtttttctctcataaatacctttattagaacttcttttggatgcttccaactaccataaaaaataactctcccaaagattccgttttatcctagagccagcgttttccaattgagcaaacaagtaaattagcttggtgttccaatggtacccggctttggtcactgaaatgttttttctcaagttacgtgagaccatttttctaaatataacgagaggtggcaccataagcactgcacaggaaaccagctggagtttccaaagatgggtcctccctgaaggagaaagacttgttttggatggacgattgcctatgagttctcttaagtgacaaaagactgtaagggaaaatctggttactcaagaagaaagtttagacatgtcaaattgaactcagctccagagcctggccagttttaaggattacaaattttgcttaagccacgattcgctgcttcttttcaaagagaaactgctttccccttctccaaatctgaaggacaaaaaaggttgcaaactttagcaagacgaacaaaaccttaacctcgaaggatagtgttaaccacacacctgcaaacagctgactctttggagaaataacaaacgaaactcttgccttaaaaccaagcctcaactccagccctatcaggtgtggacctgggtaggcggaacagagtctgaacctcagccctgggaggctgccagagaccccggccaggttcccaggcggtccggtgaaccaaggccgctccgcgggtgccagcgctccgagtgccagagaagtggctcggatcacaagaggctggcttcggagccatctgcaggcgcccaaatcccaacctaaaatcaccacagggtcagaatctaatgtaagggggggttattcaaaggcagttggaggctggcccacccggaaacaccggctccagaggaatggagtccgccctcggaagcggggaggggaagggtgccctcgggcaggcagaggcggaggcttttagcaggaccgcggcgtccttcctacgaggtgggcgcagtcctcgcgtttgatggacgacgggcagtgcctgcttcagggaagggtgcggcagtcacggtttcccgtcttctggtctaagcagtgcagaaaacagggaagttcatctacaagggtcatgaactaagaaggcaggaggtttctgtccccggcaccggcgaatcccggacccgagaaaggagctacgggcgcacggaagcgggcggccccggctctcgcggggcttaaagcgcgcagtgtgttcgggttcacacctctaaatgtatttttgccatttcttaagtagccttaaaaatgtccgtcactatttagtccttttatcaaccgaggggcccggaaggccgcagcgagggcgtcggcgagaagccatggaggagaaacggcgcttctctcgggagtttaggtggcagcttcagcagcacacgtttcagcccattctggggccgtttctagtgtggttaacgtacaaaaataaacaaatcccctaaaagtcccacgcggacatcggcgggagcccagggccggacgccgcggtgtggagcgagggcgccggcgcggactatgagggcccaccgcgcctcgtccagggctcacttaagagcagcgtgagcagcgcttgggaccgccgtccgggacgcccgcagccctttaggatggaggccaccgtgacctccgccaccgaagcaccgcgctcccctagtcccctcagccggtcgccgttccccgccgcgcaggcgcaggagccgcggcgagcccctcggtcacgcctcgcccctcggtcacgcctcgcccctcggtcacgcctcgcccctcggtcacgcctcgcccctcggtcacgcctcgcccctcggtcacgcctcgcccatccgcgccgcgcaggcgcactgagcctcagccgctctcctcgctaccaggctcctttcctctatcgcgcaggcgcactgaacctcagccgcgccgggaggcgagcccgttggcgaggggcggggcggatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctggtgagggcgccggggcgggcggggccgcgaagggggcggggcggctggtgggtccaggtcggggtcggggtcggggtttcggccagggcgctgggctcggcgggcggcctgggcccacggtcgcaggcagcgccccgacggaggctcctcgagggtcacgcccgtttggcggccgcgggagctgccgtcgcggctggggcgcgggcaggggaagagccgtctttgtctttgtctttgttttgtccagtcgctgcggccgctcctcgcgcgtggcctcgggttggccctcgcccggcaggcgggacgcttggcacctgcggcctcccttagcctcactgcgaccccaaacagcactcctcgggttcgatcccgagccgggaagccggctcacgacgtgttcgaggtcgcacagctggtcgggggcaggccgggatggcggccgcaggcccctgcagggtgatggggccgcggccggtgtgtctctacagccgccggcgttcacgccgccactccctcccggccgcagttccacgcacagcagcgaacgctcgcacttatgccttagaaaggaaggcgtccccaaagccaggctgtagcatctgattttgaagcaagctgattgcggttctacgctgtccagacgcgcaggtggcattcttcatcgtttatcccgtctgcgccaggccctgcggccacagtggtgaccgacagccagagctcctatccaagaggagctgagtccccgggaggctgaccaagaaagaagcagtgagggcgcgggggctgggggaggaaagtgcatgacaggagactcagagttccagaaaccggcagtgtttatagagggtggcttcctgtggggctgggcctccagggcctggtgggctgcgggaaaatccagcaggttctaagctggagagtgtcatggttggacctgtttcacaatgtcatgctggcttccgtgtgtggagtttccaggtgaccactagtggtggggaatagtgccaccttaacttcagtttcctgacccttacaattagggttgacctgggcccagcttgaggggctaatacttttctcagctcttgttagcccaggctctgtcagtgtctgtttagcatagtagagcaccttttctttttgtgaccttatggaatgtttattccgatgcaggattatttgtgtttcttcttacctgcctccaagtgtgcttagggtttgtgacgttagcaatgcagctgccttgaagtttgttagtcaaggaggccagtgggactgtactgggaacttttggcccagattgagttctaagcgcaaatgtgcagtgaatacgtttccacaaacagaatgggcgtctgcaggcagagtgtgtgattcactggcaactgtatcagtggctcgggggtgtgtttgcttgcattgtgaaagcgggagtgtcaggaaaacaaccatgaggttttgtttgactgtgattcctcctgctctgcactgctgaagggtgcagagatgggtgtggacgagtggagtggacagtgtgggaattaatccggaactgccattcggtgtgtcagctgaaaagccattcggtgtgtctgcacttggaggctgcacttgcttgcttccacttatggtaatcaccaagtcctggtgggtggactgttgtttctctcactggggaccccttggaataggaagaatggtgccgtgtcatgttggcattcactgcccaggcgcctttggtgtctgcgtgccccttgtccttggagagaggggctatttatagcctggagaactcccctcttcccacagagtacttgcttggtgtgagatttttactgcttgtcatggttacaggaatgtgaccgcagtactgatgtttaaaacgttttgtctcctttacaaggacactgtgtgaatttagagaatacattataccaatccaaatccaacacttttaagcatctttttatgtgttttgatggaggagagacattaagaacccatggtgtattgaagatctttagagcaagattcttgaagttaaacctggatagggcttttggaccccactttatttgtgtatggggtcagactcaatccaagagcttcatctggaggaaagacgaccccaaaaaggagctcagactgctgtgtgagggctggcgcagtggtggccagtgcaggtccccgaggtggtgggtcccactcagctgctccttacagtggggactcctgatgtggagttctgcccctgtcaccctgagaaacgtggctttctaactgtacagagtgctacagtgtacatagggttcacagtgttgatacatactcctagtcttcaactctttcttttgaaatagtggagtttccaagaacatttttttgtctccatatctgccctcttttctcacctggaattgacaatgtagttgttctccatgcctctgtcacagtgcagagtgggcaccatgcccgtttggctgctcgttctgctgatgagcatggagactgcagcctgtggcctgcggtgtgacaggagcatgacaaggaaatacgtacacttgctggtgtgttcctttgtccttagtgtgtttattgactcacctgaaacttcaggaaagcactcaaatgggtcatggagggttggtgtatcctgacagaagaaaacgttatttgttgttgttgttttttcctttaatttcggaaacaaatgagactgaaaggtctttaaaaattgataaatggagtctaagttgaagccttgcagtcataggacccagaagtcagggcagtcacattcagtgttagacttaagcaacacaagggcagtttttatctctggttttctagcacatgttttttctgtatcttgtgatgagataagagatagtgatcacttagagaaataaacactgcttgtctttgaagcagtaacaaatgattcatgcctttctttttttttttttttttttttttgagatggagtcttgccctgttgcccaggctggagtgcagtggcgtgatgtcaggtcactgcaacctccgcctcccaggttcaagtgattctcctgcctcagggattacaggcgcatgctatcacacccggctaattttcgtatttttagtagaaatggggtttctccatgtcggccaggccggtctcgaactcctgacctcaggtgatctgcccacctcggcctcccaaagttttgggattacaggcgtgagccactgcacccggcctttcttttcttactatgcaagatgatatgttttcaaaggatagaatagaatgaccttttttcatctttgatgttattttcatgaggactgtaaacattggtgttttcccccttattgaaagcccgctctgttcttggcctgctgggagcaggaggaatgttgggcggtttttctctccctcttcctctcatgcctctccgctgactcagactgaccggtaatccagaggtctgggtctgactcagactgaccggtaatccagaggtctggggatagatggagttgacggtgtgtgttttggagctcagttcttttagttcacacaagacctagttatcagaaagaagctttaaaaatgaaaatcccctgtcacttgtagccactgttgggctgaggagaggaagcacacgcacccttcctcatggatgacttttcaggaaggactcgagtgggtgtgttgggcataccctgtctccttgcccagattgtatttagaaagacctcagaggcgcagaaagttgaaggaatagtgcagtgaagtcctggatgcccttccattctcaacattggctctgtttgccttagcactctctagatctccttattttttaaatttataatacaattgtttgtgttttatttatttttaaaaattgattcagctgggcacagttgctcacacctgtaatcccagcacttttggaggccgaggtgggaggattgccggaggccaggagttcaagaccagcctgggtgacatagcaagactctatctctacttatattttaaaaatgtattgtaaattgacaatcataattgtgttgcctgttgttattttgaccaaaccatttgagagtaagttactattgtgaccctttatctctacattcttcagagtctatctcctaagaaggaggctgttcttcttcataactgaaatttatataattatcaaaatctggacatgtaacattgaatacctgatttaacttacaatccatatacaaatttaaacagttaccccaacaatgtcctgttcccctaccccctgaaatccaggatcacaagttgaatttaattgttgtgtctctttaatctccattgatctagaatagttcctctttgtcttgagaaagccaatttgtggaaggaccctcagtgggtcttaccgggtgtttcctttgattcgattcaggtgcgctttggcaggagcacggcacagtgattctgtcctctcagtatcctccgtgggaggcacatgctgtcactttgtcccatcatcatgttgttctgggttatggtggagataactgatctcttggaagtgccacctcctctccatgagtaatgactcacctgtggggaggtgctttgagactatcttgtcagtccacaggcagactcagtggtcttggcatcttcgggggcagacccagtggacttggcatcttcgggggcagacccagtggacttggcatctttggggaattcttgcctgcattagtgttggctgtgatgattgtaaaatggaggcttctcaactcatcatttcttcagcatttgccactcggccttctctttatttcatgtcagtgtggcttctaggggttagagttcatgactgttatcatttattttgatgttcacttggcccagatatggccagaaagactccctccaggctggcttctgggtcctcttgccattcgttcatgtctgtgccactctcgggcactgcacactgtctgtggctcatgtgttcacttcctgccccacttctggaatcagccatttctccgaggagccctgcttccggctgatggggaacagcacgtagaaaccacgacctgggcaccaagaatacacctctgctgctgggtgttgtcctttctaggccctttcagcagacagagctaggagttgaattttaaaaccaagagttcatcatggtgcccgtcacattgcagcaccacgggggtctttgcccaccatcagcccacagttgctccttcctcccacagtgccaagtagctggggacttgggaacgtcagcagtgctgttcttatcaaagtttcctgtaaccctgtctctcagcagtgatttaagaaattaaggcttttcactggttgtcaattttctttgcctccctggggctgaatacagcctgttgtttcaagtatctaaagtggcttaaaagaaacttctccataaaccgaatagcacatcgctagagactctgagaaaagtactacttagtgataattgctatagaatatgtgacaaaatgtgctttcgtttcaaataaagtggagatttattcagaaaagtggagtgtagaactacactgttaaatagaaggatcacaacaatgtactcgatgtattatttgtcccttttggtaaacgtaatgagtgaaattgtaagttaaagctgaagctcttttccctccatttcatcatgaagctcttcacatggacagcaaagctgcaggattttgtggtgcgcgcttgtatacccgccacttcagccgtgtcgccatgctttgctgtgttgcatttgtccaggtgtcccccacagccttccacgcctgcgtgaatgtcagtcacagacgtgagcgtcagtcacagacatgagcgtgctctcctgccttcaccatgcctgtcagggaccagagttcagcagttgtcttgttttttcttttgagatacatttttcatacgggaatatgtgggaaacttaattgtgctgttcagtgagttacacccacatagccgcgaccgagacagaccctcgatctggaagattcagcctcccccacgcatggccgtcccccaggcagccattgcccccctccctccatacgtgagtctcaccttttctagagcggcatagccacgaaattacacggtagggtcttttgtggaaggcgtctttcgctcacatgatgtgcttcagactcatccatgttttacatagagcagttcgtttctttttatcgctgaacagtgttagtgattgcacagccgcctagctcacctccaaaggagagacacgtaaaacagccttttgtgtttggaatgccttttccagaagatcccttgatacgagagccgcatgtttgctattcttgatgccctgctggtatcgtgtgagtgttccagtctgtctgtccaccctcctacagagtgacatctgggctgtgttcagcttggggctgtcacggagccttcctgcgcaggtccatctgtggatgcaggcgccttctctcctggatgaaatactaagagtggaattgctgagtcataggtggtcgcatgtttgtttaggagcagctgccagaccttctttgcaaatggttgagccatttacacttccaccaacactgtgtgagagttctgttgctgtacatccttgccaacatttggtattgtcattctctttaattttagccattctggtaggtgtgtagtcatctgtcatttggagttttaatttgcctttgtctggtgactggtgatgagcacagagctcttttcagcgtgcactgtgtttgtgtgtgtgtgtgtgtgtgtgtgttatgggattggagtaggcagtctgtgtgtgtgtgtgtgtgtgtgttacgggattgggggagtacgcagtctgtgtgtgtgtatgtgtgttatgggattgggggagtaggcagtctgtgtgtgtgttacgggattgggggagtaggcagtctgcgtgtgtgttacgggattgggggagtaggcagtctgcgtgtgtgtgtgtgtgtgtgttatgggattgggggagtaggcactctgtgtgtgtgtgtgtgtgtgtgttatgggattggagtaggcagtctctgtgtgtgtgtgtgtgtgtgtgtgttatgggattggagtaggcagtctgtgtgtgtgtgtgtgtgttatgggattgggggagtaggcagtctgtgtgtgtgttacgggattgggggagtaggcagtctgcgtgtgtgtgtgtgtgttatgggattgggggagtaggctgtgtgtgtgtgtgtgtgtgtgttacaggattgggggagtaggcagtcagcttggttgcatgttggaagttactcatgcagtcgctcttgcttctgactggcttgagttccagagctgttggctgcgtggagtttgaccccttccttagtagcagcgctttgagtagtgggcagagtctcagggtgttctgtgtggttggagcaggctggtgtgccgggcctctcccttggtacaggttggtacagggagcatagcccagtctggagtgaggctaccaggggactaagaccttgctttgtcacatgagatctgtaggtgagtccgaagacacaagtgtgctgcgtggcagtgtcgctggcgttgctgtggcctcggatggaggctcttgggttcccaaaagagtgcctgctgatgagcagaaggtcccagcaggtttgtggttagtgattacacagccacagggcacacttcctctcacagagagatctgaaacacagccttctgtgttggcactcttctctcccagaagagcccttgtggataggagccgcatgtttatactctttgtgccctgcctgcagcggggttcctgaacactcgttccacatgtcttgaagaaggcttgttatcagcaggggctcaggaagaggaccttcatttggtaattccacatcagaggttcttggtgccacacccctcactggtgcccaccctgccctgctggactaatatttacactgcctgattctcagtgactgacttgtctcttgcctctttcctgcagcttgttctcagaacacaaacaaaacctgtgaagagtgcctgaagaacgtctccgtaagtagcacgtggactagagaccagagtgccgtccagaccgtccaaaggcacacgggctttctctaggtccagggattcgctgggatgtgtggagggctctgttgtttgggatttggggggatgttttttggaatcgttatcaaatgttattttagccatttcaggtatattaaaccttctcatgaaaactgcagttactgtctgagcatggtcagtatccatgatttcactcctatgcagatggggccagcactgcgtggccagtcttcctaacgaggcccatagcgagaaatttggctgtccgcaaagctacaccctcaggttgtgagcccgtgttttcccaggctgtcgggctgcagcagagactgctttctgagctgctcacacaggattggaaggggcacagcaaggagagagaggcaccagccctctgggccggtgggccaggctgtccatagcactctctggtcgtgacctggggctcaggtttggattttaactacctgtgtgaccttcaacaagagggtagcggtctggagcaaagttccctaagcctccacggcatgaggtggggcccgagactccccggggtgccttcccgatggagactgatgcagatgcccacctggaagaaggagcacccgtggtggggaagcagcatcacagtgcaggtcttgttaaagacgtgtgaacagggctgggtgcagtggctcacgcctgtaatcccagcactttgggaggccgaggcaggtggatcacgaggtcagcagttggagaccagcctgaccaacatggtgaaaccccgtctctactaaaaatacaaaacaattagctaggcgtggtggcgggtgcctgtaatcccagctacttgagaggctgaggcaggagaatttcttgaaaccggaagtcggaggttgcagtgagccaagattgtgccactgcactctagcctgggcaacaagagcaaaaaactgtctttaaaaaacaaaaacaaaaacaaaaacgtgtgaacagggtcctttggttttctctgcgtggtggcctgcgcctgggccagcctggctggcacctcttgggcttgccttgccacgcagctcttggttcggcagcacccaagtctcctcgcagcgctatgaaatcagcacgggaaacctgagggaaggcccacggcagcgggaagtggttaggcagaaaacagcatcctgtggggcctttttcttaggattcctgatctcgcccaccccttgccccttccagtcaggagtttaccaggttttgagaactgcagggccagaggcttcctttccccggcaatgaggtttcatgatatgaggaggccgggaaagatgtattcgatgatttctattctaaggcatgagccatgttcttaaaaactcttcttcctccacgagaccgtagcgtaggtttgaggaggccgggaaagatgtattcgatgatttctattctaaggcatgagccatgttcttaaaaactcttcttcctccacgagaccgtagcgtaggttcgagacacaccctgtcagtttgtgggacttaagtggatacttgcatttgctgattaaaaattgaaagacgctgtttctgtggtttcagatcttgacattggtgatgttgaacttgctctaatgcgcctggtcctggtgcattttctagatggtgcttctttttagtctctggatttttctattggaagtcatttcagctttaaacatagctcactattgtatgtggctttgtagcctagagtgcgtttttgccatagtaccctgtgtaaccctcaccaccctgggcagggtgtggtgatgacagccatctcgtggatgaggcggctgagggacttgcccaggtcattgtggatggggccagtccagaagggctgaaggcctgactccagttctgaacccagacagggcggtgaagagggccgcttgccctacagtagctccaggcgtgtgtgggtgtgctcttgggcacacaggaggtttctggaaggaggtgtcagtgcctgggaggtctcaagaggaccctgcgtgttggagcagtggctatggtgggctgtgtccacgctcctgaggccgtggcgggctgtgtgtctctgtgttgccgaggccgtggcgggctgtgtctctgctgctgaggccgtggtgggctgtgtctctgctgctgaggccgtggtgggctgtgtctctgctgctgaggccgtggtgggctgtgtctctgctgctgaggccgtggtgggctgtgtgtctctgtgttgccgaggccgtggcgggctgtgtgtctgtgctgctgcctgagctgcttgctatgtgcatattacttcatcgatcagaaaagcagcacaaccaccagagaacaccgtatcctcccagtgcagtcctgtggctcatggtaccactgtcatggaaaaatggaaaatcagacatttacaacttgagccacttgaaaagggaggattagccaaaaatcgttaattgcaagcaaaacccctgaaatggaagatactcccaaatgaccagaataaacagggtttaactgttaattgttacattatgctggaaaccacttaaacacgacactaaggtggtcactgtataagtagccctgggaaagaaggcccaggggacattgtaattaatatttttttgtaatagacttttgccctaacctgggccaaaaacgccatgactttctatcctattaaaaagtcagtaacactgttaatgtggagattgggagtaacaggcagtctggacttgggtctggacttgggctggcgcatgaggtgctgccgaacggcagttcttttttttttccttttgagacggagtttcactcttgttgcccaggctggagtgcaatggtgcgatctcggctcaccgcaacctgcgcctcctgggctcaagcgattctcctgcctcagcctctggagtagctgggattacaggcatgtgccaccacgcccggcttattttgtatttttaacaaagatggggtttctccatgttggtcaggctgatcccgaacttctgacctcaggtgatccgccctcctggcctcccaaagtgctgggattacaggcgtgagccaccgtgcctgacccgaacagcagttctttcaccccttcctgtgccatctgcctgcgtgctaggctgtcccctgtcacgctcagtgcctggctcacagaccgctttcgggcctcgttgtgtactgctgtggcatgggctgggcccagctctgggctcttacacacacacacacgggtgtgatggtgttgtctccacaccactgcggcctcacacctgacgttcaaggggctcagacaagagcgtctatgaggttctctccagctgtcagtttagggcgggctgagccgtagttgcatcatctttcaagctgtgcgacttagtgcagttgtgaaggtcagaggtaggaagcatggtccttgctacagatggtgaccatgctcacccaagtccattcaacacaaactcagtgagtgcctgtgatgggccaggctgtgtcctgtgttcttgggagacttcagccagtgaagtgcacaggtgcccggcgtgtggggaggagaggtctacggaagcaaacctcacaggaggtgaggaggagggggtggaggcggctggttgtgtccagtctgttgatcgaggcagggcccatccagtcagtggggagccacacagatgtggggagagtgctccaggcagaaccggcaggctgagctgaggctgagagcatgaggtggggttggcagcactcaggaggctgccaacacagaggccccgtggcctcagcagggtgagttgtggaagaggcctgagtgacgcgggccttggatgagtccgtggagagctgacagggctgctggccgctgtgctgggtgtggaccgaagggcgctgagggtgaaggcagagatgaggcgttgagggggaggttgagcctttacagccatccacagagcgatggcagcactggcgggctgtgggcagagcctggacagttctttggtttttctgttgtttctaatgcttgcttaatgttggtctctttcagtgtctttggtgcaacactaacaaggcttgtctggactacccagttacaagcgtcttgccaccggcttccctttgtaaattgagctctgcacgctggggagtttgttggggtaagtcattgttttcatttgctgcttgcaaaatcgatgcttctttgaaaatagtagtatgggccgggcgcggtggctcacgtctgtaatcccagcactttgggaggcggaggcgggtggatcaagaggtcaggagattgagaccatcctggctaacatggtgaagccccgtctctattaaaaatacaaaaattaggtgggcgtggtggcatgcacttgtaatcccagctacttgggaggctgagacaggagaattgcttgaacccgggaggcggagtttgcagtgagccgagatcgtgccactgcactccagcctggcgacagagcgagactgtctcaaaaaaaaaagaaaatagtattatgtgctcagttagcagaagttgctagaaaatgtgctgccagtagctctgtgactcccagggagaggttgggaagccaggggtgatctgctgaccgggaaagcagccctggggaacctggaggacctccttcaaggtggtcagccccagcactgagctctatctcaccacgttacagaaggtgtggggaaaagggtgagtttgaaggcaacgtgtttgacttctctgctcagtatgttttgttcatgtgtcacccctgaaactcacctgtgaattcccctagaatctccagttttcccagcttaagaatccctgcttgcgtagacagccctctttttttgtgtgcgtatctttgtatatttgattttggaggcgtttttaaattaaggaaatcagctcttgtgagattcaagttgttttctagtttgcctttatttatttatttatttatttttgagacgggctggagtgcaatggcactatcttggctcactgcaagctccgcctcccaggttcacgccattctcctgcctcagcctcctgagtagctgggactacaggtgcccgccaccacgtccggctaatttcttgtattttttagtagagacggggtttcactgtgttagccaggatggtctcgatctcctgacctcatgatctgcccacctcagcctcccaaagtgctgggattacaggcgtgagccactgcgcccagccccgtagtttgccttttaaatcagtttgtggtgtgttttgtaacctagaactcattattatgtagttgaatttattaatcttttaggcttcaggttttggggtaatacatagggttcctaaactttgtaaagaagcaatattttcttaaggtgttttgatgattctttttgtttatttgcatcttggatccctctgcaacttacgtcttacttaccactcttctaattgatttccatttcaaaatctatcagcctccatctgaaacaacttgttgctggtgttgaggccctagagaattcaaaagtttgtgtggtggtggtggttgtagtgtgggatgtctggcagggggtggtggtggtgtgtgtgcaccttcatgtgtgatgtgtgtactgtgtgtgatgcatgtgtgtttgtgaactcatcccttccatggaacttctcttaatgaccactctgaagacacagctcctggacctggggagccttgccctttggaacacctgttctggaggtgtttttaatggcatgtagcttctcatgaagtgcacacatctgaagtctctctctgcatggactttatagcctacataatgcacacatgtgtgcctgcatggaccgcagtttatagcctacataatgcacacgtgtgtgcctacatggaccgcggcttatagcctacataatgcacacgtgtgtgcgtacatatattcagtgcatttttgcatacgtatacaggttatcaccactcacagcaaagtaggtaggacttccaggactttcagaaggcccaattcctgtcaggacccccatgggagccactgactggacttcccgtcaccacagattaatgttactggttcccgcctttatgtggaggaaatcctgtgctttattggatgttttattcagcatgtgcccgagattcgtgtcaattgcctgcaccagttatctttctcgtgcagtgttctacagctgttcagccatgctgccactcagggacgcctgggtccttctggtgctgctgtgagcggtgttgtgttggtgccggcacaggcgctcacgtctggaggagtgtaggagtggagttgctgtgtcacggagcatatttgtgtttagccttagtacgtctgccaaatgtttttggagtggctgtaccagtttggcctccctcaggcaatgtgggacttggttgctccacatccttcccaatgtttagggtaaccagtcaccctaagttcagtccatctagtgggtgtgtagtggtgtcttgtgcttctcacctgcatttctgcagtgactagccgatcgtgctgagcacctttacaagtggtgggtgtttttgacaattctcttgtgaaatgacatccccacgctaggctgcagaagtggatggacacacaacacccagccctgcacatgagagcggcagcaggtgactagtcacagtcacagtggggagggggcaccacacgccacgcagggtcccgcaggggaacagggctcggggaggcagccatttcgtgacaggagggtggggtgcgatgggcttgtttggttaattctgaggctgagagggaactgacacctgctcctccgggagaaacagaaagtgtgcctggccctgccgggaggaggaagaggctgtctgagctgggaccttgtccagccttgcccacgggagcagagtggggaggagcagttgtggccgggccctcagggccctcctgatttcaccagatgccgcggcgcacatgatacccgttttaggtcttgcaccacaggtccttgtttattcttacaggtaaccttagaaccattttatccagttctagccaaaattattttggagctttaattgtaatggcctgataaacatgcttacttgaaggaaaatgaaatgtctacagcgttggccgtttgtccagaggcaaagatgcctctctttcaggcctctcccacatcctttggttcaagttcaagttcatgggttttaccctatggaatcagcaaaaggagcccagagtttgtttcccattgtgacaggatttctgtttgtttttaactagttttagctgctaatcagaaaagctatctgaggggtagatatgttttaaggccagccatcttgttgatctcattggagttctccagtcagaaaatgacatcttctgccaatgaaggtcccctctgtagttctccctcttactataatttttgcaattctacgcttccagaacaggtcagaggaggaaaaaacacaggattaaaagctcaaaaggcatttgatcagatgtaacctcctattcctgattttcaaactattttaataaactaagaaatgcggatctcagcgtccggggcagcagaggggtgaggctgcgggagccccagaggcctggccgtcggcctccttgccagggcccaggcatgcagcaagtgttcaactcccagcccctggaggtgagacggtgtcacctgtggtggtggcacagctattaactgtagttaaaaacagtgaatcatgcggtaatctactgcccaggggagtttgcttataaagccatcttcaggaggctggctgggtgttttttgtttgtttcaagatggtgtcttgccgtgttgcccgggctggagtgcaatagtgcaggcacggctcactgcagcctcaacctcccaagctcaagcgatcctcccacctcagcctcccatgtcgctgggaccagaggtgcatgcaccacacccagttaatttgttaaacagttttgtagagatgggcagggctgggtctcactttgttggctgggcgggtgttgaactcctgggctcaagcaatcctcccgatttggcctcccaaagtgctgggattataggtgtgagccactgtgtccagccaaggaggctgtttgaactgcatgattgaaaacacatttgcaaaagtagttttagggtattttttaattgcctctggtttgaactgaatggaaaaatcttggctgatttcaatgtatagatcttcaaaagaagtttaaaaggatagtaagatctgttttaaatgtgcacgtgtgtctgaaggctggttaaggaaatcataacagggtttgggaccgattagccagccgttcttcagccccaaggtcctcaaaacactcagatttgaagatgatcccgtcttgttccgtggtctcgtccgctcctccacggtcattcttttcgaacctggccgccagtatgtgccctgagagtctatttctcttgtaaatcattgtaatattcttgactttggtttaaataaaaaaaaagaaagctgcatcaggcttaacctccatttctgtgagtttagaatgtcttacgagagtctgagtatgtagcttggaattttggttagttaacttttctcaggcttgaaataccttttcaaactcagctgagacagactaccctgtcacttcagttcattatggttaatattataaattgttaataaattctaagtcacagataggaacgtgtggctgaaaggagacttggagagggcgggaccctgtggggtggaggcagggccacaggctctccacacgccaggagccagcagcctggccgaggcggctttcctccttatgctcctgtgtcctgaggttgttccccaggggcgagggaaggctgctgtgctgggtgggttctgtgtctggggcggccctaactccaggtgcttgaatctccagtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggtgaggtggtggtgatgcccgctgggaaggttacttcgaggggattcagatctgcaaggccatggaaatcacatggatacatcctgagttttcctcagtttttagaaattaagaatgtgtatagtgcccaggggatcttctaggtcgtggtagagagcgagagactgtgatgggaacctagcagtggctgcgaaccttgcttctataggcttcctcgcccggtgtcctcccatcggtgcagtaaggctgagtctgtgcgcggtgacacgggtgtgtgacggctgctaaggcggctcgtccaggcccagcatttgccaagagcaagctgaggctcagaggggacagcgtctgactgtggctgggtcagctctcctgtcgccctttccctggtgacacagcactctcctgagtgcttgctggggctctggggcaaccccaggaggaggtggtgtaatccacacctggcaaaggagaggacctgaggggccaactgtcaggttggcggcgggcgagggtggaagcgggacagattttccatgtagtcaccttgaagtcacatgctactaagtaaaagctgacaatcgcattttcctcaccatcttcagaacctggtgtatgatttttactgtgttttctttgtatgaaaaaagctttttaaaaatcacggtattgggcatttgaattgcttttattgaaaagagtagagtaatacattggaacggcctttgaagactgggttcgttgtcaccttgcctgtcctggtgggtatgtggcctgatgaccaagcttgtcctcaccctggtttcactctgggaactggagggaagccaccagaagaaacctggcgcccccactgagggacacggaagggcgtgtctagcagttacaccaccgtgcgctgtcgtttggtgctcataatgttcctctgtgttttaggagagcagagatgaagacaagacatgatgaaatcagaaaaaaatatggtaaggactggtcacgcctcctttttgtctggttgggaggcgatggcacgctgtctcggtcctcgttagtgccagtgtggcctgagatggggctgtgggttcacccatcggaacagaaggacgtctctccagagaggagcagctggcggttgtccccagcggttctgtggtgaactcactcctaagaatatctttatctcagccagtcgtcttcatgaagtctgttttctcagatagctgtttgcttatcgagtcccaagacttctgggctggaagtctgcagctgttctgccgtcgtgtttggcttcctgtgggcacgcctgcgtagccgaggtgctgtgagtttcagggcggccctctcatcctcgggagcgttgctcgttgccatcttctgagtgtggcaggcgctccttccaagcactccccagcaccggccctgctccttctcgcccagcctcggcgttctgttcttgtttggttgtgtctggagagattttggagaggagctttgaaggagccagaatgaatgtatttgccaagtgtaaaccttttatttagttggagtgaattggaaatacacattacgttatctatactcccccaaaccacgtgatgttcactgcttaacactgaacaccaccacccagccgtgcttcgttgattctgtatgattttaaagtccgcaaagagtctagtgtctcccgcgctgggtttgtggttgtgtggtgtcatgggcgtctcccgcgctgggtttgtggttgtgtggcgtcatggacatggtgggaactgactcctcgcctgtgcgaggtgcgtggtcctgggttcatggcagccgtgggcctcaggaatctgtcgtcctgcgcccacggtgctttccttgaagcagtatattaaaggctaaacctaattggaaaatttcagagccttttctgactaatgcacgtgttttgagtcttctgtttgttttagggaatatcatatatttgtggtattttagggtcccacccactgggggcatgaggacgtcgctgcggttctcggtcatcgggtggggggtggacggcaaagcccagcagccactgtgagcggcgcctccgtcaggtgcaggtgattggcgttgggttccctctcatgggggctgcagaggccccatgctgctggtgccctggactgtaaacgctgggtggctctgcccactggccgggacgtcccctccctgtcagttctggcctccttggaaagtcacctccatgtgactgtgctgtgacctgaggccacgtgagtcctgccggtctcgaagtgtcggcttgggggcgtgaggctgccttggctgctggcctcgagatgcccagtggctgatagaggctttttcctatgtgttcccgcccatcagtctcctgagtgccgtgtgcttgggcgctgactctctgggttctcttcactgctgccttgtccttgccccaccctctctgtcgcctgttgtttcccggtgtgtgtctggagtgggtggtgaccgggtacctgcgtgtgactgtcataaggagcagcaccagggttgccctcctcagcgagtgcatgcctgtgtacgtggagcgtgggcccagcagcatctctgcaggccttggctggaggcattgtgctttccttgaaatggaagagtcaagagctttttggcacctaatttttttttttttttttttttgagacggagtctcaccttgtcgcccaggctggagtgcagtggcgcgatgtcagctcactgcaagctctgcctcccaggttcacaccattcttctgcctcagcctcctgagtagctgggactacaggtgcccaccactacgcccagctaattttttgtattttttagtagagatggggtttcactgtgttagccaggatggtctcaatctcctgacctcgtgatccgcccgcctcggcctcccagagtgctgggattataggcatgagccaccacacccagccagactaatgttaatgtaaataaaagacaaggtggatacacacacacgcacacgcgcacacacgcacacactgcccagcacctgttatcaccaagcacaagctgtgtttaagttgctcgacctttactgtgccctgactcccagcgggtgtgaggctgtgggtggccggccaggctcttggagtggtgtcttctgtgtcagggccctgattgacttgcacttgccattttggtggttaatttggccctttaattgcattgatgaaatgagctttttgtgccagtttgtaataaagccattgaatggcctgtgctttggaaagcctcggctagttagaagaattcctaggaattcctgatgggagagtgcgagaaagcatgtgagtccacctggtgcagttatataaaataccagcacgcacgcaaaaacccttcttttggttttggttttccctctaaactggaagtagactcaggagcgagtttttcaataagaacttaaccagcctccttgctagtatctgatgactctttcccaaaaccgactttgagcctcactcccaaagcctgatgcctgtggccctccttgacaggcaagaaagaaacatggctaggcccttccttaccatccctctgcttccccgccgcctcttccacccagcccccagaatacatgcagtgagtagctttgttgtaatcgctgcagataattttagtgtacaatacagattgttaaagggagagagaggccaggcacggtggctcacgcctgtaatcccaacactttgggagaccaaggtggtggatcacctgaggttgggagttcgagaccagcctgaccaacatggtgaaaccccgtctctactaaaaatacaaaaattagccaagtatggtggtgggtgcctgcagtcctagctacccggaggctgaggcaggagaattccttgaacccaggaggcggagattgcagtgagccgagactgcgccattgcactctatcctgggcaacaagagcaaaactctgtctcaaaaaaaaataaaaaataaagggagagagagtgtgtgtatgtgtgtgtgtttctgcagtgtgaagggaaaactcctggtctttgggtaagtagcacaggtttactcttatgattaaatacacattttatcccagttttgtcagagtactcgagagttagattgatggtcatcttagttctttctgtagccttaattccaaaggtttaagagcagctataagcacaaagtaaggttattttgtttaatagtagccatccactgtggaactagccaaccactgtggaaagaaatacttgccttaaatttcttttcttcgccgagcatcaggaagtaagtgcttatctcttaggatctgttagagttcttgtttctagtaaattttatttcagttttaaagtttaaagtggtttgacttcaaaaaaggttaagcactgtatgagagcctgcttacaacgcccgttgttgctatagcctcagtaaatcttcttataaagcttggtttgtatggctttctaagattttgtttctggttgaatgaatgaagttatgattcaagtttattttgtttcaggcctgtttaaagaagaaaacccgtatgctagatttgaaaacaactaaagcgctccagcacatcagtcccgacgcttcctgtgaggtgcacactccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttagtatgccgcgtgttcctgtgttccatctcagtggtgtcgacatgaccgcttggaatgctgggaggcaggtaggcttttttgggtaaagtgggcctctgacccatcgtgggatgcctgggcagtctccagactaaatgcctgtggctgtcagaacggaccaggctgtgtcctaaaactgtgcccacgggcctgcctcgcaggggaggtcttggctgtctctgccctccacagctgccctgcgcaccgcatgccctccactcgcgctgggtgccgagggccgggggagaaggcagggctgcctcgggaagggcgaccttggcccccccgtgtgaaacgcacacctgcatgaggctcccgcgctccctgctcccctcgcgtccttccctgggtgtctccgtgccaggtttttagggagtgcccccccaccccggcccccttctgtgttgctcctgccacttcagtcctctgggacacagggttgagtccgagcagcagagtattggtatgtctgtctgtcccgtggacctgccccgcagggcccagcgtttgtggctacgagcaccagcccgtctgcggcggaaaccccctgtgctcgacccgcttccggctcattcaggaatgtgtggcaactgcagacttgcatctggaacggggagacgtgaggttgcgactcctgcccccagacacactgccatggtgctgcccccagacgcactgctatggtgtggtcttagtgcccagtatctcgtttgagaggctcatccttgtcagaaacattaggcttagaatcgtttaagaagttgcaaattttctggccgggcacagtgctcacgcctgtaatcccagcactttgggaggccaaggcttgtggatcactcaggtcaggagtttaagaccagcctgaccaacatggtgaaaccctgtctctactaaaaatagaaaaaattagccgggcgtggtggcgtgcgcctgtaatcccagctactcgggaggctgaggcagtagaatcacttgaacccaggaggtggcggttgcagtgagctgagaccatgccattgcactccagcctgggcgacgagagcaaaaacactgtctcaaaaaaaaaaattataaagttggaagttttctgattacactgagacttctgctttaaaaggaatggttggtgagtaaaatacttcctctctgatgtctgctcttcaaaaaaaaaaaatattgtgcaggttaaaaatacagtcactggccgggcgtggtgcctcacacctgtaattccagcactttaggaggccgaggcgggcggatcacctgaggtcaggagttcgagaccagcctggccaacatggtgaaacctcgtttccgctaaaaatacaaaaattagccgagtgtggtggtgtacgcctgtaatcccagctactcgggaggctgaggctggtgaactgcttgaacccaggaggtggaggttgcagtgagctgagaccatgccattgcactccagcctgggcaacagagcgagactctgtctcaaaaactaaaaataaaaatgcagtcactgtgggtgcccaggccagcgtccctgttagctggtcttgtgtgccttccaaagccagtctgtccttcggcctccgtggggcaccaggtgcagggcttctcaggaccgtcagggtcctcacccagtcccacccgtctgctttgggaggcgtagcttccacctgcagtccagttcgtgctgcctcggtgtggcatttgactcagctgtgaggtcagcttctagaagtagaattctggatcaaagggtgtgtgatgtgtacttgaaacgttgactagaatctgccaaatttccctccaaagaagatgcctgactgtggggatctaatccctggcaggacagatggaggggagtggggtgtccagtgtgttcagcacactcgaggacagacagactggggctggcctgggcagaggcgagaacatggggaccacagcggctgaa

SEQ ID NO: 12350 - DNA, 193689 bp, Human
gcactttcaaacaggcctcactgagttatggagaataccacctggagatcatgcacccggaacgtctctggacacaggtcatatctttgcacagacatcaccaattgcagctgttttctgaactcctgatgtctgccctacaatatgttcaagcccagcagtttaccagactatgtagtattattctatctttccttcctgtcagatatgggatgtccccatcagcaaaactggccgtgttccgaaaatttatttctaaatcatttatctgggatcagaagacattttcccacaggaacaattttataaacagtggtgttccacaaatgcctgcttgtgccacagtgtacctgaaatgcaacattgactgtatgattcccaccaaccattatttattcttttctctgggaaagtgcattcctcttgggatgcctgaggctcatctctccctctgcctgggagcctcagctatagttttttgggctgtgcagcagtagcagtcaggaagaggggagggaagcaaccttcccaaaaaagagatgagtgtagagagttgatatggatgcctctgggtaacttgttaatgctggaaggctgaagaaggaaaccaacagtgcgaactggctacttcccaactgttctaaaagaggcacaaagggcagggacattttcgtaaacagagatcatttctaagtcacatcttcataaacagggaaaggcatatagtaaaacctcccatttttaaagaccagtatctggacttgtaattagccaggaaaaatattgtgaaacttcttggtcagtgatgaaacagtctcaaacatataacaatgagacatagatcttgcacctatccccaggcctgacaaatagtaagtgctccaaaaaaaggggatttcaattttaattaagtactaattgagtgaattctgtattgaaaaggacaagactatgtgtgggccagttaccttaattctcattagcatctactaattctgaccctcttatagcacacatcctaaccatgaagagttggtcggagcactttcaagacgtcacctgaacattatgtcacctctgcgggatatatgcatctgtctaccccagcccaaagcaggtggtgggtctcttcataccctctctgatgtgcatcaatttctaggaatttctagtactatctccacatcaccaaatctgaggaaacaaaagagataaggagaggaaagtgaagccagtgaggatatccaagcctgtaggaccttaggtttattctggccagtattacctgctaaaaaagacctacgcttttggtttccctttggtcacttatttttataacacatgcagacgtattttggggaggtgtgcctctttcaggctagaatttagtctgctcagcagacccgggtcctgtctccttcaggttttagaattgcataacaatttaaactcattttgtatgtgcaagtactttgaaaagaaatatactattaagactccctctggtaagaagccttccccacccccacgcccaataaactgatctgttaactttttgtttcagagactgtgctttctttttattgctgcatttgtgttctacaagacagcctctttctccaagattaacatttcttatgattgttcctgacaatggattcacttccagaggccctgctaaggataaccaaaaaagggcatggagcaggctggttttggcagcgtgcacgcagtttcagagctttttaggtcttgggttttctgatgagtgatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtaaggcacagaaggctttcttttttatcttctagagagaatctggggactttctccggctttcagtcaacattcctggctaaggtagctggagatgcaagaatgttcaaggcaataaaccatgcaaactcccgagcctgactgggcttcactgccatacggatattcccggaaggcaaacaggatgagatttccagttttgtttttagaattgggacaagaagagtgaccatatagagacttacatttagggaacactggcaactttgattaggatagccttttgtttaggacagccatatgagattatacctgatatccaaaggccagtgttagcaagcctactgcaccagactgctcacacagtctcttctgcatcttttattgccaaagatttgaagaggttttgctttaaaaacaaaatcaacaatcctttaggttgatgagaagccaaaagggaatgatttttttaaccaaaggcttttgcgttatagtctgctgccagtatttaaaactagacttccagagttgcaaggaaatacggtcagagatggagagatcactagcacctagcactggttgggttaatgtcactgatgggatatttgctaagacagaagatgcctaggctggtctgtttcctataaaacctaataacaagagaatgcatgcgctagtgggtgtgtttttttagaaagcacatttaacgtcctaccaaactattttttaagaaatctttttttctgtttgaaagtgtgcctgagtgtgtctagagaatctaaagagatgtcgattggcaatgtgtttcagaaaggaaggaggcaggcttttatatctagatagacatatttgggtgtctgaaacagtagtacaaggcagctagttggtagtagcctggaattccttttagaaagagctgatggcaaggggtgggggaattttagtgctgtggcaatacatggtcaaaaaaagtggatgagaacaaagtgcttgatatttatagatgccttctattaacaggactatgcagatggacttgtaaactgaaaatccttctaatgtgtttgtcaaaaccagacatatacagctagaacctgagtgaagactagatgctatatggcaagcagggtaaatctgatgattttttagtagtgctggctattaaagactaccagctgcaaatgactgattcaactggattttattccatgcaatgcggtagtttggggttgagattcattaaataaagttttctctttgtatttagaagtttggggataattttcttgggaatgcctatttctccttctagaagtgatatatgagaacagaattccttgtgaatttccttccctggaacagttctgagtaagtgtgagagaaaagctgcaggcaaaagctatagtttaattactgtccttccctcgaagagatcaagttccaaactattttcacagtgtttttaatgtcaatcaaaatatggagagcaatttttcttttaactgttctctaaaccatgaagggaatgcagtttggaaggagatctataatcttgggatttgaggataaattccattttgaaaccaacatctccgaatccctgaaagttcaaactgtgctatgaccactctctccagatcccccatcccccttctcttgggctccccacccccaacaaccataaaaacactcatttttttccaagtaacactttaggtgttctgctgttataggtagagatagagtgagaggatttgagtttatgctgaattttaggcagttctttgtgctacttccttcctgttgaatgttacctagaacacatttccccacatagtgaggccaaaggagcacaatgaaagcacagtaactttcatttcagaaatataatcacaaaattccagaacaaaaagtcactaagagttgatcctaggacacacaaggaatgtatgtacaatggattgatccataagtaaagtgcagggttgtttcaagtattcgaagcaaatagaaggtgtaatttaaatcattccagtcaaaagattgccttaagtaaatacacaattcttatattaaagttaggagaaggagaaccaggctcaaactgcagtttaaaggattttaaatgagatacatgaaagcatttcctgacagtaaggcaactgccttattatgagaatcattaacaattctaattggctcctgtgactggcctgagaatctcctggtcttaggtagatagaataagttgatcttatggccagccatgtaaaggtccagaatctagcccaggtattctctgttctgataaataaaatgcacctcagcaggcatttttgtagaaacacatgtaattgtctccatttgccattttcttgatagcatgattaccagttagtcattccttagcaagacgcaaaagtgattcagagatgggcatgaaaagagatttgctagttccccatttgcctgtagtctatcacatgtctcagaaatgtggtcgggggacaggaaaaatgctgatagagtggtatgcaaatagcatggtaggactaaggaggaggttagaaagatgctgccaaagaattttcagacttcaaaagggcgttttctgcgttaagttctcttagggcctgagaagataccattagctccttactgaaagtccttcatctgtcaggctaatccaagtttgctattggagagatgcccataagtcctgagtagatgggtagtttaaagagaaacttttggcacaggcttaacttatgagaaccactacaacatctcagttctagtattggttcctctgcttaagtaaccctgacctttttgaggaaatcatcagcttttgacttcatctgttgagtgaagaacggacattggtaatgcttctccgatgtcccacagtggttaagacgtccaaatgagatgaagctgtttgctccctcttccctgcagattctataccctgaactgcctatcatttgagtcctctggacattatgctcatcttggctggtatcctccacttcttacctagtatccctaatgatctcttcctttctcgtatttaaggacccttgagtgatatcttctcgctcctggttatttctagagccctgagccgtgtccagtgaatactggtctatcccaatgttgtctgaatttttactttgatgatcacagactaagaggacacaaatataaggaagtggaataagatgggccatcagtggtacaaggcaccaggaaatccaaagatccacttgagcataagaccagtgagaaagtgctgacaacagaaagcccttaagtaattgaggcagcttctctgcctccagccaaaagcatggaatgaaccccggaacgtcatgcctgggccttgtaggaagggcaaggaaggcaggaacacctggctgtggttcctgttggtattgaaaccagactgctccacggagctcgcctctcacctctttgcttctgtctttagtgctcccagctgtaacggaccctagttgcatccctaacttccttacccccaggcctccacctgtaacctcttccccagctcccccatccctgtaccggatagggagctttcttgatccaacattgacaatttgcaggggccagctctaagatgaggcccagagtacagcagaacactctagcacagataggttctagctagggaaagccacttgcacagacagaggagatgtcagagcatgttttgtggtaaggacccactctgcttctcaccccaaactcataattggcaggctgtgggtaaggctatgggagcggggtcggggggaaactatgacctgggctgtgagggaggggtgatgaggttgttccctgtgttgttcttccctgtgttgttgctatggaaacctttgagaatctgataaaaactgtgaacccttaaggtccctttgtaaacccacgcttcatgattgacaggtaagagacctttgagctggggcatgtaagatggggagtggggtcagatctggattcccatagaagacaagggtggatgggatcagaacatgagtggaggtgtccatgatctggaaggaagaaaagagggggtaaatacacagatatataggtggagattgcgtcatatgacctccatttcaaagaaaaagaggtcatttccagaaaagaagcaattttctatggggagctcgtgggggctagagaaatccaggaatggctgctattaagtgtacgtaaaaagaacacccagaagttaataaaaggcttgctaagcagcagtaagggaatagttgaaggaaaatacatttttaaaagattttagtatatcgggcactcattttagtacatggcttttctttgaaaatatatgtatatgtataaatgatgtataacttgaagataaattgctttttgatggtatcctgaggcttctggcattgttttgtgaatactccatgaaagcacttgactaaaagggaataatctcacttggagagaaacatattaagtaggaatatataattagttcctctgacacccacatataacattccccctcgcttgtctcaagatacattgctggggaaccaggctgacttcaccttgtgctgaagaccagaaggaccaaggcaaagtgcccaagagggccaaggaccagttggcatcaaagatattagttccactggggtcaggaggaccagtctaagccagaatggatatcagttacaaaaatgggctaagttgtgcatgacagccaggtgagtaaagaagaaacagcaaaaatcagaagtcaggcagagcttagtgaagtagtgtatggatgaataaggtgaagtctgggagagcacatggcccagtgttaggaagaaatagacctctatgtgagcaaactttggttgctcaagtaaagggccaggattgtaagacacagattaacgaacggatgaaatcacagggatatccaagagcagaagcccaaataggaccagggcccaaagagagtagagttagagtcaaggtgggtgagaggatcccagccgcggtccatggatatttactccatccctttccactagtgtgactcagctcagcgcacgtgtctgcctctttctgttgttctatcaactggaaaatttcttctgtgtttccaggtccagtcctgagagaggagatctgattggttcagtcaaagactattgtctttggcaaatcctttagtaggaggaggacatcaaaggcacaggcgcgcctaaggatgaattactctaatccaggcagtggtcacccttgggcaaagaagagctcaatgggtaattttagttagaagagaaattgagcatggaaggcaaattagctgaaatgtccaacagctctcaatgggaatcatttgaattttgaggtgaataaactcctagagaggcaaacacccaatgaatgatcacacagttcttgatgatcactgtgacccactgagccagtgttaagggagattaatctagaagtttgcaccactggtaactgaaaggataagaatcatccatctcagaaagattttgggaaaaaacattctggatattattgttggcaagaaacttcatatgaatcttccatgtgatatggctcccttcaaatgaaagcagtcttgaagatttaatatgtaatcatttaacaattttaataaataaaaacaagcacaactcaatgtaaaccacagtacataataaggtgaatgcataaaagctggtgtactcttaatcactggaagtttcagatctaagcaatatttgctatgtaatttttaatccattgagcacccatcatggtgtttgtcaagtggactaaaatatcccctgagttctgcatagttcggatcccatttgggaacttgtgctctgttctgggctcatttttctgaaaggcatggatacatatgcattctagggttagcatcaaaggctggagggagtcaggaggcaaaacatatgctgaaccgataagggatctagagctgtttatcccaaagaaaagaaaatgaggccacataaatatcttctaatatttggggtacttttatatgaacatgggagaaggcatttgtgtttctcaaggcagcagaacagaactgaatatataaattcatagaatttttaagctgggcaagaccttaggagctcattcagcccaaggagtacatataacttttcatctgtatgccagctccaaccaattggcatgttaagaaggattctgaggatgaatctaagctcagaggggaggggaaaatgtggtcactgatagtgatatctgttgtggaagagaagggccatatctactcaagtaccatgttttagtcttcattaatgtggtctgtaggtttttaacctctgggtggtggatccctgggaggccacaaagtcattgcaagaggtaaacaaatctgtatatgcagcaagtgcttttggcaagctactctgagtaaataatatatcttacatcatatgtgctactatttttctaattctatacatacattataatgataaaatgctaatttatttaaaagagttattgaattcatagtagcttttaagtttgtgtttttgtgttttattaatgagtggacttaaaacatataattatattatgtgtgggaaggttgggacaggaaatttgggatcttaagtagaaattctttttaaaagatgaaccagtgatctattttttattctccaaagcctagccacaccaagtaaaattatgtatgtatttgtaggtttcttcgattaatgtctgccctgtcttattggtctgtcagatatataaggacaggaacctctatttttttttcattcgtatatacccagtgcgtggcacacggcagaatctcaataaatatttgttgaatgaaataacaaaccaagtgacttgaccaaagtcatccagttaattagtggtaagatagttccaaaacacacagctcctaagttccaagcagttaaccttttcaatataccacattacttcccctgatagtaagagagcatgttttaacagttagcaaatttaggttatacaatgctgcccaatctgcctatatacccatgcatcttaaccagtatcttaatcagaatcaactgtagagctttttgaaaatacacatccctgagacctatcctctagagattctgattcggtaggtctagaagggggtccaggcatctgtagtttgtaaaagttccctggtgactctgataaaacatcctggctcagaaacagttctgtgcacctatcgttaaaataattgatagtagatgtatgtagttacttattcctcagaagcctatttctttagttttgaataatttctttctaaaaattatagttgcatatgccaaataatccgtttggccagaagagcaaaacctttagttttgcttttttttcagtttaagcacaaagttatcaaccctgtaaggtcaaatttttctgatgagatttccagtgtttgcttttgtaaaggactggaaatgtggcaagaataaaatttctcatggtatttcccacttccttttccagccatcattactaagggaaatttaggcttagagggaggggtgaatctaggagaaaaaaaattttaagtatttctgttcttaggaggttttgagcagatatttcgcttcctaggaaaagctgaagatgtttttctctgtttccactttgtggtgaggatgcacaaatcctgaagaggggagaagcttcctccacctccaccctcacccctacatcttctctagggcaggagtcatcacagcccctggtttagatgcttccctgggtggcccttttgaaagtatgtggaccctaagagacaggagactttgagtgcatggatgggggataatttgcttttgcagaaggacagaaaatttatctctaggttcttcctttattcggcagttaggaattacatcctctgtattgcacagaagaatctaccatattcagagcactgagtacatggattatattcactaaagattggagagctaaaagtttctctgcaagagtgacctgatctagtaagaatgtcaaaattgttactatatttgtacccttgctcttcggtttagagggcaggtgcttccgtgtgtacatagaagcagagcttgttggagaagaggagctaaaaaggaattagattagaatccacctctgtacaatggcaccatctggactcagtctccttcatctctaacactgtccccactttctctgcaccccaaactcatactggctcccaaaagctcattgttaaactttcgagaattttgagagccagttgtaaaacacagccattataaaaactaaatcatataaacttacaattaaacacattatatgaagagccaagataataaatactcaaaactcttcctaattattttgctatgtttcactattatctattctcttgaggttagttacatctattgtggctatatggtggaaatactgtataaaatgctgtgcaactgagcttctcctcccaattcttcattcagtgatgtcatattcagaacttgaaattgaccatgatggaagtaattacaccacagaaatcagcccatgctacaaagcagactcccctcccctcacccaagaacttgttgctaaacattgactagcacatcactgaccctaagggatgcggtggtaaaattagcctctgcattggagagccaagcggaatacctctgtggttcagttacatgcatattcataatgtatgcttatgattgcatatttgtttgtttgcttgcttatttatttctcatgctcctagaacataagctctatgaaagtagagactttgtttggctttttcagtgctgtgatttgaacctaaaaatgtgctgtgtcctgcacatagtattaataaatgagttaaatgagtgaaagaaataaatgtcaggctggtagtggtagctcgtgcctgtagtcccagcactttgggtggccaaggcaggcagattgcttaagggcaggagtttgagactagcctgagcaaaatggtgaaacactgcctctacaaaaaatacaaaaattagccggccatggtggtgtgcatctgtagtcccagctacttgggaggctgaggtgggaggatcacatgagcttgggaggtcgaagctgcagtgagctgagattgtaccactgcactccaccctgggtgacacagtgagaccctgtctcagaaaaaaacaaaaagtaaaaaaaaaaaaaaaaaaaaaagtctacaatttctactttaaaaatacctgaagccagtgttcatgttggagctcattgattcctcatgaattgtatcattgttcagtgtttagaacagtgcctggcacatgctaagtagcatgtagatttttattaggtaaaaataaaataagttatcttcataacagctaattttacagatgaagaaactgagttacgattagattaagtaatatagctaaggtcccacagctagtaagtagctgggtcaggatctaaacccgggataatctggaggcactgcccaccttctttaccactgtgctatgctgcctcttgctagttactccacgtcactgagactcctcttttgtatgtggctctagaaagaattgagatctatttgagaacaaactttggagtcaggagaacttgagtttgaatctcaaatttaccacttttttcacttacaaaatggggatgatttctcctccactttgtagttgtcacaactactagaagtaatatcttgaaactgctttgcacgtacatgatagacactcaattacaaatggtcagctattggctgtgatttcctgtggaggctacctgttagcgtggggcttagccacacactgtcccctgttgcctcctctaggccatcctgtagacagattaaaaagggctcactgcttctacatttggggtctccaggaggtaagactaggaccaatagatacaagttctaggaagtcctatttcagatcagcttacagactttctaaatagatatttctgtctctgaagcacgaacctcgctgctctacagaagcagacaacttccactgtcctttccaaccagaaggtttacctgcttgcccttatcaacaaatctatgctgcctttaacattttaaatcattttatctagtatagctaaagagttgtattattcctgagattgggttgttttgcaggttttcagtgttttagacctggaatgagagggagtaagaaaagagggagggagaggaaaagagaaaaagaaataaggagagagagagagagagagagagaaaggagaggacagagagggaggaagggaaaagggggaagaggagggaggggagaaggaaattggaatttatctggagaaaaagtactgaacttgggagagagactgaagagcaatggattgatagttatctgaagtcctcacaggttaaggatggttgagaagataagctagctcattcagctaccttgctggcatactagctatgtgacaggcactgttctggttgaggactgctctctcagagcagtaaagtaaatcaaataacttgcccaaagtcacactgctggaaaatgccagagctgttcaaagctcctccctaactccaaccctctccaattctctacagctatctgctctgtgtcttcccccaagaaagcgatggaaaccagagcaggaggtttccgtaaccagtcattataatttgtcagggagccatactgcagttcaactagacaagcacattgtcattccctgccatataaggaaacagagctaaacaccattgctttcactattgactggagaggttgctcaagttagagttagacaagatgaggatctagacctagagcagttaaattaaattaaaaaaagaaagaaagaaagccagagaagtagttttgtgttttcttttcctggtaccagagatagtttaacaagcagtttccatccttctccctgactcaacgggagattttccctgacattaggcactaaaggattcaactactcgtacaaatacttcaagctgttttggtgtttgattatgtcaaattttaagaaaaggcagaggatcagttcaggtattcaaaaggccaacatatccaaaaggtattcaaaaggccaagacagagctgcttctgtgtgggtcaggtagaaagtcaaggactgtatttctctgtccattgatttacaaaagaaattagtgtccactcaccttcccaggtgagatactacttattaagaaataaaatcagaaatactacttattaagaagactttacatttaagtttgaccttcttgtccaaagctaagaatattcacggggtcactctttgccttaagactcagacacaatgggcactttatttgtttgtttgttttttgagatgaagttttgttctgtcacccaggctggagtgcagtggcacgatctcggctcactgcaacctctgcctcctgggttcaagcgattctttcacctcagcctcctgagtagctgggattataggcacacgccaccatgcccagttaattttttgtatttttagtagagacggggtttcactatgttggccaggctggtctcgaactcctgacctcaagtgatctgcccactttggcctctcaaagtgctgggattacagggaccatgcccggccacaacaggcactttagaatgcaggctcagtaaccaactttatgaagggagaaacagaggcatgaacagttgaaactatttccttaaagacagccagttccatcttgccatacagagtgcccacattttcagataatccgaagaggcatcacttagtgtccccagggaaatgaaaaacaaaaaacaaaaaacaaaaaaacctgtaaatagtctggtcatcttctcctaactatcatcttggaccagattgcatctggagtactagtttattaggcatacccgagactgggtaatttataaagaaagaggtttaatggactcacagttccacatgattggggaggcctcacaatcatggcggaaggcgaatgaggagcaaagtcacaaattacatggtgacaggcaagagagcttgtgcaggggaactcccatttataaagccatcagatttcctgagacttattcactaccacgagaatagtatgggggcaactgccgccgtgattcagttatctccacctggccctgcccttgacacatgggattattacaattcaaggtgagatttgggtggggacacagccaaaccatatctgatgccacaacaaaatgcacaaacaaatttatttctggatggaggttagaagtccaagatcaaggtgtcagcagggttggttccttcaagggctgtgagggaagtctctgttccagccctctctgtttcacttgtagatggttatctttgtgttcacaaggcattctttctgaacgtgtatctgcatccaaatttcctcttcttttttttttttttttttttgagatggagtttcgctcttattgcccaggctggagagcagtagtgccatctcgactcactgcaacctccatctcccaggttcaagcaattctcctgccttggcctcccgagtagctgggattacaggtgctcgccaccatgccaggctaatttttttgtatttttagtagagacaaggttttgccatgttgggcaggctggtctcgaactcctgctgtcaggtgatctgcctgccttggcctcccaaagtgctgggattacaggagtgagccactgagcctagcctcctcttcttataaagacaccagttgtattggattaggggccaacttaatgacctcattttaacttgattacctctgtaaagaccctatctccaaataaggtcacattctgaggtcttaggggttaggactgcttcaacatatgaatactcgggggagatacaattcaacccatagtatgtcccaactcacaatggtggtagaaatccatatggcacattttctgaagctcaagtgccaaagaccctactgctgctggtattctatctttccactgggtctaagggaatgctttgctagaaatcccttggccttttgaatttgcctttgacatttactttctgcctttctcaatatgaaattctgatcccattaaaagtcaaaagaggttttcgaaatgacgcactgaagtacagcttcacatactgtggcctatctgtggacagctatgaaaccacggcggcagaccatctggtatgaggcctttaggagccaaggacggggctcagtgggaaggcttggccagggcagcctgcaagccagggaggcaggcgctgagaggggagcagcttcagggcagctggccgggccagggaggcagccacagagggaccttgtgcatgcctgcacagggcccaaagagggtggcccttttccgtcatttttatatatgctgatcacaaccacaaatccccagacacaaggaaaaatatttgaagcctacacatatttgcgctctgaatcatttgtctcttgtctttattttcctctctctcctctctatctatccttaaatttttatactttttctctcaacagtcctcctcactttatctgtctttgctctagttggtttcaagcacccatacattgtgtcttgtctgcattttccatgttctatttttaaggtattttattttagcctttttgtcccttttttgtccctttcctaaagctcttcttggtgcccatttcccagctttggtcctgctcatggcttctctgtcttaggccaggggtagtctatagacaggatgactataccatttatcgtcaaactgggacacgttgaagagggaaagaaggggcagttaataatttccctaaaatgcagtcccgaagtgggactgtcccagtgtggagtggatgcttattctatccatggtgtggttttctgctttccacaaatctctcttcacctatcaaccactccctccatttatgtaccattttttttttttaaaccttttatgttctggtccttcttttttatttcaaccccaagaagctttatgtgttcttgtatttctgtcttcttttatctcctcctcattccttcactttactctactctgctctctatcttgtctcaccacttcaattcttcttctcccttgatttccttcttttgggtacagactggactgcagctcacagaggccatgcctgtctgccatgatacatgcaggacatagtccctgcatttctgaaacaaatcaaggcacagctgagcacatacacacacacttcaaaataagccaccaaatgttacaagctgctttgggtctcagatgagccctgagtggactgttcaccccttcagcacctctacccagagactagaacaatccctacaccacgcaagcagccatgcctgttactgttacggaggcatgttctgtgtatgtgtctaggctcgcacgggatgcatttcctataggtgtacctatgtacactagagttgaaaaatgatgaaagcatatgacccgaaagacaaaaagaaagtgacaggtgagctaactgtgcattgcctttgttatgacttcagtaatctggatcatcttatcctctaaagaaatgtataccaaaggcctagcaatggctgccataggttttttgttgttgttgtcaattgaaacagagtctcactctgtcgcccgggctggagtgcagtggagcaatctcagctcactacaacctccacttctcgggttcaagtgattctcctgcctcagcctcccaagtagctgggattacaggtgtgtgccaccacgcccagctaatttttgtatttttagtagaagtggggtttcaccatgttggccaggctggtcttgaactcctgacctcaagtgatctgcccgcctctgcctcccaaagtactaggattataccatgcccagcctgctataagtctaacataagtaacaataaacttttaggcaacaagatagaataaatatttttttcagttctttttaaatgttctcatgacacagtcatctgcaacttatggtttattctgaaaaatcacttcaattttccagatattccttagacttaaggttgtgcaaggaaggcctgaaactccttcccaacttgaaaatgagaaaggaagagtattttcctcttgtaagtcgctggaagccagtccactgatacctgaaatacttgacagaatggcactgtgtcagctgtcaggagctgctctcgtcttttttatttatttatttacttatttgggaattttgaccacaattttctttctctttttttttcaaatactctaaaaattaaagaatgaggaaagaagactgtgtccccacccaaatcttatcttgaattggagcccccataattcccacgtgtggtaggagggatccagtgggaggtaattgaatcatggggatgggtctctcccatgctgtcctcatggtagtgaataactctcacgagatctgatggttttatacaggggagttcccctgcacatgttctcttgcctgccgccatgtaagacatgattttgttcctaatttgccttccaccatgattgtgacacttccccaggaactgtgagtcaattaaacctctttcctttataaattacccagtcttggatacgtcattattaccagagtgagaacagactaatacaacagtgaaatagatattttatgaacggaaatacaggttttgttcaagttctctccttccttcctctctctttcccttccttccccctcctccttttctttctttctcttcctcctcattcttcacattcttccagtttttgtttcttctcccactgagattgatatggctggaaatgtgctattatgattgggcagccttgtgctttatccatggtggcctatagctctcttgcttatatatatctttttatgaagatcgatggtaacaaaaaatacttcacccacactctgctgggaagatgcgacggtggaatggaaatatctatccagagagctccctacgaccctaagacttgacagagtcatccccagccagcctggagccactgacccacctgtgtctgagtaactgggaaacaaggagtgtaggagtttgagagttatttttgttttttacttttttaaactttcatgcctttccatatttctgctcttagatattctgttaaaataaaacaacggctctttccatgggagtagtttctagcttgctaattcttttttgagagagtgtttgcatgaggttttaagtttttaaagtcttggctcttatattttgtaggagccctagactccagatagtggtctaatagaaaattagccctggctcctgcctcatgtccacagctgataatctgtgtgactttgaatggcctccttgtgcctcgggcttcttaattataaactgccaacagccttttcccttctctatgatgccaaggtggggagcaatgtgatctttaatacaaaaggatgttaggcagtaaagtgtcttaaaacacagacatggatttcctttcttcttcctttgaaatatgaagacttttcctggttggttttgggggaagatagaaatcatatattcataaaggacacaccccatattcagagttcagaatttggagtttccaataatcatctcatgcacgagagctgactccctctgctggggctgccccacccccagttccagcctttccttctttcatttttatttatttattttcttagagatagatagagtctcactctgttgcccaggctggagtgcagtggtgcaatcatagctcactgcaaccttgaactcctgggctcaagcaatcatcctgccctagcctcctgaatagctaaaaccacagacacagcaccatcacgccaggctaattttgtatttttttgtagagaaggggtctccctgtgttgcccaggttggtcttgaactcctggccccaagtgatcctctgcctcagtttcccacagtgctgggattgcaggcatgagccaccacactggccccatcctcatctttaaaagcaatattgagaatcatcttgtttggagaaactctgaaaccctacagtgctgaaaagggaggattgagacagactgccattcaattgaagcttttcctctaatgtagtaagaattttttttttctttttttcttttttttgagaaaaagccttgctctgtcgcccaggcttgaatgcagtggcgcgatcacagctcacggtagcctcagcctcccaagtagctggggctaccacacttggctagtttaaaaactttattttttgtagagacgaggtttcattatattactcaaactggtttcgaactctagggctcaagtaatcctcccaccttggcctcccagtgtgctgagattacaggcctgagccactgcacccgacccagaaaacttttttaaaagctttatctgaaaccaaagcacatagtgcacaatggcagactcttagactcttgttgccctcagattttctaaaattgtcttttatcagcatttaagtttctaacacatgagatcacatatgtgaaagtgcttgtgctttgtaatatctgtgattttactatctatagcagaatatattaaagtgtaaaagtgctccaggaacctaagaagagtagaagaaaagcatgtttgaccccagcaactgtgcttgcagccaggcttgaacgagcaatcatgtgggtgggttaaattgtttattttttatttttgagacggagtcttgctctgtggccaggctggagtgcagtggcgcaatctgggctcactgcaacctccgcctcctgggttcaagcaattttcctgcctcagcctcccgagtaactgggactataggcacgcaccaccacaccggctaatttttgtatttttagtagagacggggtttcaccatattgtccaggatggtctcgatctcctgacctcaggtgatccacctgactcggcttcccaaagtgtttggattacaggcgtgagccaccatggctggccaaattgtttatttgtattgttctttaaataaaagtttattttagaatacttttaaatttacagaaaagtagcaagaatattacagagttctcatatgccccacacccagtttcccctattgttaacattaaggcacatttgtcacaaataataaaacaatattgatgcattattattaatgaaagtccaacctttatttggattgttttaggtttctttaagccccttaaaatagaaaaatgtttcatatggggaaaatgtaatgttcacattgtagctatatagttggaactctaatacatgagtgaaaatggtttaagctaactcttttcttgaacatatgcttactggactgacaatctcttgaggactttccacctgtaataccttaggcctcttctgttctctggtttgtttcccttgagaccgttagcagattgctcagcctgacccaccctggtgccagatgttggaaccctcttgctgctgccaatctgactagtcattccaaacagatggtaatatccagcatcacaccccctcccacaatttcacagttttaggcagaagccttagagtgaacacatttacctggctgttgaattgctgaaactctgttcttaaagttgcttcataccacagtgacttgtgagagctttgacattaatagaaggtccaaaagaagacctgagtgacgttcccccaaatcttgagatctaaagactttggccagtttaaaaacactacaatttatggaaaatacctgttagtaacaaatagagaaattataaaggagattgctttttagaaatcaccccaatgaccgtattccacatcccgagcttccaagctttctttgaaatacgagttaccagcagacactagtggaaagaatctttttaattcaatctctgcctttgagcaacttgctgactgacatctagaggcatctcagtcttctggggtggcaccttatggtggaaaggctggactagatgtggtctctcttagttttaaatctgcttggattggggctttataacgttccctcagaagtcttgttggtgtcctttctaccagatttctttttctactgtttcactttcattaacaaattgcttcacaggggacaaaattctagatgtagttcaaatactagttacaaatttgctgccttcaagatacctagttatttgattgatcacagttgtttttaaagttcattttaagtagagttatgatcaaacatgtgcaactgaatcaataaagttgaaaatatatcacgatgaggaaatgtaggtatcttctttggtatcttcatatcaaaaaattaattgagaggaacccttactaatgagtgaaactaatattcttgactcagagaacttcctcaaagcctcaaaataacaacaatttgaattggtcatctaagtataaataaagttgggaagagacacctttcatgaaaggaatggttgaactaactctcaaataggaagacatcaaagtcaaggaagaaagtaagagctcacggcttggggtggaaatggttactaagtttagccatctgctttggtctttcctgttccacatgtagctatatagtttacataaaagtatctctccagaggatcagaaagaacagatttatggaaccagatgtgagttagcatttctacaggtgtggctctgcagctgaaagaacatgttgtaccagggatgaagtttcttattatgtaatcaatataaattaccactagacttttacagaggttgataaagcaaacacgtgtcattcggattggccttctggtatataaagagaccctgcttcacaacgtgaaaaaatgtaccgtttgacattcataaaagacttggtagaaaataccatgacaataatcaggcaaggttgttcccccttgcacacagaggggatagctggtggctagatggaaattgtgttcatatgtttttcttcatcaagaaaaacaaggaaattttcataaatatttttaaagtctctcagaatctgataagaaagggccaagaggatgaaaatgagaggactggggaaaaataacagaatgcaagagaaaagatgaaaaaaggcagaattagttaacctatagaggaatatatccttaggtggtatagaaaatcagggttataaaaaaagattggtaaattgcagatcatttaaacatttgcacacaaaaagagaattttaaaattctagacaataaaagtaaaaatgttgctgataaattaatttgtgtcaaagtatttaatacaaatgttttgattttttaaagctgagtgttttatgctagattttacaatgaaacaaaaagaaaaacttctatttttgggcttctaatttgcttaaactttttcaatttagtttaaatgtattgctcaaatctctgatattcttactaattaaaatttttttcttaatcaattcatttctcagacaactgtgccaatctcccataatgattgtggatctatgacagtcttcttataaaatttctccttataaaatttgccataattactgttcatgtttctaactatgttgcttaatacacataagtttatgatttttacatcttaaagcatattttgtctgctattaatattgctacatgtttcttttgttatttacttattacataaatttaaaaccttttatttttaatatttctgtctaattatcttaaagtgggtctcattaatagcatatagataaatttcaaaatctagtcacagagatttctatcatttaatgtatgagataaatccattatatttgttattatggattatgtacaggatgtctgaaaatctgaaaacagggcaaacttaatttaaacaatatattagtcacattttaaaaatacttgcttaatatgttttcttcaagtttcagacaacatttcaagtaaagtatctttaaatttaaagcaatgtccaattttttaaccctaaaaagtataatgaatacactattttctgaatttccagaatttttagaccctatgtaatgtatttattgtacaaaacataggagcatattatttgaaatgtatctaacctacagtataagtgcctaccctatattttctgatttttttggactcaaggtaatttagtcttatttttaacatcatattttgtatttcttctttcccatgtgtattcttcacgtctttattttctcccttcctagtgttttattatgtttattgattcccttttagtctttactgttttggttatatacatccctattctagagaatatttctattaacatttaatatgcatatattacaaagtataaactttattttccctcaaaactatccgtgttcatcctataagctattattgtttaataatctgtttcgtttttaaaccttgacaaattcatttttttttaaaacagccaattgttacaataatctaccaatatattttgttgatttctttgctcacccttgcttctagcatctcactccctatttctgggttcaaattcctatttgctgaacttattctttagtagttcctttagagagtgactttgggttgtaagctcttagactttgtaaaaatacactttttgcttttacttttaatttagacctcactcttggatattcgtttagctgagtatagaatatttttgcttggtacattgaagaaatcacattttcttctctctctctctctctcttttttgaaacagggtctcactctgtcacccaggctccagtgccgtagcacagccacggctcactgcagccttgacctctggggtcaggggattctcccaccttagcctcccgtgtagctgggactacaggcactcaccactacgcctgctaaattcgtgtatttttttaaaagatgctattttgccatgatggccaggctggtctcaaactcctgggtttaagccatcctcccatctcagcctcccaaagtgctgggattacaggtatgagccaccacacccagtcaagatattattacattttcttctcacatctatttaggagaggttggctgtcagtcttgctgtcctgtcttctgccaatataattcatgttttctctctggtcacttttgtaactgaagtaaaaaagcaaaatttccacacagagaaatattcagattttaagtgtaatatatatgtgtatgtatgtgtgtagtatatatatatatatgtatgtctatatataaggtataagtttgccatatatatgtcaacatatatgtgtgtgtgtgtatgtcatatatatatacatctgtctatatatgtcaatttccattaccacattgcctaccttacacatctactgttctgatttctatcaccatagatcacatgtgtctattcttggaattcatataaatggaatcaaatagtatatattttttatctggtctgttttgtgcaacataatgtttttatgattcatccatgttgttgcatgtataagtagttcattttttaaacttaataatatttcatagaattaatatacataacttgttttccattgtcctattaatggtcatttgaatcgttcccagtttgggatattatgaataaagatacaagagatgcttctcaacttatgatggggttatatcctgataaagctattgtaagttgaaaatattttaagttgaaaatgcatttaatacacctaacctactgaaacatcacagcttatcctagcttaccttaaatgtgctcagagcacagttgggctaaattatctaacacaaagcctattttataataaaatgttgaatcttatgtactgcatatcactagccagagaaaagatcaaaatctgaaatttgaagtacactgaaattgcaacagttccatactgttgtaaagtcaaatcttcgtaagtcaaggaccatctgtgtaagattcaagtacctttttccgtgtttgtgtgtgtaaacacaagtttttatttcttttggctaaaactgagaagtggaattgctgagtctaatgtacatgtttgtctttacaagaaattgccaaactgttcactgcggtgatgctgtttttaacacttacaagcaataaattagcattccagtggctccctatctttaacaacatttggagtagtcagtctttctaatttaaacaattctagtagttgtttagtggtatctcattgtggtcttattttgcatttgtctaatgacaaatgatattcggcatattttttgttcttattgaacatatgtatatcttctatgaaggatttattcacgtttcttgcccaatctttaaattaaactgtttattattattttgtaggagctcattatactttctggatacaagtcagatatatgtattatattaatacatattttctcccagtcagtggctcaccttttcatttccttgatgctgtattttgataaacaaaagttttatattttaatgaaatcccatttatcattctttaaaattttatggctagttctttttcttttctctttaagaaatatttgcatactctatctaggttgcaaggatcttctatttaaaaaaaacttttagtttttgtttttatgtttagatctgtggtccatgtagaatgagtatttgtgtatggtgtcagatagcagttgagtttcatttttcccattcatttatccaattgttccagaacaatctgtcaaaaaaccttgtctttatgaattgtattgactccttgttgaaaatcattcatctcctgcataggtgtgggtctaatttttttttttttttttgagacagtctcactgtgtcacccaggctggagtgcagtggcacaatctcggctcgctgcaaccttcgcctcctgggtttaagcgattctcctgcctcagcctcctgaatagctgggattacaggtgcaggccaccacacctggctaatttttgtatttttagtagagacagggttttgccatgttgaccaggctggtctcaaactcctgacctcaggtgatccacccgcctcggcctcccaaagtgttgggattacaggcgtgagccaccacacccagccaggcatggttctatttctatagcttcttttctgttctatagattcatttgtcttttcttgcaaataccaaactgtcttgattactgtggcttcattaatgttagacattgcttgttacctttctactgttggagataaggatttagtacattcatacaatctccccgttcaatacggcatcttccccatactttcaatattataataattgtatgaatacttcatagcttaccacatagtatactatgattacattttctttctatattaccactttccttgctactatcccccatgatttaataatgacttcgtttcttttacctgtttgttttctatcattaatgcctgccccagggtatctgacaggaatgtcaaaccctttttaatacagtcaaacacatcaggtaatttgtcaattatttttctttaaagagacttttctggaaacttcttggcattttctaggtttggtgcacagcttgctgttctaaatcttcacttcacagtcatctgaggcatttccttcctaggactgaaaggaatttcctttgtatgtgggctgaaatttgaatcctccatttcctggttcccattattcctccttctttatactcttgttttgatgaagaagattatctaagagcatcttgaacaagcgtccagggacgacaacatttcttaaaacttaattgtttttagtatctttgatttaagacatacttgattaatttattggctgggcatagaattctaggctggaaatcatttttcctaaaacttccccaaacatacctgcactgtaacctcccaacagggtctccttgcccgcttcctagacagagctgatttgtcaagatggggaattgcaatagagaaagagtaattcattcaaaaccggctgtaggggagatcaaagttttattactgctaaaatcagtctttctgataactcaggatgggaatttttaagggtaatttggtgggtagggggccagtgagttgggagtgctgattggtcgggtcggagatgaaatcatagaagtagaagctgtcctcttgagcttagtcagctcctgggtgggggccacaagcccagatgagacagtttgtggatttttattcattctgaatactatgggcctgttcaatccagaaaaacacatcttatagttagaaattttcttatataattttggtgataatttccttctcctcatttcccatgttctgatacacacagtctcctctgtcactgaattattgagagcttgaacctcctaaaccaactctctgattttgtattttcttaactatattctacttttctgtatcttattctaatttttgagagtttccttaactttggctatatattgtttttagccatagtatttttaatttctaagggttctttgttgttgttgttgttgaacatttctttttataacatcctgatcctctttcatagatacagtagttctctatgcccctggaaatatcatttatattttcagtgcctttctgcccctgccttatctgagttttctctgtgttcctgttttctattatttgtgctagtctctgtctttcattcttccctcagaatcctggtgatccttggctgtctgtccatatataggagcaaggcagtaaaaagctgattaaaagctatgggttcaggagtgctggctggcagaaaatgggccagttattttcttcccatggcaatctccaaatacccatatctctagatcctttttcttgaacaagtttatccaaagattttctttttgctctgttacccaggctggagtgtggtggtgtgatctcggctcactgcaacctctgcctcttgggttcaagtgattctcctgcctcagcctcccgagtagctgggactatagacacgtgccaccacacccggccaatttttgtatttttagtagagatagggtttccccatgttggccaggctggccttgaactcatgacctcaagtaatccaccctccttggcctcccaaagtgctgggattacaggtgtaagccaccacacccggccccaaagaagattttccaaaactcttcctctgagttgtaagcaaagggtcaacattctgagaagtcttagggcattacctgcattgcagagccatccccatggcatagtttccccatttgcctttggtaggccctgtcagtttcactggttctaggccatgtttcacatcagtgtcttggctggaattcctaagcagatagttcatatttgcttcccattccctcccacaaaaaggggtttttctccccccagcccacggtttagcttcctcattagtaggctgtcatgggtagagggtttccatttgtgttcgtagatgaaatgccacctttctagcttgtggctttacacaggcgctcagttccagttttctgccgtgttaccaatgaatgctatcatacccttaactcaggccaacttctctgtctttgagtttcctctgtattctggaacctggagatgttcttctcttgcttacaagctcatttaagtgttgtttgtaaatgttttgcttattttttctgcaacatttatgcatttgaagcagagtagaaatgcttcttggatctgcttagtccatattgaccaaaagtctaaagttattgattcagaattctggactctgagagcaatcagtaaattatagtgcctcggtttgcttgtgtgtatattatcaatccttcgccaacaatttttttctgttaaaaaaattcctgttagaatttttataatacttatttttctatatctgtccattagtgtaacatggtggtcaaaggagaatttttttctggtagtttttcctgtcacaacatggctcccaaagagtagatctagtaaatgaaacagattgccttggactatcttaataaccattgccatcatttttcccccaaatttcacctatttattcattcagattgcattattaattgaggaaaattaaattatctagtggagatttagctttgaaggtaatttcagacatgacagctgtggtcggaggaagattctcagtttgtatgcaagtggagaagcatcatcatgggcagaggacttagcccctggtcctaatttctatttttccatgctcaaccttttaaatagaaatgagtcttgtaatgggaaaaatggaaatattgctccttgaggatttgaagaatatgagacctgaagacctcagattttatatctattaaaacattggcacaaccatgcaacattctttccatgataccatgactggtttattgaggagtctcaactcactgggggtataaagaagaaatgatttctatttttccctatcagtactgttctgtgtcaaacttccttttattactagctacagggggcctttaattacatctccgaccagtttctaaactcaagaaggataaattgctcctaccctcaccccactcccccaggctagagtctagtggcttagaattgtagggttctggctcttaaacagcttattttccttcattccagtgaataaccctggaatatgggggagcatgaagagggtggaggaagaagaggtctgtactagacttctcataataactggtgttatgaaatgacctaagccaatctgcctcttcacagttgtctggagtggagcgatctcagctcactgcaacctccgcctccctagttcaagcaattctcctgcctcagcctcctgagtagctgggattacaggtgcccgccaccatgcccagctaatttttgtacttttattagagacggggtttcaccatgttggccaggctggtcttgaactcctgacctcaggtgatccacctgcctcggcctcccaaagtgctgggattacaagcgtaagccaccgtgcccggccgattatctccaatttttagatgtaggcaccatttcctcccagataacctcaataccaggtgatatgttacaatggaaacaagtctcagagactaaattctgccacacatgaaacaaataggcataaaaacaattacaaagcctgttccatacatttggtaaagtccccattccatctttttttttttttttgagacagggtcttactttgtcgcccaggcttgagtacagtggtgcaatcatgtttcactgcagctccaaactcctgggctcaagcaatcctcccacctcagcttcccgagtagctggggccttgggcatgtgctatcatgctgggctaatttttttttttaattactttttgtagagacaacgtctcactatgttgcccaggctggtcttgaactcctgggctcaagtgatcctcccaactcggcctgccaaagtgctgagattacaggcatgagccaccacctggcccccattctattttttaaagtgctctgacaagtgcttttgcactttaagcaaaagatccactccctggcaaaagttacaatattctaatggcagagccagctcatgttctagtcaggccagaaagtttcattaaatgggcacaggcctgaatagaatcctagatctatggcacgcctctgaatgctggatttgtcagatttcttaatccctgtacacacaaggatggagatgcctgaataagtctttctatccaatccaatcacatatattgaacacccactcatttgcctggtgaagcattatttctctgtcctttatgccaatttgcagaccttcaggatttagagaatgatattgaaaacatcaatcttaggctttctggagtgtgtactcctgactagagtccttcatatgctaacagttcctagggtgcagattagaattaatttacatatattgtctgcactgaagtattttaaaacaaattttcaacagtataacattggtgacaatgctgagccaactcttaggtgatgaggggctcattgccaagggataaaaaagtagttgaatattttaggatgaaaataaactaatgttaagaaaatagtacaaccaggggagagactatctcatagaatatctatatttactaaggaaagaatatgaaggctagaatccatgaggattttatattcctcccagcaccctacttttaagctgaaattaccagtaaaagttcatgagagacactgtagtacaataccggggacacaggtagtatacgtactacaatcctgcttatgggctcttgctaatgaatcatggttttaaattcttttaaatttttatggttttaaaattctttttaatgtagtattttgggcagctgaagctgacgggtcagaactgatgcataagagagaacttcattgtaatacaaaagtcactgggtctgtcctagctgtgagaacttagataaaatattgaatcctttgcgcttccatttcctcatccattaaaagataggggtgaggggtgggagttataagaactaaatgaaataatataaataatttagccactgcctgttgaggctggataaatatcagttccctcctcttgtagccacaaagttttaactaagctgatatgtttgttacattctgctcatgtcttttccaggagaactccatctagaacaaaatgtgcattcagcaaggtataattgtgtatgtttttattgtcagttttagtcatatctgtcattttttattttccaacatgaaaagagaggtttagggtagtcacattggaaaacaaagaaaataagattaaaattccctcaaatcaactttggagccctaaaatattaatgccttgacggcttactcacaatcacaaaaggctgtgagccaacattcagctttgtattgcagaggtgatgagaacatattttcattgctagaaaaaaaattaagctatacagacagaaatgggacatgggagccaaattccacaagaacaccctcgagtttaagggtttttcccccatcttttgacaatatttagaaaaccaaagactataaacttttaaaaggaatcttggatgacttacagaaatagtaaggtcaccaaaacactttgtagatattgaatttttataaaagtatttaagttgattaatattattctcagaggtagcataaacttaaggatcataaatgcttactaaaagtgaacatattgggactagttgccaactgctgcctaatcaacccaactggtccaatcctgcattttcagtgaattgacttaaatcctactcatatgaaataaatcagtggtcggagatagcaaatctgccaataggttactctcagctgtcttaattagtgtttcctacatttttccagtttctggtacacctttgaactgccagattacacctggcagattacagctgatggaggatctatttgccctttatttagttatatcataattcatgtataagaatatgtattatgagctcactattagtagggtacatgcatgctgtttttcaaagagtcaatatcctcctgcctagcaccctgggacaagagtgtcccctgtgtgatggctccctggggagagagctacaacaaccattgaactggccatcagaggatcaaaccattgactttatctttagggtttctcccatgatagctgaagatcttctctttctctgcacccacatgagtgtgggccaatttttgaaacggcagcagtttcataaaacccaaagtttacctgtgaggcctgctcaagccttcattctgtgctcagcctttgcattctcagtctgagaatgcctcccatcctcttttagctgacgatgcagcagctaggtgtgtgggagttagcctcttggcaactcctgggccatggaggaatggccaaccacccaagttgcctacagattttcccaagcacatgtctatcaacatgtgctgtcagccaggcaaattgtttcattggtcttggatgcttttccattcactctgtactgattgaaaattaatccataattcaaggttcagctcatatacctccaccacttccttattgccccagtgagaataaatggttctccttttgggttgccacagcacaaacctccgtgtattatatctgaccaatagggtttactactctcatctccctacttcattaaaaggcaagaacaatttttattgatccttgtatatcctgccctcaattctagtgccgaacacagcatcaaacacaaagcagaggctcaacaaatgctgaatcgaactgaattcaattaattgaagaaagggttgtttactgacactgtactaacacttctaatattatcctgcctcactagggagtcttcactgggggcaggggtctggagtacaatcagaatcaactggacagttttccaaactatacaggctaatggtagtggactgtgttaaaaagctattcaggatactccgaaattatccctgctcacatctcaccaatccttatgctagttgaggaccttcaaagaaccctccctgtccaaaatacatcattcagaatcttctgtttagctctcttcattttagtgaaagtctcctaaaactagtcctggatgtgttttcatcacacttgaagtttaattaactgataactcaggcacaatggaaatacttagatagatgctcttaaattacatttaaacaaaactatttacaagcgatctagtaaaaatctgtgtctttaatgggctatttttaatgtttcctaaacaaattattgtaggtgggccaattttccctctttacttgttacttagaagcccatttggacatgttctaccccgatctggttctctcaccccactggctacagaatagtgtgtttttgtttgaaagggtcaaaacattaagaatgtgacatccaaaatatgtgctatttttttttcctggagtcaaaacccctaaagtataaatcgtttttaaatgaagaaagcagtgccaaaaggaatgaaacatatttggtccttctccaaaacagagagatagcactgaaacaggaagtggatgatttaaatatccactcggcatcttggcaacatatttatgtttaagggacttaaggttaaaaggtttttgtctggcctgggaacactctatcttccctagggtttggaggtttggggaaaacttttaacaacttatcaaatatttgcaattagccattttttggagaacaaattgttactgagaatgtcataggaaatgttccctatatgctgcatgctaccattactctcctgcttcttatgataatctctttagccacctagcttcatgtggtagaaagttattgttttattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtggccccattcttatagctagaaatcgacaatatcgggagtgtttacacaaggaagtaggccttctcctacttcccacccttcagagatgagagactgctattatccatttaccagcacaccactggaaagaatagtttaaaaaaaaaaaaaaatgagctcaaggtttttggtctaaaagactggaataatggtgttttcatttaccaaacttaggaagaacatacaaggaggaactatgggagtgcaagtcagtagttcagctttgaacattttatatttgtcacaacaattaggcatttgattggaattgttaaataagcagttggatatacaagtctggggttcagggaagaggtcctgaatatatttttttgggagtcaggcatttgcatggtatttaatgccaagagacaagacgagaccaagccagtgagttattagatagaggagctcagtcccaggataatttttagggtcttccaacatttaaaggtcagagtaaagaccagcaaaggagactgagaagagtggccaatggggcagaaagagaaccaggagggtgagatgtgctagaagccaaatgaagaaaggacttccaaaagaaggaagtgatcaactgtgtcaaacgctcatgtattaattaagatgagaattgagaattgatcattggctttggcaatgtagaaatattgatgatcttgaaaagcatcaaggatggtagagaaaaagcctgattggcatgggttcaacagaagatgggaggaaaagaactcggagcagtgaatagagacaacattttcagaattttttttgaaagaggggcagaggattggaataggagctggagagttgtatgggtttaatgaagatttctttttttcttttagcttaagactagatatattttgacatgcttgtatgatgatgagaataatctagtagaaagagatcattgatgatgcataagagaggtgacaattgctagagcaatgtccttgggtagataagagagcatgaaacctagagctaagtagggttgaccttcaataggagcatggacaaatcaggcatcgttgcaggagtaaagacaaactatccagattcagctgtaagtatattggaaaatatgatggtagaagcctgtgatgctcttatctgattgcctctattttctcagttcaataaggaagcaaattcttcaactaagactaggttagggaagcaggaggtttggagacttcaaggcaacagaggatgtttggacttgggaaacagcagacttgccaggtagcactaaggacccagttgacattactggtaacaaattttaagtaaaagcacttagcttagctgcgtgttttcctccagctggatttagcttcctgtctgcttgctacatggagagcagtgtttagagtgatgaatcaggggatgtcagctggtaaaggacggtgggtggctgaggcatgtgggaacacaagatcattggaggacagaagcccaaggaactaagaggccagggtattagaatgatcacagacatgaatgttgaaatcgctgagaattatggcagaagtagcattggaaagagttaaaaccaggagctaacatctagaaatgaagggaagtaatgcagggatcaggaaatgactgcaacaaggaggggtagaggataatattttcaggaaggaatatagctgtggagcaaggagacaattgcgtctacttccaggctctgtgatacaaagggtatggaagctgtcggaagagctataaatcacgagaggaagtatagagcatgaagttgcagggaacattcaaagaagagtttgagatacagggtcttggctaatgacttatctggagttccagagaaatcagaaaggggaaagacattgggtcagagcaggagatgcatagagccagttggctgtgggagtaggggttccacaaggagctggaagtcctgggggtcttgcagaatgtaaggcatcatgcagtcagtcccagtggtctctcatgaagagtgtagtggtgagactgggactgctgtggagggatttccttccaagaacacacagaattctggggctccctttccctttctactgaggttgattggaggcttgggaaggagttggttactaagagcacacaaagccctggggaccaccttcattcctctaaccctacggaagatgctatttattccataccttgtttaatgcttcagtgcagctggtccacaagtgtttgctgtatccagaagaaggtcagataaagagtgaaggcacacccctgttggaaaagaagcaacagtctctctatgattgttgattcactgtttgcctgttgactcctggaattaacactcaacagagtcaagaaacctgggtattggtcttgactgagtgtccttggataaatgcctcccccagtttgaatttgaatttcttctctgtaaaataagggagctggatcacgtgacatctaggttcctttcaagccctgaatctgagtctttaactgtggcttcctagattttgggattggcctacattggcccctgcttcctaccctttattctcagttttgccgtggtctagcttttcatttcttatgtcaggagcatgggccagccacagtacttttgactaggttgcttgctgtcccttaggtgactgtgtcctcatcatgtccggacaagtgatgccaaggattgctgcaactctagctggcctttggggatgaagtgggttagaacccaacacacactaatatggttggaatttaggctgtgcatattgtctgagaagcaactatcaaattgcttgtatgtctgtgacacaaagaacaagaagagatgaaaggagaacatatactccatgttgtctctccggctggtcctcaagttgtagaatttctgcctcttttttccccagtgctagtgggacttcccagtcccagtgcctcctggagaagtttcccgtcattgttcttggataaggaaaactctgcttggggttttggtacatgtcactcttgctttgtgaatatttactaaacatggttttggctgtatagctctgatgcactgtaatgatatcattcacctatctgaagtctcactgtttagaggggtgaccctctaaaccatttctcatgttttttaaggttgaaggaatgtttagctgagcctatgaggtcctataccaaaattttacctatcttctggaagctagcaaggcctaggatttttactaaactgaaaaattcaatgaattagtggaactgagaaatttggtgtttagagaaaatgaaaatatagacagaatacttaccaccatttacaaatatacaatattctcaaaagaaccaattatcaaataaaacattttaagatatctatcctttgaaaaacaaagcctattaattttttaaaaactatcctcgaactggcatatatcccctttgtaaaatatcaattccttaagaatctttctttcaaaatagcaattgtgataaccagggtcattcacttgtgaacttgtcttgtctcctcttaactagatccagaacatttgttttgctcagtgctatcctgctttcactcagcctatctaaagttttactaatttagttcagttgtataacttccctccaggagtagtcatctccagctttaaaattttatttttctggaatcatgcaagagtttgttatgcacaaatatggactataggctttaaaaaagctaaattttatgtcaaattggaatttatctcagtgtctgattatataatgtgatgttgcaaatcaatagatgtgtccctagcactgcatcaagtaaggatgaggaacacaggggccatgtcaatccaagagcttcacagtttgtccattggcagccatttattgaaggaaattgctagattcttggattttccacttattaattttcacatgctggaaaaggtgcgaatttgactagttccatttagtctgcaatttaaaagctaccccaaaatatttgaaagagcttatgacatcattcttagatcatgtgtacatgctcagaaaccaaacctattcctgaatagcccctttctcttcagccaatttaagcaatcagtagactgttttgtatatgcaacattaactcatttggaagatttatgcttatgctgttgctctgactgagctggtcagaggattttagaagtttccaggcgaatgggtaaaatgtagggagtaagcacactttgaagtgaactgtgccatcataggatcaatgtattcaaatagacactggagaagacatttccactgtttcccatactagttacatttcattgacaatcccatggcttcaataggtgagactctactgtgtcagaaggtagaacaatgagcttcagtcttcttgaacttctcttgtgaaacctgtttccttcctggctttattaaaaaattatgtcttctgtttttggaaaagtagctgtcagaggattagagacaattcattgaattggattacttgttgtcacaaatattataatagtattgtagagcacagaccaacggagagctgttcccatttgctaggatgttgttactgcttcggttttatttttatttaaattttttatctctgctattctcctttatggtcaaaattgtaaagagtgcatctttggaggaatgcaaggtaggcaagcttgctaagagcttctacaagactaccttaaaagaagacttatatttaacaaacagaatctcaacatatggacatagaccctcttgagctggttagaaaggacttttttctttatttgctctttttgaccactgacatttattttaatttttttcatttttaaacatttttattttgaaataaagtaaaagattaacaggaagttacaaaatagtatagaaaggtcccaggtacccagttttccccagtagtaacatcttgcataactacagtgcaataccaaaacccaagaaattgacattcgtgtgattcacaacgttattcaggtaagaaggtctttttaaaacaagaaataattcattacaaccacggggttcctctaaaaactgtccctttaactgaagaacacctgattgtttgttgtttattcagtacttctccacattttgcagaggcacacaaaatcatttttataaatcccaacctatgaaggacagaacaaagtcattgttctatttttcaaagtatacaaaagctaaacgagaaaaaaatcatctgggaaggcagaaatccattggtgcaaagtttttagaaagctaagtgaagtagtaattatcttactcattccattattgaagacctcttcaaaattttattcatttacaataaaatttcaataaattcaattccattctattacaataaaatttccccatatatttctaaaaagtcacagttttgtggcaacaagatttagaattttcaaacaatactttttgtcacacttgccgtcagcccattttgttataacctcatctgtaataaacccaaaagagtttactctttttctttatttcttggttaactgtttttgagttttatatgcacagatagcattccttgaagaaagaggcaaggtatacatacacacagttgggttgctattttttttcttacaatgtatttatactgttgtcaatttaaagaccaaaatattctcaggaaaatacaatattttactttttaagcttcatattctatgagtaataaatttagttttgagggataagatagcaaaccataaatatggaagcactctcttaaggtcaacattaaatctgataatatgtagaatagatttaagactatttcgaagtttcaactagagtttcacccagtgtgctttcttcttaggttttaatgctggtttacaaaaggaaaagtaaattgctttctggtaacaaattattgcagaagatcttctacttaaagcatagatgcatttttatttttcatttacttctctgtttttgaagggttcagtgtttatttggcggaggtttatgtcaattatttaatcagaagcaggccccagagtttgccagtgatattttggaatgtagggtctacttcaaagaaaggttccatgtctcttgacccagatgaagccaatttttcatagtgaagagcaaggtaattcgattttctttttcagagcaaaaattatttttagactgaatttgatgggtcatatttctctgctcagtaaatcttgcaattatcactccacactggaaaatgtaactcaatgacccaccattgcgccagagcttctgtgggcagccgagctccgagaggcagctggacatgatgtgaagttggtgtctatgacatactgcaagatggaaaccaagcagtcaaccagtggcagtagttcacatgccaacatttttgtttatttgtaatggaaaactttaggaggaaaacacaggagactgggtgccatgggtgtgaggtagagatttcaatcctgttcagtcacaggaaaatccaaattggccacgctaaaccagatccaaaatcccagactaatttcctctcctctttcctctgcgagtgtttctgatttcacacaaggcaagagcaactgagaacagggagcctgactagatgaagtaagaaccgtcgtgaggcccaggagcaagaaaaaaaggcctggagttgtagaacatgctagaacatgaatgacagtctctgcggaattaagaagcattctccactctattccatggcctcttgctgacctaactcctagtcttccttcacatctcaccttaggataccacttcctaaggaaagcttaacagactcaagtttgacttattacctttctctgtgccctgacaattcctgataccctctccagagcagggttatcacaccacattgtaatatttaatattgacatccctactggactgcaagcctaatagaacttgggccataccgctcaagtttacaattgcatgctttttgcttagcactgtgtctagcacacaggaaatgcttaatatgtatgcgttgtttatgttatccatgccttaatgtttgggatgctccagatggcttaataaagtgtttaactatctttacaacctcaacccagtccaatgtattgaaatcatctctaccaagctttgggaaattcaatcagcatctaagaagcccttgtaaaaaacattttagtacccaatgatgactatacgtaaaccctctagctcctgagccagatgtgatggcacgtgcctgtggtcccagctacttgggaggctgaggcaggaggaatgcttgagcccagaagttcaaagctgtagtgagctatgattgtgccactgcactccatcctaggcaacatagtgacaatcccatctcaaaaacaaaacaaacaaacaaacaaacaaaaccctggttttaagaaaacaatgaagatagccatgaaaatacacactggcctataaatgtatatgctaaaagagaatggaaactgaaataatggatctaatgaaaatcaggcatggttttgaaattttgttaatgtgcttcttttttcacccttctattcactttagttggattttcatggaaattcagatctaagagagaattttgagttcatgtctacacagatggtaaccagaaacttctaagacatattctcagtgtaattttcagcccataatgatgagggtggtctgtctacattgtaagaagattaaactgacagatctatgatcttgtacgtatagatggacaatgacctaaaagctatgcttaaaattgcccctggagacattttactcctgaatctgttggtttccatggtaaaatattcagttgtatgttgtcaaaaaggtgaaaaataaaatctaggagaaatctgtcatgggtagaagttggtggaacacatttaatccaccagataaaatgcttccggtctaaaagctgctgaaagatacttgaaagtctagatgttgggtgatcttatccagacagcattataagatatacaaaatatttgaagtaacgtcatattacaaggagaaaaatcattttcactgttcctggaagaagtctttctgtctacactttacccactacaaatgttgagatgttctgaaggactaccttgcacctttagtaattaatatcatttaaaaattaatctcttttaaaatgagattttccataaatgctagatgcccaatttcaaaggaaaaatctatgtgatactctgacatattggtcaaatattttattctaggggacatggtgggtagcaaggggtggtcgtggactgtaggaagtgttgacttcaaaatatatattagcatttccatcattttaaaagattttttaaaagactaacaatataacatatggacaaagggatacattccttagaaaaattttaatggtaacatgaaaccacagtaaacagtgaaggagaggggaggagaaaaatgatgcaaactatttacttccccttagaggctagaatgcagttgttttctattaaacttagattacgtttatgcgtaactgactcaattataaaatgaaagctaagcaactgttggaatttgtgattacaccatgtaaatgttacataccttggcaatgtaaaataataatataattttttaaatagagaagaaagagactgtaagaaaaaaagtaagtgtacaaatttccctatgctttatagtagggattcagataatgtctagtgataatatctgtagttaaaacaacaacaagcccagtcttttagtttttttcataattttaacttttaaaaacccatatctcattgtaaagaaacatttatctttagttcatcaacttctatcattgaagctgtttctctttgttaaattattgtaagtaatatttctaaatattagactacatttataaaactatttctacctatccatctatttttataattttagagatatccagaattttgttcaccaaatgttaacaatttatttctgagtgctagatataggtgattttttttaatgttctttatacttttttgtgtttaactttttaaaagagtcaacgacattttttttttttttttgagacagagtctcgctccgtcacccaggctggagtgcaatggcacaatcttggctcactgcaacctctgcctcccaggttcaagtgattctcctgcctcagcctcctgagtagctgggattacaggtgcgcaccaccacacctggctaatttttgtatttttagtagagatggggtttcaccatgttggccaacctggtctccggttcctgaactcgtgatctgcccacctcggcctcccaaagtgctaggattacaggcgtgagccactgtgccccgccaagagtcaacaacattttaataaaagagatagatgtttatagagagagatagttgactctctctctcttcatttctatctatgatttccttttttctttcaaaggtttaacaattaattctttaaagcattcgttcaattgtggcacaccgacctctcttgttggccagaaacttataggggtaagtctcaataaaactattgagtctaaaatcacaaaacagctgacaactttgtggcacatcacccaattcttggagacagtgccaacccttggacaggtctatattatcttgggcacgagactgcttgctaagttaaggttatatattgaagagaaatcagacatttttatttctagaattttctgtttcatgagggactgctggctatcttttatttgggccaatgcctaggcccaaaagaggtttaccagatgtgtgagaaaatgttatttctgctttatttggtgaatgataatgagtaaatgggatgaagggaaactttctagaatttctagaatcatatcttgtctgaacaagatatgaattgatcagttcacttgtcaaacaagaaagacatttgtatctatctacaaattttattcttcagttgaattcagaatatagtgatttttcataagaaacgacaaaatttaataagttatgcatttgttaaaaaaatactaacttgtctaacataatcctggaatctcaaacatattctgtagttgttttctgagtgaatgctaacactcactgtaaataaggcattgatacttccttgtataaaaatattttaaatttctaaaacctctcatcttaccatctccttttcaaacttcctccccaaatcttcagacaacttattctacttcatttgaagagaattaagtatggttttcattcattgcatttttctattatatttctacactctatgttctatttggcgatatagttagttgcctctatctccctggctagatcatgtgttccttgaaagcagaaactatgctttaatttatccctgcctctccactgtaactagtttagtactttacatgtagaagctctgtactcaagtcaacaatgtggaattgccttaagatgaaattggtgaataggtctgtagaaaaatgacttctccgtgggtcaccctgcccaccccacctgtccctccacatgcccccttaaaatgcaaaattgctggaagcttggggaagatgtatgcctctatatgtacgtacatatcatctcaaaaggaaaatttctgtaattttcatctaaaagatgcctatgagaacaaagccaaacaagtagctaaggcccgaagcactgaatgggatgaataaaatatctcgatatttacatggttcattttgaccgtacccacagggcagcaaacatctgcgtgaaaagtaaagaattcagcctgttagatgactggttgtgaagagccaaacattgggtatcatgtcatccacatgtctggttgattgaatatgaattgccccctttttatccagatagcttcagcaatagataaagcatggagatttttccacattttacatggtgcttggtgttgtagaattcagcctttgtgtgttcttttccccccgtcttgctattgcctggatctcattaggaaccattagtgatgtaatactaaacctatggaatcttaaacatgcttttaaaatcctgtggaataaagatgtctcctaccaaaccaaaaatgcagtgggaatagacaaagttacatttcttcaagaaaaaatgactcatttcatagttcccaaactgttttgactgaagcttctcaaaataaactttctggaatatggagcctttgatgtctgactttgaaaaaaatatatcatttctcaaacatacaattcaatccttttggggtgttcatgtatttctgcagattaacttacttttatttcaacaagtgaatgacacaatattaaatagccatctgacaaagaaagaaaagtatgtttgaagtggtcttaactcctacataaaccaaatataaagaacatgccatatgattttttaaattgccacaaaaatagaattttcagaacattaccagaagggggatttggtccattaagaataacaaaacagtttagatgtcatgaaagtagaagattaggagtgccattaagcttactaatgagatttttgattcatatgctatttcctaggctaggcaacatttttaatttttcacagtcttgaactttaatccttgaagggtaattcaagtttcagaacttacatactgcaatttgtttggggtggcaatttgccattgatttgcctctgggttcttttgttctctttcagctgggggactcaaaggtggtcatttattaagtccaggtctacacatgaccgctgaaacaactggttttcaatcaaatcttctaaataatccaaccatttttgtgcagttgatcagattgatttaagatatcaattgctctattcaaacaacagtgaatgaaataattgtatgactggacaatctttacttttctttcctcctcctccttcttctccttcttctccttctccttcttcttcttcttcctcttcttctttaataagagtttctctttggagtggtggaaggattggttaagatctgcattctagcttcaactcttccacctctatctgatgcttgaaaagtttctcttaacctttcaagcctcatttttcttttctataaatggagagaacaaacactgaccttgtgctatgtttgggacattaaatagatactgtggcatttgatacacaattggcctacaataaatgtaattttttcccagttccccctcaattgtacatacggagttttctgctttttttcattttctattgtgatgataacttctcaacagaagggttaaaagaatatttgacacccattatattacgctgttaaagaatattagaactagagatatacgtcacttggtcagatctgagctccagggcctgatgtctctgatgatggcaagaagagactgttgttggaatttgtgttattctctgagactttaagaatactacctttccttcagaggcttttaaatatctattatgcagtaacatctctaaactactcttgaacctatgcacatttttatcatggtaccagcattgaaagtaatagattccaagtgtttaatacttataatggaaagaggtttttctattatttgacctaaaatgatcacttcaaagctttaagatttagataaagtggggagaaagggggataggaaaaggagcatgggaaaaggggtaaggtaattaacatttataagatgatggccaagtttattagaaaacagatggagtcatacatttgggtagacctgaacttcacttccagctctgtctcattccagggcagagttgttaagagaatgtaatgtacccgcattaaaataaatttgctttgttaactataaatttaagtttggatttcctctttccaagcatttatttttataagtgattagggtaatttaaggtctttaaattgctataaaatatctaagcattaaagaggggtgagaaaaattagcattttaaaattctctatataaggataattttatactctaacttttggatttatagatatcttatgtatattttcccagaaaaaatgtgaagatttcccttttggtgaagtcatttagagttcattgttggttggtataatctgcaaaattatattcaattatgcaattaatgtaaaatattacatcacataataacccaaggtcattttatacttacaataaaaaattgttttgacccttcctgtagattaacctcccaaatgatttattggtcattaatagctcaatttttagacccaggggtcagagctcagggcattgcaactgagggtagatccctgtacagactgaccagaggagccctgggtatgccggggagaaatacatgcacatttctcaatgtctcaggctatgttttccttcagtttcaccaacaccatcttaattcaggtttcaagaatctccaaacttacctacacactctagtttagccctttcaagtatcattccatcctgtaaactgattttaaatcttcccaaactactgtttatataaaaaaaacttagtctcaaaatctccccaaactactgtttactttaaaaattttaaattaaagaggggtgaacaaaactagcatttttaaattctctatataaggataattttattattctattgtctgctccaaagaataaagtacaaaactgatatccaaggacccggtcaacattcctgctttctcccaccctcccaggcaggcttttgaatgtactcacccacgagcacagctgcccatgaccacaactgatgtatttctgttctgctgatgttgctccttcgtcatgtttgaaatattctcacacctcctttctagttatccaaatcttaactctttaagtgccaatcatcttcctgaagcatctcctaagtactccagcccacctaatcaacacacaccggagcttttctagtccattcttcaactttttacagtttaggagacccaatttgcagagtttgtgacttgcctgaggtcacaaagcaagttagtagtgtcaccatgacttaaaattgaggtcttttaccacgaacactgttgcctgaattccctaaactatcatgataacagacattttactgataatattggttttgtattgttggttcattgttcctaagtatgaaacctggatatgcccaaattgttcctggattattctttcatttcagatccaaataaaataattggggcctccatctcaatatttctgagaatccccaagaaagagataaggtggtgggatgccttatatttttgtcacctcctgctccaaattccagtcacccatttacctcctcagtccaacctctacctgcttaactctgagcatggaaaagttctttttttcttcattcccacaaagctgctgcatttaacagactttgatgaatggtttatggtgatagaagggcattaaaatgcagcccacactggatcacagctcaaaattaaatattttaatttgagaaaaaaattaactctttagctctttgccttaattctctcccatgtgattttggagtggacagggccattcaacttttacaaccacaaagcaaggtcaggatatttatgtaaacaaaatacaatagttatctaccctgggcttatgcccttagtaactctaagaagcaatagaagttttgacattagtttttctttaacttggcccaggctgaaatcttaggcagatctccctatctcagtggaccaggacaatgtcaggagccaatgggtattcatttgctacattcttagttgggaaaatgaatccagcactattttccagaatgtagtaagattaggaagagagtaaaaacagaaaatgggcattttttgccatttgctgagctttttctccataccaggttctatactgttatacacgttaccccatttccctctcacaacaaccatgcaaggtaggcattctccacttttcaatggagcaaataaacaatttgccaaagtcatccagtaagaaagtggcacaatccagaattcaaacccagatctgcctgactttaaaagcctttctggacttggccagatgacaacggcaatggcccaggcacaggaaagagtgaggaccatatcacatcacatgatattccaaatttatcagagtgctgagagtcagaataaacagaaatgtcagtcaaaggtgttatttggggaaggtgatggagggtccacgatggactgaggttcagatagagatgacttttttcattcattcttctgtttaaagctaccggatttaacacaaactcaggaccgtctacagaatctgaattggatatccccaggtcacttagtttttataacccaacaagggcaacatattcaatagactatcaccaagagcctttctgagcagcttgtatttattcatcttgcctgtgactgggcaaagggggcaggtgtctggcttttgttactgcatagaaatacaactttggtttcgttgatgtgaacagataagcactgcatgtgaactgaaatcacactatgtctaaacagaggactctgtggcacttttcttactaaaaagttgttaagtttggcaatcctcactctgttccagtcaaacattttcttaaccatattaggttatatggaaataagccaatatcgcggctggtgtatgagtaggtcctctgcaccaaggcagttttcttgagagcattttctcactggtttaaaagcaatagagacaaatgtggctcagagtatatttttaaatgtggctggaaagaaaaataaaaattcactgatccaaaaagaattcggaatcgcagctagaccaaagtcagatttttaagctggaagacttggagagatttgggtatttgcttgcttcttattgaaagactcaatcaattttttaaaagcccagccaaccttaacacagatataggagaggaaatcagaacaaaactgcatcatctgttccataattgtccaatgttgttctcgttgcttaatctcgtgggttagaaacccagcatttgagctctggattcactacattctgagtaatcctagacactgggcttaatttcattgtttgtcaaatgggggatgatatactacctatatcataggattcttaggaaaatccaatgagataatgcatgattcaactattaccaaaaaagcatattataagccttctgtttttcaaactacaacacttggagaaaagtagcagcagagaaaatagcttttaggtctgcccctggttgctctgatacagttatctgcttttcatttagatttatcatattctgctttgacagctaataattattcatctatatattcattcttttattcagaatattgagcacttagcaagtgccaagctcttaattaggagctcttattctcatctttgcaaatagatgataaatctataaagctccccccccatcttatcattagatactcttttgaaatatttttatttcaagatacatgttggccattcattcattccatgtatatttattgagtgactactaaatggcaggcaactgcaaagtgctgaggaatcattagtaaacacaataaatacatcctcatggagatttcagtctagtagaaaagacagatattaaatacataagtaaccaaacataaatatcattgcaaattgtgattgtacatgaagacaaagagcagagacttacaacagagaatgacgtggaagtaacatcttaaaactctatgtctaatgcaacaaattttaatttacaataccttggcaataaatggataggatacgtgaaaacgttatcatctgattgtactgtaacacaaaaattggtgttttcagggtgttgcaattatttagtactattccaactttgactttgtgggtttaagaaaggttaagaattatccaagtaagaagtatgcctttgtcattaggtaatggtgagggactcatttctggtctctgtggccagtaagctctagatccatgcaagaaattgaaagcaagcttgtgtgactggatcacaaaagagagaggcacaagaggaagctggagaggcaggctgagctagattatacacgacattgtaggccatgggaagagttggatctgtattctagatgcactatgaagctactgaaatgttttaagcatgggagtgacatgattagatttatgtttttaaaagggtaattgtttgcagatggctggaagatagaacagaaagaccagttgggaggaagagtccagatgagatgatggtggcttggatttgagtgacagcaacaataatgaagataaatgaaccattttaggcaaatatcctgaagggagaatcacctggatttagtaatttactgtagagggagtaacggtagatgaggaaggaggaagtgtatgaaatgattcccaagtccggagcttaagcaaccaggtaaatattggtgtcatttgctaagatgggaaaaacttgggaaacaaggactgtgttcaattctgtcctgtttgctgaggaaaaaaaaaaggggccagggagtagtggtggaactttttgtgagttatagagaggaaacaaaagtataaagcttaacacccatcttcagaatgcttgcaccctaagcattaaatccactgttgatatttccttaacaggctttctcaaaccaccagaggctctactatgatgtgtgttatctcactcgtagaatttattctttcttcacccttcctctgtgtgtgtccaaatataatgcagttgattttaataatttaatttgctacacctttgaattatctcatttatcaaggcatcagtcaatcttaaaaattagatctttattttttttttaatttttaagctcagggctacatgtgcaggatgtgcaggtttgttacacaggtaaatgtgtgtcacgggggtttgttatacagattatttcatcacccaggtattaagcctagtacccattagttatttttcctaatcctctctcccctcccaccctcaaccctccaataggccccagtgtgtgttgttcccctctatgtgtccatgtgttctcatcatttaactcccacttataagtgagaacaagcagtatttagttttctgttcctgcgttagtttgctaaggataatggccaccaactccatccatgtccctgagaaggatatgatctcaaaccagatttttaaaggcaatatattttttttggtgcttctataatcttggcagtgaataatgacaatagaagtctttaccattttgtcttcctgttatttactgtaactcaactacaaatattccaacttctccagtggtgtatgtggaaacaagaagagttcacagaaagaaaattatgatcagtttgattcccctgagagccgctgatagagtactaagctctacattacttagcaatgcaaaaacaaagtggtagagatttagtgatcaagatttatgtacaagaatgtccatcacagcactacttataatagcccaaacctgaaatactctcagtgtccagtgataagggaatgattacatataactgtaaagttatcatgttttaaaaattgtgtaaaaaatatgtataatataataagtgaaaaaattgagtgcataacatcacatttgtttttaaaatagaatcttacctttgttgaaaaaaaagactggaaggaaatatattgaaactttaaagtaatctcagggtgggaaggatgaaaagagactttagaattattttctgcataatttctttctttttttttgagacggagtcttcctctgttgcccgggttggagtgcagtggcgcgatctcggctcactgcaacctccgcctcctaggttcaagaaattctctgcctcagcctcccgagtagctgggattacaggtgcccaccacaacgcctggctaatttttttgtatttttagtagagatggggtttcaccatcttggccaggctggtcttgaactcctgacctcgtgatctgcccacctcggcctcccaaagtgttgggattacaggcatgagccaccgcacccggtctctgcataatttctgtattttctataataaaatgcatatttgtatactttctataataaaatgtatatctatatagcactcagagatggcataacttctagagatttgatgatttttgttagtggaagagatccgagttatctgcgagttaccggcggcgaatctgtaggggtccacagcaacttcagtccttgcctcctcagaagaaagaattcaactgaggggcgtgtaaagcagaaaaagagatagaggcaagtttcagagcaagagtggaagtttattttaaaaggctttagaacaggaaagaaaggcgcgcttggaagacatccaagcaggcacgtgagtgttaaagagagaaggtcgagtgtcccgtataaccgtgatcctaggacttttataagcccgtcttttccccatgcgtcttccgtagggtgggcatgcgcacagcccttcttacgcttgagaaatgcgcacgcgcagtgtatttagggagttatacacatgcccatctgaggctttcttccttcttccagcagagagtacccaggagatcttacttcgtcatttttgtctcttaatatgcatttccagaaagctgtttctctctggggtctgcactcagttaacacttttaaatgttaacaggtatggaccatcaggagattgtctctttctggctgctgtgaattatcatttttagagaggcaaagggataattgccaaaccatcacctgacatttctagtgggtggtgggagagccctctcctgctccctgctcatgactgactacctgtaacaatttgggacctttttcagtagagtgaaatagaaataaaagcagtctggaaaaccagcaatgaataattgtcaagtgctgcctgagatactgtggggtataaagttgtgtgaaaatgtgattgcttattcatggatcttatgatcaagttcccacactcctggatttcccttgtttgggttcaaacagcctaagaacataataagggcagttttgattttcatatctgagtttttcttttaagccacatcgggaaatgaaggaacacagacagacagcgggagaaatacactcgcaaaacaacctaagtatctgtgcagcctcaatatcatttaaattctggctaagtttaaggtttttcctttttttggtttcttccttcactcttcaagtgtattccacataatgtagttgtagctctgctcaaggttctggagtagcatttctatgcaagcttagttattttaagttattcacagttatttgttttttaaccctttaaaagtaatttgtcacaatcacatctttatgtgccagatatataagaattattgtcttgtctctggacagtatgttttagaacttttccttatgaagctgcaagacgtgttttacacttatcagctctatttagcctataactgtgtctgcataatgccagaattgccatttcaacagagaccaagaattccccaacagttatttggtggcaactgccaaaaatttttattgaattaatttatctttttcacttaattcaatccacttagctatgaatgttgaacccagtgaaacttctggttttggggggatttttttggcatatgaatggaagcattgctgtgtttaaaaatactatcctttggagataaacattatgggatgttcaatatgaaatatcttattaatgtggaaatgggtttcattaacccatctgtatctgcacgttatccttcatctggttaaaattccacattttaaaaaagatagcagcttgggtttaagtttgtggccacgtaagactgaagtttgatactgtccacgttaccatcaaccagctaatgtattaccaataaaaacagcagtactattcttcagtgagattctcattgtccaccttgtgtcagttttcagtgtagccctgggaagaagggcactggagaatgatgtttccatcaagatttagaagtggaaaaaattgagcttctggagacctcacttatttattcacttaacacacatttattgagaaactgctatgtgatcagagctatgctagacactggggatacagaagtgaatatgacataaataatttaatatttatttgcccactagagtgttagccctctgagagcagtgaccttgtctttctccatctctgctgtctccttagcaactcccatttaataactggaaatagaatcccaagcggggcctaactttttgtctcatgagataggaatagtagaagagcaaatctcaaacttttcccccatatgaggaatgacattcacagaaaagacccacttagaggaagacaaataggcctttttcttccacggaagaaagatgcctagaatccagttgaatgaatatcaagtttatatggatagctttgaatccttcctaatattttaaaaagtaaatcacatgaaacctcacatttctgatgatacgtcagagtagcaacaatactgtgatcagaactccacatagaaagctgctgtggtgggccaccatacctgatggaagatctattttgatgttcaaatgctttgagattaggacggttgcttgaagtatttatcgcttgttacactttctctgctgtgtgattactgcaaagacaggccagattgcaagggccacaaaggatcagttcttgagataattatatgaaaactgtttagcccatgatggcagttagaaatcgagcagtggattcttccaatatccaaaaacagatgtagtgattgatttgtcctaaaataaaaaataaccagctcctgctaaatggacttagttgttaactaatcaaacacaggcagaatggtgttctacaaaaagaacagatttggagacccagctcctcccatcactagctgagaagccttgggtaaaccatttaacctctctaggcctttctaggtcttatttataaaatgttgccaataatacttgtcttactgacctccagggtttctatgaaaatcatttaagaatagagatatgcaagccctgtttactgtaaaagggccatgtatttgtattcttaacccatttgtgatgtcactaggcacttggaaatcagcccacaaatggctgatctgattgatgatagaagcataattgccctgtgaccaacccacttcatccctaccaaacattccagacatttcagtgcaggaacaaggtctatgggaaaaagtcaaaaggagactgatcagaggaattccactggcccttcccagggccctgtgcacaaaatggtcccctgtgcattgttattttgctgtgtttgccgatgtccacagcttcctagacattaacagatggatatctgggtgatgatgaacagacagagtgagtgtgatattttaccagttttctagtgcaaaggcctctgtatctaatctatgggcttgcagccttcactagttactctttcagctgaatgtgcaaagagataaagtactgcctgcctttctttaaaatgctgaggaatgacatctagtgaattttttcaaggctacacatactgatggttttgcttttggttgcaagggtaggacaaggtgattctagatcctgacctgagccctgtgtcctgctgctgcccagattctctctgtcagtgtttcatgcttggcaccgactgagctcaaggctctggattaggtcttactgcacagctctgtggcagagaggagaggtgggcaatgccagttggttggaacgtgggaaagaggaacaggataattccacttagggtgttattttgctttgttttttgcttgctttaagcaactggccataaaggaaatatatggccctgtccttaggtagttaaatttcaatcagtagtcaaaactaacattagaaaaagttttaagcatactttaaacaaacaagaacatattataaataggaacatgaaatgaatttattacatcaataaagtgtgcctaaatttttcagagttgacttaattgcacaatagataatccgatcgtgatgacgtgtagcctgaactagaatttattgacttgagacactctttctttgtgaatatcgaaaatttctaagtacaacctttattgatgagattgtcaaaaattgagagtctaatagcattaaagaggttcaatttggccaaactggacattattaagtttatcctatatgctggaggctgtgctaaattctacagataaaagataaatgaggctaggcgaggtggctcacacctgtaatcccagaaatttgggaggccgagtcaggcggatcacctgagttaggagttcgagaccagcctggccaacatggtgaaaccccgtctctactaaaaatacaaacattagctaggtgtggcggtgggtgcctgtaatcccagctactcaggaagctgaagcaggagaatcacttgaacctgggaggcagaggttgcagtgagctgagatcgcgtcactgcactccggcctggtgacagagtgagacttcatctcaaaaaaaaaaaaaaaaaaaaaaagataaatgatatgactcttacccttgctcagatgtccatcctgtttcctcagctttgcctcctcaaccatgagggttctaatcttcatagttgcttctgtttgataagttctatttatttaggaagccatacacaggaacacaggcagaagagaaccagaagactgcatccattggaaaatttaatatacataaaaattaagtgcaccatttcttatcacttgctgaaacttaggtaacttaacatcatgccttacaaacaacagtcagtgctcgttgataatgatgacagtggtagtggcagtggtgatgattacgatgatgaaggcaagagaaacaactgccactaccttttcacaaactttggactttttattatctacactaggtctttcgtgatgagtggtagttatacccagctcaaacttcaggtacactatgactctgtgaagagaaagatacatttttctcagtgtctctcatgcctgtagccacgggaaacttatcaaacactgacgtcagctactttcccatgagaagttcagaaatttcataagaccgcaaacgactttctctttcctatttgcttcagacaagtacagaacttttcatgaagcttaaaaataaacatctgaccttcatggatacattctcattgcttctccaatcagaaatcatcttgcctgtgaaaatccaccctcattcttctattaacaattgaaacatcttggatgatgcaaatagcatcgcagattactcttcattcaatgattgtccaagagaaaggagaaaaggctgcaatgattaggcaccattttaagataccaaagcccatcttttgtactatcatagaacaggataagatctgtttttttttttcataattttaccatattggcttctctgagaacatacatgtaagctatatcctttgcactccataaaattttaagaagaactcagcaaaatttccctgggtagcttgctagtcttgggacctgatggcttagaaataaactaagaattgagccattctactttctagatgcagaataacaaagaaggcagagaaagaagctgataatattaaacgagggtcaatggcatgctaagttcaatactaggtactttatatgttatctcaatcatcactcaacaacagacttttttctttcgttctcctttttttttttttcctgagatggaatcttgcactgtcgcccaagctggagtgcaatggcatgatctcggctcactgcaacctccatctcctgggttcatgcgattctcctgcctcagcctcctgagtagctggcatcacaggcgcacaccaccacactggctaatttttttaatttttatttttagtagagatgaggtttcactgtgctggccagactggtctcaaattcccgaccttgtgatctgcctgcctcggcctcccaaagtgctgggattacaggcgtgagccaatgcacccggccaacaacagacttttatgaagcatatgatatatgccagagaacatgctaaatgcttggtatggagtgattgataagaccatgcccttaccattgggaagcccatactcatgcaatgctaccatagaggcattaaccaagtacaatggaagaagaaaaaaacccttcagcgtagtaattactatcctcattttaaaattgaagtagctgatacctgttagttatctttgttaaagagcttctcttaggttattaagtgtagagttctatgtgacccatagtcagtcttacaattccatgctgttttaatgggaaagatctatgttcaatccaactgaatgatttaaagctttgtctgctatccaataaatctgtttgctacagaatgccacaaaaattctgactttcactgaataattgactttttctttaattataagaaaaatttccttaatttcccactttagcctgtttggtagctaaattcctaacatattatcatattaatacatcttgtccctcttatctactcatttatacaaatatctgtatacatttccatatgcataataattccttaataacacagaaaacatatcccataaaaatcaagagattctcatacagacataaacctatacactaaactacaagcatactatagatgaatttgttcaagatacatagggaaaatctgaaatggaaacatacaattttaaaaaataaagaggaaacattgttcaaggacttgatgcacaaaagagctacaagaaataatttggggaaggtgggtggttaaaagtgaggacaagaaacagtggatactaagcaaagggctggatggatggtgaaattgcatggcattcttaagatgataagtagtccctgtatttggattgccttggtatggaccacttgcaaaaacattcaatatttcacttctaagatatggtaagccaaaatacatatatggaaagttcactaagtcattggcaaataatccagtgttgacttttaatttagaaataactggccaaattgatcccagccttcccaactacaattctccccctgcagagtacattgatttgtattatcttattgttttctctcactgtttgtctttctttttattattttattttcctactggtacaatgtatgacaagagatagtgaactttcctgattttatatattttgagctcataaattccctggagttgtcatctttccagactaaagtttcatctttttctattcacatgttctaaaaataatctttttaatgatgtgtaacatatagagaagtgcacaatttataattgtacagagtgatggactttcacagaatgaacgcaactgagtagtcagcatccagatcacaaaacagaatactacttgcattcagaagcaccctaaatgtcccttcagagtcatgccttcccccacccagccactgcctcatgataaccattattctgatttctaacatgaagtattaattttgtctgggcttcggtttttatattaatgaaatcatatagtaatttttgttgtgttgtttacattatgattctgagattgattgcctgagcaaaacttagatcattctaattgctatatagggtttcattgtttgcctcccacaatttatccattttgctgttgatagacattgaggttatttccttttcatggctattattaatagtactgctatgaacattcaagttcatgtcttctggtgaatatatgcatggacttttgttgtatatatgcctgtaagtaagatttctgggtcacagggtatacaaatattcagctttagcacatgctgccaaatctttttcccaagtgattttgccaatttatattcccatagcagtgcatgagcatttcagttgctcaccaccattttgatttatgtcttttaaattttagctattctagtggtatgtagttttagttcatcataagtttcaatttgaatttttctaatgattaatgagattgagcactttttcatacacttgttgatctttttgtctttttgtttttgttttgagacaaggtctctctctgtccccaggctggagtgcagtgtcacgatcatggcttactgtggccttgacttccctggctcaagagatcctcccaccttagccccccatgtagctgagactacaggcatgcaccaccacacctggctgatttattttttagttgttggcaattttaaatatcctcttttgtgaaatgcctgttgaaatcattactcatttctctattagatcatccatctttttctttttgatgtgtggaaatttttatatattctggatacaagttctttgtcatccatattgctaatattttctcaatctatggctagcatctccactctttttatggtttttagttttaatgcaacacaagtttttttatttttatgtcccatttacaaaatctttgcctatcccaaaatcatggagattttctttttcctgaaagcgcaaatgtgtaagttttcacatttagatccacaatcaatctgaaagaatttgggggaatgatgctaaatagaggtcaagttttgattttcctttttccatatagatattcatttaggtgcgggatgatgttacttttctacagacaggggttgtcttaccttctggttgttttgatagagttgggaaagttctcttcagttaaatggggctgagctgatctacaactcatcttccattttgcaagactccttcaacctctggtttgctccttctccgtggctgaactctccaagtgtcctaatgcctccaaattaattttggttttgtggaatattatccagagtttctagttattctcaatgaaagcactggactgccacaagctattccatttaggcagatacctacgtcagtctagctacattccacaaactcatcaacaatctcctccaaaacatttaaagaaaaatgttgtgtagaactcaaaaaggtaaaagaaaatgtcagtgttggcagctatggctgctccatgtatcctgtcatggaaggagctttggaataaaacaaacctgggttttaattctaacttgtcatttattaactgtgtgacaatgaatcttacttccaagtggggataataaaaaacaactagtttcacagttttcttgtgaagattaaatgaaagaacagatatcaaatacctcgcaaatagtaggtattcaataaataatagatattattatgtaatatattataatttctcttagagttataaaatgcactcatctcttagaaataatagagaaggagtcgggataggtggacttgaaaagcaacactcttctctgagcaccctgttagatgctgaaaagggggaacttggttgaacttgttttattcaaaatgatatcaaggtcattcacatacacaatacatttttttcgtggaaagatggtagaaataaatcatctgaattgagtactgtggcaaatctattccaaatgcttcattttatagatgaagaaattgagtggttaaatgactcgtacaaggtcaattcacttgttagtatttatttaaatgacccaaattccctaagatcatatatttcttttcttctaacatactcctagctcccatgtttaactataaatgtaaagcagagacaattaataatgtgttattattactagctcattctaactaaaacccatcgatctatttttaaatattttattttaatttccatccccacaaattatgtgacttcctgccaactatgattgaaataggtacttgccattcctttcccattttaaggattatgtcctgtagcttttcatttttctgtctgttattaagaaatgatctgccttatcctctaatgtatgaaaggagctcgtgcaagcctgtagaacacagctctcttgaagtctacctagcaaaaaagggagtggggaacctccatccctctgggcactggatacaaaggtgatcatgtgcttctttggcactttcatctctgggcagggacagatcctcatgctttccagcaaaggcagccctgtggggatcgttttttggtaagaccctgtgtccagcacatctttcagcattgtgtactctacgaacagacatatgagcctgaatcccacatggactgagtaacttggaagtttcatgatcccagagcacacagccatctcataaaagcctcacaccaggcttctcaagggctctgcctggaacatgcttccttcagatctttacatgggggggcttcttcctagaaatgtgtttttagcctagatgtctccttttcagagagactatccctcaccatccaacctccagggaccctcagtggacctctttacatcctgctgttttttatttgctcactcactatcagaaatgtatggtgtctgaactccagcagagtataagctccatggaagcagagcccttgtacatcaccttgtgctgtgtcctgaagcagaggactcactcagtgaacaagcaagtgggctcctgtatccaccaaatacacccagcatggtgggtcaggccctggctttgaatactggcctcaccactagctgggtgaattcaggcaaatgacttcagccaagaaacttctcagtgcttatcctaagataagaatatgtattttacaaggttgttacagtcatcaaatgaaataatgtgtgcaatgtgcttagcacagggcctaccactgaaaaatacttaacaaacaatagttattattattatttccataatgaaagcaaatcatattatgaaaaagtcacagaggaattgttttataaaaatggtaatgttgaaatcagagaccctaattcaaccatgtaagataaaattttaaattaatgaaaatctgggtcttcttgttagttatttacaattatttatttttgtaaaggatccctaatttaacctttgcaatgattctctgttgaaataagttatcatctcaccctctgctcttagtatccatttggaaaatgccatctttctgagaatacttgcagtagaaattttaaattaggatattaaccatctcctgtaaatatatgctagcaatgtttttctatttgtttaatctagaaaggtgctagttacagtttttcatgctactgaatgactttagctagaggtttcctgggggttctaagaaaatcactattcttaggggactagaaatctgatcaagagggaagaaattacttctttctttttattacaccttggttctcctatagtaaatgttttcatataaaactcatttctccccatgcccgaggagatggttaaatcaaaggagcaataactagtgcctggctgtttgccactggctgcaatggggactcggggaggaagacaggctcatttgcctaacagggcccagctcccttcccgtcttccttcatcttgggccttttccttccttactacctccggtctagactcagctttccctgcagagacctttggcaactgcttctgagccagggcagccagcatctgtgtgtcgggcactgcattaaaagctatggcttaaagggctcaagggaggaatggttcacccgggcgtctatttgaagttgcgaggtaactgatgggagagaaagatcttaaacagggagtaagagctttagcaactctctggcccttagaccctaaatctgaaaatagaaaggaaagagattatctgaagacaaactccactgttagtgactctgccattcattttatgttttctcttgaaagcctttctgtctttgtctcactaacaaggtagttcatggacatacatagacactacagaccaaaaaagttttccacttataacattttcttccttcagtttccctttattcattctcaaattttgaaataaaattactgaggggattgggagcagtgaaaaagaaacttggcaattagatactatccctgggtttgtcttaactatacctccttctccagaataatttattcagaataaatggatggactttgcgataactgtattttccttaaaatgcaaatgcacaatagctatttctacccctgccttacttctccctttagattctaactaacaacagtacttgaggaagaaatgatatttgaaaatatatagtctgtattagctaaaattcattcaactgaattatgtttccatcctccttttattccaggtatcattggaacatttcaagatcatcaaatcaaattccacagggattggtgaccaaccagaaggctcagacatctgattgctgacctgtgagtaaagtttatgttttattaatactttgggctctgctcttaggaattacacagcctctgtgcctgatattctaaattcttacatctgaagatgcactgtgagaaaccagtttttctgctgtggccctcctactttacttgccagttaattaatcagttagaatctatcaagttttgaaggatctatcaagtcttttatcctgttttgtaatctgatttttttttttgctttatttttaaatgtttcctgcaatgtaatatctttcacaaaacagtcctggatcaatcatgaagtcttcacttcctgtgaaaaatgctagtgacttgaatcaataaagacaacatgagtcagccttccaaggtgaataagctcacctttgtgcaaacactggtgatctcaggagtgctaagtacccctcactttcaacaaatctctctcacctgggaggaaaacttctaccagaacaaggaccacctagggaggtgaaagaggggatttccactttagaggatggagaaaccaaagggcatttcactcattcacagttttgctgagcttggctccagtaggtagaaaagttcttcaggagttcagcacaccactcaggcaattgttgtttcaaaattctatctgttgcccccatgcaagttttctcaggctaccatagtgaaaatccacagactgggtggcttaaacaacagagatttcttttctcaccattctggagggtagaagtctgagatcaaagtgttggcatggtggatttctcgaggccctccttgcagatggccaccttctccctgtgtcttcacgtggtcctctctccgggcacacacctgtctggtgtctttctctctgtgcccaaatttcctcttcttgtaaaaacaccagtcatattggattaggcccaccctaaagacctcattttaacttaatcactctttgaagaactcatctccaaatgcggttacattctgagatcctgaaagttaggatttcaacgtatgaatttgggggaaataccattcagcccataatgctgccaccatcattttccctctctaatatgctgactttttgtttattgcacgtgggcttccctctgtttctcccctcctgaactcttttagcgattacattactctcagagcatctgcagttcttagagtgtattataatcatttgggtacagctctcatttccctatgacattctataaattctgaaatcagagagtgtgccttttacatctctcatagcactagaggaggttttgtatacagtagacattttgtaatatttattaaatgaatgaatgaatgaatggaaagaggattagatgcagcctctgaacctgcaatttatttgctttaagactgtctccaaatgatgagtattaaagatgctttctcctcacttcctgccccccaagacaggtagaaataagttaaggctgaggagaaaaattgaaagaaaggtgtgattgactaatagcaggagagttacctttctcccagaggtaggaaatagtaaatagcacaagcatgccccagttaaggtggcctttccacaagaaaactgttcggggatccaagagggacttactgagtttgaagcctgtgggacatgcaagggcatgtgtctagaaaacaatgcatatgcaggtctgaaggtcaggtgagaaccagagatgttcacagtcaccacctacaggcaggaagcagcagtgtgtcaatgaatgaggccaccaaggaagactgtgtagagggagaggagcagtggcttaaagattccatcagaaattgtgtatggaaatttttcctgctagataacaggagaaggacccgtccaagaggaagaacactgcacgatacttctaatgaagctgtgtgagaacatgtagatgagctaatgtgtgtgtctattttttctcccctagtgtttttggacctattttgttccttctctgtcctgtcttttgggggctatgccccaaaccattcctgtgagccttctcctacccacctttgctcccttctagctaactccacctatggtcattgtccaactcccctgctgcctgctcagggaatcttagacaaacttcctttgggcccattttcttcatcagccaatcagagctgatcagaatggacaggaggggaggccaggatgagaatccttaatgaccaaagagacagaggcaggtcgttttcagggtcaggtggctgtgacgctatggtcacagagcatcatcttgtttagtcagtaaaggccccagataggggtggagggctgtgcctcttttgccctgaactccctcctttgtccattgtcccctgctgattgtcccactccacctgttccccagaataagctttggcagtattttagggtttccctgccagaccagagagtggaggggccaggccatggcccctgacagtcattaccagcctcccctctctaggcctcaccatcaaatgtcatttctcacggagccatatttacccctgggctgaatttccctaatttgccctgctagcatgatgcaaataaaaggggtaaaggtatttattcatctctcttttattttccaaagtgttatttcttttcctttaagttctctccttgctttatgtttcttctctctcccttagttctccttccttagtagaaacccttgagcttcagggtgattttctgattatgagcagaagaggctatcagagatctggaagccacctcctgcatttctttattccccctcctcacccaattgttttaaatgtacattgagataccagctttcttcaagaacccacttccacactttcctctttgtgttcttggagtagccaggaaaaagatgcccattttctcgaaggtacccaaaatgtcagtgacacttgggtcagtgattttatgcaaattactaattatatcaaatgagaaatgttgaaagcaagaggaaaccctttgcaatccatgaatggtctagttggggtgttccaatgaatgatggccagtggccaacataggtgcctcccgactgtgtttcattaatttcagtcagctcgtgggcttggagagaaagatcattttcctatgagcacgtaaaagaagtgctttgagttgtaagcacttcgaaggctttgcccttgttttcgaatgggagattttataaccactgtgggccagtatttttgaagtcagtcgaagctccagatggagtggaaagagaagcttgggtttttattttcttcttcttttcttgagttttgcagaatgagcctccctggaaaccttgacaaagtccttagtctcctttggttcaggtgggcccaagctttttatagtaggatctgaagggatctttcttaaactaagattccttcctgtgggtttttagtagtggctgtagaactaggcttatatgggagaaggtctggaatccactcccttccctgggagtctcctctcaaggagaccactctcagggtccttgtcatgagatatgagaagaaaagtccacaatgagcctgggcatagtccagatttggttaaggattgaggggacacgaggtcacaggtcccatgggactcccagcgttctggaaacctccatagtaaagagggtagaggacattccaacaccaccacgtgcagctttagtaaccttgcccaaataaacgtgtttccccggccagggaattgcacctggtcttaagaggcacctccatgaaaacacacctttctgcctggcatgaccattgacagagaaagactgtgctgagaagggggatacagcagggagaaaaacacacaacggtgccaggagctcttgtctagaactcctttccaggctttttttccccataagcgcaagtgagtacacaagtaaagagaaaagaatgattgtgctatttagctttgaaccaaaaactatcaagcctttcctaaggttccaactggaatagcatttgtacagttacaggacacagactcaattgcttctgaactctgctttaggatgcctaacaggattaagttgtgaacatctcataccacgccgtgcaacagtactcaaataggacttaagcagaacaaacagtctggggaaaaaaaaaaagccctaagacattttccttcctactattctctgtatcccaggctcaacttaatgccaaattaaatctggatttttttttaatagacgtttcctagaggaaaaggcagagctgcattccctgaaacatattttagcccaaacttataacttggattttttctttcctcctccctttcgctaattcaaaacaaaatgtccatcacgcactctaacaccagcctctaagagctagagacaaatgaagtctgaatattcacgccaatgtggtacaaatgagctgtgatttcaggatgctggctgttttactgacaggggaaaagggcagttgactagtttaatatatttggctgaaaacactttgctaaagagcagtgaagaaggccaatgttaataatgaatcctgttctttaatgaccaaatatgatatatcatggaatggggcatcctgagtttgggggaaagcatttcaccatatccacaggatgcagacgagaatgaatgcaaacatactgcattcatgttgggccctaatgaagaagctcttctaggagtattttctccaagttcctcaaagaattcctcccataagtatatgataccatgattttgaatctgatttcacacagaattacaaaattataaatataaagacatttgttattatgagagactccgggaatctagctaactgtctcccattattggctaatggtttataaattttaaaatgcaattataagttggggttgatgagggaagcctgtgaccaccattagcaccttccttaaatatgcatattcagtcagtcgttaattcattcattctacagatatcactggattggaccttctccatctcacgtgccatattagttctgtgttacatttgcaattctagtattccttaccataaaatgggcttttttttaattaaatgcaatggaaaattttgtgaatccaatgacgtgttcagtgacgtaaattgtgatttctaatactgtatttatttttcattggcttcgtcttggcaaagggtcataatattttaaatttctctgccctctcatccacctatcacactttattatgcggtttataggcaaaacacaggcatgcactggctatatctgtaaatctacttttctgcaaatcacttgaagggtaatgcataattgccccctacattattgtttcctagattctaacttttgtatagaatgttgttaaaagcagattataatgtagttccaagtatgctgcttcctctgtatccataggggattggtttcaggactcccgaggataccaaaatatactgatgctcagttccctgatatacaatggcacagtatttgcacataatctatgcatatcctatcgtatactttaaatcatctctacctctaacacctaataaaatgtaaatgctatgtaaatcactgttatactgtatttcctattatattttttattgttgtatggtttttttaattgcgttggttttttttaaaaaaatatttttctatccctggttgattgaatctatggatgcagaacccatggatatggagagctgatagtaattgaatttaaaagcaaaataagggtgctgtgatatttttatgaaatgctcatgagaatcaaagatgagagaccagaagccaatttaccgtgaagtcagtagagtttaagccgcagggcctctcatggggagaggtccctgcctcaacacccccatgcctaactttttacatttactattgtattctggttttccaagaaggcctctcaaataatcttcaggtcccacaaaacctggatctgccctgaaactgacacagatatactgagatgatttagcatcgtgtctaaagctaattaagtaagcaaagcaaagaaatggtcaaagtgtgaaatgtgatcatttatttttttaaggctttaagacaaattcagcttattttctaaagtgaaccccacttaagtgaaataataaatcagtttgccaaggcacaagtgaacataaacagaagattcatttttacttcattaataaacatcaaatatgaacggaacctaacatcaagcaggccaaggcctcctgctgacaggaaacagctcctagtaagagcatttgtagaagaacataaatccttccaggcaatcacgtgatcatttcatcattgaggtccttgctacagtctactatgtattatccatttacaggtcttgtgagatgtaacagagtgttgtgattaaaagcacacaatctggggctgagttgcctggatgtagaccccagctctaccacttactagctatgtgaccttgggccaatgactcaccttctctgggcctctgtcttttcatctgtaaaatggaaataataaggattgtcacaaggatttaaactgatattatcacagttcttagaactgtgcttggtacatagtaagtgctacataactgttgtcgaaagaaatcaacttatccatctagaatgaaagctatatgggattgcttgtgggttcactcttgcaactcctcacagtgcctaacatggcacatggtcagccatcaatgaaagacagcaacccagggcccatgctgccctgcaaatgtgcttcccttgtccacccttgatgtggtttggctttgtgtacccactcaaatctcaccttgagttgtaatattcctcatgtgtcatgggagggaccaggtgggaagtaattgaatcttgggagtgggtttttccctgtgttgttctcatgatagtgaataagtctcacaagatctgatggttttataaaggggatttcccccacacatgctctctcttgcctgctgccatgtaagacgtccctttgctcctcattcaccttccaccatgattgtgaggcctccccagccacgtggaactgtgattcaattaaacatctttcctttataaattacccagtctcaggtatgtctttactagcagtgtgagaatagactaatacaagcatttttttcaaattttgagtctgaatgctcatagggatgcagggatgcatatgttctccattttcccataagctaccactccccaaatagttacctctttggtcctttaagctatttgagtttgtcatgcctgatataaatgaatgatcccataatacacgaacactgcaacagttagtggcagttttatggctcactggagtaaagagatgggcccataaggaagtgaaatatgagtcacttccactccctgatgctctacctgcaaacagtgttccggttaacctacctatccctgtttctaaactagaggtctcagaagggaaataggaaatcaggaatctgagcaagcacttgcttagaaacagagacgagtacaacctaatgtcagagctggccaagactctatcagtcatgacaagctaggttatgctggtgtcagaaacagccaaaatctcagcaacgtcaaaatgaacgtgtgtttatcactcatgctttgtcactaaccctggataggcaagggtttctagtccacatcactgtcatccatgcttagccacccctactgacaatgactgtctggaaatcttaccaaccatgatggagagaaaagagctctttggagggtctcctattggcaagtctaccccagaagtgacatgatacttctgctcaaaactcattggccagaattagccacttggccccagatgaccacaaggggcaagcacaatactataatgtgcccagaagaagtaaaacaagaatatggggcaaacagcacaaaggatcatagctgcgacattatttggaacttggagtctcaggccagaattcttaagcttttcaatgagttcaactcagcaaatatttccattcataaataactgcacagcaaagtactcagcactgtgaggggatgtcagaggagatgtaggccttgacactgagcagcttcagacttggtcaagagaaagtgatggtacaaaacatttgaacagcaaggccatatagtattgatcaccaagaacaaggccaataattgctgtagaagctgaaagggagggtggttctgggataaagataggacttgagctggactctagaaaaatataggggatttgcaggagtggagggcacttcaggttatgggcagcaagaagccagagacaaaggcccagaggcagaaatgagggtgaaattattgcaggattcaggagtttggcttggctgtaagttgtgtttgcatgggagggtagggtggggagaggaatcatgtgatggatagagtggagccatttcacagtgagtttctgggttctgcagagaaacaagatggtggtatgtgggaggaagatcatttttcctgaataactccattcaaaaccaaggaatttgcacctcccaatcaccagcctttcccagcacatttattccccaaaacaagagtcctgaatacccaacagcttcccagaccttctaggcagtcattgaatggagacagtagtaaaccctgggctgctcctgcctccagtttaaagcatctttgatcacttctgctgacaaagaatatccaagttcaagtgaaatagcctcttattgctggggtcagtgtagcctttttgctatgtaacatctgtttttaagattcggctgagagctgagaccttgacttaaatctgtttaacttaaaaagcagcaagagaacatcttgttttcatgaatgtccaggggctgtgtgtcaacaaataaaaggtctgcttgtggtactcaaagtggaaaagctggttgtgagatgttctgccactgggataaatttattatggactgtttgtctcttggaatcatgcaccagcatttgaaaataaatcagcatatttctgcttgatggcgtgttagaaccatgcttttattgtcggaagttcacagagctggatgggtctagaaagatgccctctttcatgcctcccaccttagctgcatgaagttaatgtcttaacgtggattccccgggtctgcatgaattctggcaacagtttctgatggatcattatttttatgtgacttatgtaggacctgaagtgggaaagaagtgggtgagactagttcaccatccctcaaatctgactagttgcttttctcctcacccacctatttaggagagagaagtggaaaggaattttatttatctgcacctaggggagcaaatgtctggcatgtactcgatgtcaatttaatttgttgaatgaatacaaactccagtcttataaatttatgttccctgtatgaattcatgtctctatatatattaatgtcattccttttggaaaaggtgattaccacccagatcttattctaacacataggaaaccattagatcgttcctgtagttctctctcatagtagcttctttttttcttctttttaggtttcttcctaacattaacctaatttgtattttatttgttgattgcccatctccaccatcagactacaagcaacttgaaggcagaatagctgcattcacatcttatatgctacactaagcaaggtagctagtacatgaatatttcataaacatttattgaattttttatttatttatttttattatactttaagttctggggtacatgtgcagaacgtgcagcttgttacataggtatacacatgccatggtggtttgctgcacccatcaacccatcacctacattaggtatttctcctaatgccatccctcccgtagccccccacccccaccccgacaggtcccagtgtgtgatgttcccctccctgtgcccatgtgttctcattgttcaacttccaattatgagtgagaacatgcggtgtttggttttctgttcttgtgttagtttgctgagaatgatggtttccagcttcatcaatgtccctgcagaggacatgaactcatcctttttatggttgcatagtattccatggtttatatgtgctacattttttttaatccagtctatcattgatggacatttgggttggttccaagtctttgctattgtgaatagtgctgcaataaacatacgtgtgcatgtgtctttatagtagaatgatttataatcctttgggtatatacccagtaatgggattgctgggtcaaatggtatttctagttctagatccttgaggaattgccacactgtcttccacaatggttgaactaacttacactcccaccaacagtgtaaaagcattcctgtttctccacatcctcaccagcatctgttgtttcctgactttttaatgatctgcattgaatatttttattaaagttctcattgggatgatggttgtagagtctcagccactcttgattgtatctgaatttaaatataatgcagaagacgacaggacttataatgcagctgaatatgtaggggccttttgtttaatgacacactcacattcatttggccatacacgctactgaaggtcacggcgggatgggctaaactaaccatctctattttctcaatttaaggtggtcagctacatctgtcatatagctggcccggattaatgtcatagcacagggccatagcttaggatttttttcccctcaaatgagtaactcattcctggtgggataaatctgtgactttagccttattagcaagaaattctggcccacgaagctatctggtaaaggcagtgtgatatggtttggatttgtgtccctgccaaatctcatgtcgaattgtgatccccattgttggaggaggggcctggtgggaggtgattggatcatggggaaggatttcccccttgctgttctcgtgatactgagtgagttctcacaagttatggctgtttaaaagtgtgcagcacctcccccactctttcttcctcctactcccgccatgtcaggcatgcctgcttcctgtttgccttccactatgattgaaagtctcctgaggcctccccagccatgttactcatacagcctgcagaatcatgatccaattaaagtcttttctttataaattacacagtctcagatggttctttatagcagtgcaagagcagactaatgcacagtgcaaggatctagggtcagaaaggtgttttggtgctcaacagacctatggcttaatgtccacgttcacttgtccagtggtcaatgcagatctttctggtgatcaagcacaatatgaatactctcacttgaggggtacgaaggtggattcatttgctccatttttctttggcttcctgtgtagatggaattgaaatgggaatgatatgtgcattccaaaggatctcaagagaaatgctcattcgtttacaagaggtgcaatcccacaatagtttcttgctttgtatacttgaaaacattcccaaagaaacaaagttggatgcagaaaagatattgggagaaaagaaaaataatactccaaattctgaacaattctactttaacatgttgatctgtctgccagctggccacagggttgactacttgtaatatatacttttggtaggccgcatgtagttcttggaactgtttatattcggctgcagaaacttaattattctaaaattggcagagtgatctttggttacttaatacaaaattgcttagtcatctttaaacatagtgtggacagcttttgtttaagtgtgaaaaattaggaattgcaaatgtactccaaagagattttaggtcagggagaaaaacaagaaagtatcattctttcaagatatttagcccggtggttgccacatgttttaatttgacaagctaggtaactgtcgagttgaagtccttgattacaagtatttttccattttctttgtagatattgtcagaagtagaaagctgttgctgctgcttcttagatggtattctaatcctacactctgcaaagtataggtttttcagcaagagtgtgaggaactctaacatcagctgctggaacagctttcttgttctacgaagcgaacaaggatgccatttcaagctggttgtcacaaagatcctccttttgcctcttttggtttgaatcctcgaactgttgccttccacgtatagtacagagctatagtgctttagcgaggaaacaggcaggcagagtgagcttctgcattttttaaagtctaaagtggcaccggaagtttctagtttttccaggaatgcccatggcaacctcacacttttcctgtgatctgggctggggctcctaagagagatggtgagaaaagataaaagtcctgtagccaatgggtagccacgcgaggcctgggaagggtaggttcccaagcaaacctccagaacggtgccttatgtttctaattactgagcatggttagagagcaaaatcaggcaacagtttttttagactgatggaaacatttaattggctctgaatgtcagtgttttctaattatgatagaggggtagcaagaagtttccaaaggctgcggaaatttgaagtgtatcagctgaattctgattctcttcttttcttattcatcctgtcttctttttctttcaacatccaagaacaaacctattccctcagttaaatgcctaatactcctcttcctgaaatcgaaatgtctctctaagaccaagttcttttccactagagaaaaacaaccacaactacaaatcagaatataaaatagagttccatagtaaaccaccaccattcccaaggttactaagagctcagccagagaaacagccttttgataacgtcttagccaagttcatttgtttaacaactaagttcaacaaataaacactgccctggcatctgttccaactcaacaagtgtgagcctaatgcggagtataagaaaaacagtcagttaagaactttgagggatcacgaaagacagtaatcatttctaagagataacaaccttttacagaagacaaatatgtacttggtaattaaaatacaagctatagactaagtgctccaatagaaatacaacatgggtatcagtacaaactcaggctattgagtcagttgttcaaagatcctatggttttgcgctattctttttttttttttttttttttttttttggagacagagtctcgctctgtcacccaggctggagtgcagtggcgcgatctcggctcactgcaagctccgcctcccgggttcacgccattctcctgcctcagcctctccgagtagctgggactacagatgcccgccaccacgcccggctaattttttgtatttttagtagagacggggtttcaccgtggtcttgatctcccggcctcgtgatccgcccgcctcggcctcccaaagtgctgggattacaagcgtgagccaccgcgcccggccagttttgtgctattcttaagcaggccccaactgtgagccattccctacctgaggaaaagtccaggtatccccaaactaataaatgagtgaaactgctatctaaatgactcattactatctaaattactatctaaatataaagaaagaggaagcaatctaagtacttttcaacttattatttatctgtaaatatatatgcttaaattatatgtctgttacatccaagggacatagcagataacatcctttagttgggtttcaaacctttccaccttggattataaacttctagaaggtagtttttaacctgctttgcagttccagaatacagtaaacacacttgatgatcatgatgaatagaagtcaaataattcactagagaataattagtccctgatcagtaacagcttgtccttcacatacaaaaatactgctattaacaaagcacctctagaacacacctttgaattgttttcagcactataaatggatttgcatcctgccatctaagctatcctactttatattagcaagatagctggccaaggctctgtatcactaaactggaagtgttagttgaacaaaccagtcacaaaaagcaggcacatgagttgctgacttttttttttttttagctgagtagttcagcaagtccagaaggccatgcacaagttaaactacttttatgtaaaatatggtgatctctgcagcatgtttacaactgggaaaggcccatggcttctgaactttcattccatgtgaaccactcttgggccttgttacttaacttgaagtgtgatctttcttcagccagtgtctcagcttcttttgtatttgccaagcatttcactttctcagttgcaagtgcccagtcacagctagattgcccccatccaaaaagcctccataggaaaatggagagagtaccaatgagggaattatgagagcacagccatgctttgagatgctgacccatacaacaccccacaacttaccacatcttttctatgagattgtaaggtctttgaagacagaaaccatatctaacataccttcatgtctctgaagtgcatagcattacttcactcagtacaatcatttcatattaggagttgaaagatctcttttttttttgagacagtcttgttatgtcaccaggctggagtgcggtggcatgatctcggctcactgcaacctccacctcccaggttcaagcgattctcctgcctcagccccttgagtagctgggactacaggtgtgcgccaccacacccagctaatttttgtaattttagtagagacagggtttcaccatgttggccaggatggtctcaatcccctgaccttgtgatccacctgcctcggcctcccaaagtgctgggatcacaggtgtgagccaccacgcccagccaggagttggaagatcttatagtagagctgtccagtagaactttctgcagtgatgaaaacattctctgcaccgtcttatatgggggccactaaacacataatggctactgagctcttgaaatgggactggtgaagctgaggaactgaattttaaattttatttattttcaatttaaatgacctcgtggctggtggctaccatattggacagcatagccttagaatcttaaaaaatatattttcgccataaccctaaatagatggccacttcttctccctggctttttcagagataggggtctaccctttccatgcacccccatttttgggtagttgcgctggagccagccctccctgtatctgaattatgtgtgataatattgtgaatgcctctgttagtcaggcatacatttagaaagcatctttacatatttgttgcaagtctacgcattttttctcacatggacacaaggtagtggagaatttccaccttgccttagggtttacgcttgtgtcatttgttcttctctagtggccaatagagcagcatgcctattctgatttagcattaaactctgtctttcagcctaattctccttgagttcatcaaggaaaagtatttaaatgcttgaaaagaaaacagaagaagtcgtgtcccaaattttcacttctcttcattcttctaagaaactttcaagttggtttagaaattagtctaaatgccaatcctggttttccactgatttgtagtggttaaggagctaatgtcaaagctttatatgtctcagtctcctttcttcaaatggggttgaattgattcttcttacttgggaggatcaaataatgataaccataaagttttgaaaaatataaagtgctccaaattaaggtggtgatatttgtgataacacttgaagatgcaacctaaagtccctaaacatggtgtcttcctaagtgttgaagttagtatatacaaaaaccatcatttcacaaatctaaactactcaaactgtctgctactcagaaggtgaaagaaagggcataaagacattggctttaataatgttaaatctgccaggtcttctgtttgctagtggagaagtacaaatagagaaatggtaatgctaagagattgtgcggggaaggcaagggaaaaacaggtcataacctgttaacctgcccttagtatgttggattccattgattagagaaaagaaacaccttgagaagacaaagtgcctcaggttgattgtattcactcttatttctatgctgctgttcttgacagacctgccttggtaaatgcatgtatttttttaaagtagcacagatttttggaacaagatggtgaaggttgagctaaagttaagtgcaaactgtacattataatccatttgtttatttggtttttcaatcccaaatgaaccattgagctcagaaaagagcaaagtgggttgacaaattgatttttttggaaaaggacaaaagttcatttggtacagtcggaaagaaagtgctgccagatttactgtgtaactactgcaaatgtgggtttatataatttttgagattcatacatagtcaattaccaaggtctttgattcactttgtaaacactgatcagtcaataaagtacagagagatgaattggcttgagttacattttccatactcagaatggtaaaatctagaatagaaatccagtggctcaaattggctacaatttctgagtgcctactctgtctcaattgtggaaaaatttttttaaagactatatcttttcataagtggccttaagaacaaaagcatatggaaagtaaaatactaatacaaatatttaaagactagctaaagagaacaattgatgagctgtagctgacagtgtgttattgattatcaacatgaattatagatattcaaggagggaattgtcgcttttaagctagggttctcaggaaagggtatcatgagggaagtaaaatttgagcatgaaattcatgattgaataaaaatatggatagtgaagatgtagattaaaaagaatgagtaaaaatgtagaggtagaaagttgtaagacatatttgagaggtgataaaatatttttatgtaggatgctgtggtatgatcagcttgaaaggaaggttaatggtttctagatcaaaaaattaaatgagaacagacttagatactcaacacatttatgtctgggaaggaggaagaagcatggatatgtcatgtgtgatacctccagctttgctggctcaagcaggtatacagccatagtattattatgtggcgtaagatgaaactttgaatattatctctccaaccagctcactttatagagaaacaaagctcatagagcttcagtctcagtctcctaggtctcattccaggtcactatttgccaagggtttgtgaaggaaaacagttaaagggtcaaggtaagcgatgatcattgcagatcagaggtaggaaatctgctggagtatgttgtacccagaaatcacccaatacctgtaggatgaagagaaacatcactgagttgcagcgatggcccaactgaaatgaatgcaaatctttaggatatacacgacatgctccctttctcccacaaagcactgaatctcaagaacacaaaacagaaagcaggtgataggtgtgattcaaggttgaagatgggtgtgacaagcctggtggaactttaaagaagcaagaaagtctaaactatcaattccaggaaggcaaagaccttttctgtcttgttcactgttataccccagtgtcgagaacagtacctggcacatagtagctgtgcggtaaatatttattgtatattgattgtataaatgtttttgtgaggcctcactgaagtagctgaatcatgaaatttacagtgggtgcaaaatgatggctagtcagagaggacctgtctaataatggttttgagtgttccaagactagagttccttgcgagagcagagaaatgatgatgttgtgaatgaggatacagtgggttagaggaggaagatgtgtaatgaagaaggtacaatataagagaagaaactaagatattgaagaaaagtatgcaatgatgctgtcgaggatacagccatcctgagttacgaattttacaaagcactaacaataaattaacagagatgaaataagcatttggaaggctaattcaaatgagatcttttgtgacttgataattctatgatttaaaccaaacaggttgtaaaccgaaggcataggtaatttttaggattatttcttacctaaggttatatgatccaatgaatcaatgtggcaatcactgataatagtcctctcagaacttctttggggcactcttgtttgttccctgaaatgggaaacaaatcctagagagaaatagtggattagtcctattatagtggttaagtgtatgcactttgaaattccataaaatggggattatactagctacctcacagatctgttacccagataaagtaaaattacttatattttaatggcccagcagagctatcagccatgaaaagacttgaaggaaacttaaatgtgtgttgttaagtggaataagccaatcagaaaaggctacagacatactgtatgattccaactatatgatattctggaaaactcaaagctgtagagacataaaaacatcagtgattgccagggttttggagtaaggagagggaagggataaatgagtggagcaggtggggtttttagggcagtgaagctattctgtatgatgctactatggtgaatacatgacattcggtatttggtgaaacctatgaaactgtgcaacaaagagtgaaccttaatgtaaactatgaactttagttaatcataatgcatgaatactggtttgtcaattggaacaaatgtaccacactactgcaagatgttcctaagtttcctagggctgccataacaaagtaccacacactagttggtctataataacagtaatttcttgtcccactgttacggagagttgaagtttgaaatggaggtgtcagcatggccaggctccctctgaaggcactggggaagggtttgtcccatttctctttctcagctttctggtggccttaggtcttccttgtctccattttctcatggcatctcaccatgtcttcacattatctcccctctgtgtttgtctgtctctgtgccaaatttccccttttcataaggacaccatcatattggataagggaccaccctaatcacctcatcttgactacatctgcaaagactctatctccaaatgcaggagaaaatgtgggcaggagttggggaggggggaatatatggaaactctgtactctctattcgctttttttctgctctaagaaataagtctattcattaaaaatgttaaaggcttaaaaaacagcctgccacatagtacatattcaataaatgttagttccttttggatgctgcattaacttattcagtgcccctgacacaacagattttattcttcttgcattccaagatcaatactggcactgcccaaaaagtagataagacttagcttcttccacatggccttgtccctaagtgttgagtgctgggttagccacctgctcacaaacatctcctgccttgactgcatttacacacgtgctcatgcacaggtgacacaggtgagcatacccacacacacctaaaatggcttatctgccaccaacactgacccaaacaaaagcagaaacttactagttccccttataaaggcatcacaggaaatatctatagtgagggctacatgcccatagagggaaaaagaaaaacagcaaaaaagaatataaaacataatacatttcttggttgaaagatgcacatcagctattgaactaaatttttaaaggaaacgagccataaattgattttaataaatataaatatactttcatttccgacacagggtgggagacagagaagaaaaaaaagtcacaaagaaagagaaaattttttttaatgtcagaagaaataccactcaatattctgcctttgaaaagaggcagagaaaaaaaagcaaggaggaaggaaaggaaagagaggaaagtcccggaagccctggcgtggtggtaagatgcaggacacgcctctcgtcacatcatgccaatcccctgggccgcaggctcgtggctttgttcaaaaagaagggcaggctgggtgcggtggctcatgcctgtaatcccagcactttgggaggccgaggggaggatcacctgaggtcaggagttagagaccagcctggccaacacggtgaaaccccgtctctactaaaaataaaaattagccgggtgtggcggtatacacctgtaatcccaggtactcaggaggctgaagcaggagaatttctcgaacctgggaggcaaaggctgcagtgagccgagatcgcgccattgcactccagcctgggtgacaagagtgaaactccatctcaaaaaaaaaaaaaaggaagggcagtgtgtttggtgatttgaaatcttttttctttccttttttttttttgagatggagtctcgctctgtcgctcagactggagtgaagcggctcaatctcagctcactgcaacctccacctcacgagttcaagtgattctcctgcctcagcctcctgagtagctaggattataggcacctgccatcacacccagctaattttttgtgtgtttagtaaagatggggtttcaccgtgttggccaggctggtctcgaactcctgacctcaagtgatccacccaccttggcctcccaaagtgctgggattacaggcatgagccactgcatctggcctgaaacctttaacactgacttatttcttaatcatggcagtttaggcatgccctgttttaaaagaaaatcctatctatgagaatccatattgaaaacacagacatatccataggtaatgacatctgcctctgttaaggtttttgtttttcccctctttacaaaagaagtcacctcagtaaatttttcaatagcatgaccacagtccctcctccagcacaaaaatttagattttcataaaactctccgagaacgcatcatctgtcactaacatcaatacttagctctttcacactactctatttgtgacacccagagcctcacgactgatggaatcaccctgtcttgacttttcatcccttcattggttgagagtttgtttcctaaccaatgttgctgaaaagaattcagcactgagtaggggtagggcaggaaatgagggattactgcctggggactggggacgtagaagagaaaaagaaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacaccttctctcccccacacaagacacacacaccaccgagagtcataccacatggtacacagatgtggttttgtgctttcctctaagctacacccactcgtgtgcacaaagcctcacctagaaaagcactggtctgtaggaaatggcacacactctctctctccctctgggtgcccccacatgtatactcagcagcattcaaatggcaggtagtttttctatggctgggaaagaaaaagtgctcaagtaagcaagagaaggtgaggagtgggagaagagaatgggtaggagaaaaagaatttgcgtgggttaagagccagtgaggatggtcagccaaactgacctcacgatgttagtttcacttcccttttaagtattccaagacactgcccggctctgcagaccatgtgcatctccagcctgcttggagatattcatttcactgctcattagcacctctaccagaggtataggctgagaaccactgttgctgacaaacagccagaatgactacttaaatttgatgaggtaggagcaaaaaccagacagaggcttagaggatgctcttcaagctacttggataaattttaaaaggtaaaattgtttgcttatagacggacctctttttcccatgtctgtttgctattgctatagttattcaagaggcactttatatgcaacaaaagaccacatggaaggaagagaagagtctaccctcccactgcacctggcattcgagtccaggagtttagaccctactgcccacagggctgtcctcacacactcctgccctgtggtcagaacaggagcctaccccagggagaagggccctgggatgccctcttagggaactctcaaatcactttttctttttccattcagataattacagactagattggaaagtgtagaaaaatttctttatggtcgatgaaataataagaaggaaaatgggttgtttccttcataactagcaaagcctagggaagtactcttggtaagagtaagatagataaacatcaaaaatttaaaaccccaaataaacaccaagatttgaatttctaaagatttataagcagcattaataataccctagaggataaaaaaggggaaaaattcaaacattgtatagttttgcttttgttggctgaacttttatttttgtttttgtggggtttttttagaggggaaaaaacctttgaaaataaaataattggacaatttatttaagaaggtttctgaacttggcttcaaaatctaagttttgttttttgctccttcaaacaaagatgccttcaggtgtgatggctttaggttttgtacagctccttattttttcacacagggcaaatggctcgtctcatgtgcacataaagggctggaaaatatttctgtgattcgagcgcagcagagagtctaggattccagaggaagtggaggcctcccattccgcacaggaaacaatcttcaagcaggccttaaatgccagattccaggctgagtttaactaaccactgacagctctgtaaacaaagcaaggacaaaaagagcccgcttccccctttctggtagtcattttgggtttgggggctgcaggggaattctggaatacttgactccatggcacagaaacgcaggggaaacgggctcctcatttaaagagctggaaggggaaggtctttccggaattaaaaccatcacagaggaggtaggaaagggtaaaatggttgggttacatctgtagaaaagcagtgattttagagcttggaaaacagcttgatcaccacttaactgcttttaaaaatgttgcttcatgatgtttattcatgatgttactgctgcagtctttattaaaatcctgatgcttctttgagaatatgcacattatatgcctagacactgtattattttatttctcgctttcacttttctcctagttcctacaaatacctcttcttgccacttttcttttctgtttgtcattcctgttttcctcctcctttgttcactttttcataactttggtctggggttcagaaagttacaaagagcaaaatcattcattagaatttcaagtgattctaccaatatttcaagtcttcaaaacctctctgtctccggaggtcttttttaaagaataaataatcttgggatcttacttatttgtctctaggagattcatgaatgagactgaatttaactcggctcaggagtcagaaattgatcactggctaccttatcagctttctaagagtaaagaaaaatcaggagaatgacaaatgggaaagagggcccatagtaactcaggagaagtaacacactgagttatcaatgatattgactctacctcctctctttcaggtccagacatcatctggtctccctgaacctgaaatcacaccatggatgattttgagcgtcgcagagaacttagaaggcaaaagagggaggagatgcgactcgaagcagaaaggtaaggatctagggtgaaaaatacttgtattcccttattaacaaccttggtttcaggcctcaaagaccatccttttgagaggccaaatgtggtcatatcgcacaccaaactgttcgcaaaagtagttatggaaaatttttctgctaagactctaaattaagcatttaaaaaaggaaaacaaacaagaatcaagaaaaagagagatttgagaggaatcaattgataactgcatattgataattgcatttaatcaatacctttcacattggaatgttttaaatgacaaaagtaatgtgtgaatgaaggtttaaaaagcttatataataagaaatgacaaaaaaatgtcaagtattgaatattggaaccacttaggacatgagagtcttcaatctaaaaaatataaaggcaaaaagccctggatgaatcttgtgaaaaattttcattcttattagaaaagtatccaactctagggatctgcatagtacaggttaataacgggctatgttaccgaggagattctgggtgtaactggaagctgttaatgtcgtgtgaggcctctacagtggtggctatgaggtcaaattggggagataaagcattggcatataaaacctggggcataaatacatattttaacattttaggcctcagaacaaaggacagtgtggtatttgatgcgacttaaatcagatgttcttttgagaaagcaggttaggcattcacagagagaaaaatgttaaacaatgaccttaaaatcaaatcgatttttttcccagtaactccaatgctcagatgaaaaatgacactttaacgataccacagcacaaaactggaaacttacacctataatgaaaagtattgttcttatgttctacttatttgcatggagaatgcaaaagcaaaagataaaataactgcctatgatgaactgggccagagtcagctggcattcatgaactgactaaacatgtccacaaggcactatggatggtacctgcattctgttggttcaaatcctagctctgccatttgcaagctgtgtggccctgagcaaatgatttctctttaagccatagttgccttatatataaaacaggcataatatctacatagcctgtgtgattgttgggaagattattgagcttcataaatagcctagtcaggtacctagcacatagtagtttttcataaatgatagtttttcataaatgatagctattattattattaaccattatcactagccaaacaagaaatagcatagcagcatagccagagctaaacaatcatgccaagagaaggaaaggtagtcattatcctgcaatggaactagtcagagaaagtttcttggtggaggtgagccatggaggaggtaatgatggcaatgaagagggaaacggagcctgtctaggtgaaggaatgacaccggcaaaagtgcagaagtggaaataagaatcctggtgcaagaaacctgttgagtgtttaagggaaaatggattggactggtatatcttggctgttcctatttgccatacaaggaatagacagagacttaacaagggagttatgtgcgatgacactatgctggagaaacttatctacagtggactagaatatggggataccagcactggaagagatagtatggtaatgagggcctgaatcaggtcagtgagtatggaaatgaagaaagatcaaatatgagagtctttacagagggagaattagcaaaccttttaggagagcaaagaacttatagacggttccaaagaatatacatctgaggagctggaaggaaagtctctgctttgtcctaaatggaggatttccttcttgaatcgtcagagaggagcagtgtttaatttcaggtagaaaccacatccaaaaggggatttcctgcaggcatgtggagataggaaatttcactctttgttcaaaaagggagagaaattattattagagtaataaatttgggcagacacagtatggtggtgctagtacaaaagctgaggggatattcccaaaaaagcaagtgtagaaaaagtgagcggtcatcaaggtataatggaagccatcaaagaagacaacgtaccagggagatgggggagaaccagggagagtatgaggcccaatgttgagtggacatggtggacatggaagtcttgcgggcagtggccgggctcagtgaaccacacctcttattccttccaatgctgtgttatttcacctcaggttctcatgatagtctacaaaatatcttcatccaacaactatttattaagcactaaccaggtttaagtgtgccaggatgggaaaaataatggtggtaaagaagtagacatggttcttgcctttatatacctcacagcatgctaggaaaccaaagtgtaacagaatcaggaagcagacaggccagggtgtaggggcagacctgatagagttgtggctagagaggctcaggactgaggatgtagacactgggcatcaggctagattgccattgtcagcttctttcctttccacgtgaacagggggtcagggaatcattgacagaggtgtgacagaactaaagtgctgtggttagagccatactgtcattagagtgaataaacccagtttcttcaggttcaggactttgcttaagaattgaccgcacggctacgtggttcgttcctttgacttttttgttttgtgtggaagaatttgtcttcttttaatgtcagatgtaaaaggaatgtacacagtaagtcttagttatgtaccctgaataacctaaaataaacttacacaaattaatcctaaccttgtttaatttatatttctgtctgtattacttcttttgggatattatattgttttcttttctgttttttatttcttctttccttccttttctttcttgcttccattcatttccttccttcctctctctctctctctctcgctctttctttcttcttaagagtagtacttacataattccttatacttgtactaagtttacctttccatgtttcaaggtgagccttctagttctgctattctgagatttggtaagcccatgaccacccttcaggattttgtaaaatctgatcatttatgggaatagtgaaagtcaggcttcatggttcagccagctctggtgggaaagtgcagggtgtgtgcaggaaacaggtggccagaagctgaaatcaaggccatctaaaatcatggttttgatctgaagacaaagagcacatgagaccctgagcaagtccctcttcctttagctccagaccttggcttcctcctctaaaataagactagccattttctctggggtattggtggtcactttaatttttttctcgcttttggtattattgatttttctttactacgatcatatgttactttatttaaagccaaataaaaatgaaggcaattttctgttttgaaaaaaaataattctatggccctatgcagtatacctgagcccagatgggagaagacttaacttctctttgaatttagggaactaaaagaaagatttcatccctgatctggagggcagttaccaactactggaaatagagtggctccaaggctcagagctgcagattcatttacttactctcaacacatttttactgggcatctattccactacaagctctattttgggtactgagaatagacccacagagtaacagtgttgggaagtgtgtgcttagtgctttacaacctatctaaaatgaaaaaaagatcaagaaattatacttttgtatcctcaaacataacatgtaccccgtatgggttcatacttattagagatgacccacagcctttgtacacctgacccctgcagacagtgtgggggatggggtatactacagagaagagaaagtccattgactttccttacccataaaagcttttcaaataaaaataccctgttatttttatttaattagtattgagtctgattgccagatgcagttttactttgaaatgataaataatttaaaacttgtacttttacccggtgttataaccacagattaaaataaagcgaatttttacacattttattcttcagaaacagaccttttcaaagactattttgcaagctaattgaaggctttgtgccatgctggcttgcatgtgcttaggactggcatttattcactgcatccgagctgtcctgagactctgtcgtccacatatctccttctaagggttttagcccagttcatttcaaataacctcgactgcaaacgtagtgcatcaaaaacgttcttccagctgggcgcagtggctcacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgacggagtgagactcggtctcaaaaaaaaaaaaaaaaaaaaaaaaacttccttctttgtcttgccccttagcctgtgcaacttttatgccattacctcgtccttccttgtcttccatttggctttctcactctgagttcttgagataaggtctttagatttggcaaaaaggaaggaagtacttcattttgtcataaaaagaaatacagatgctgaatacctacaaaatgcaagatactataccgaaccataggaatcagtggtcaccagtagggacagtatcccagtagtcactaagctcctattctaagggtattagtaactttagagcaatcgtgaccaaaagagggagaaaaaaaattcagtaggcagaatggaatgagcagtaatcagtgaaaatccttaatgcattgtttctaagcaaaaggcactatttgctcacatctcaaattaaactgtattttaaaagcaattactcatttgaacaaacagataaaaatttagttttgctgtttattattctccaccaatctcaggggagtaaaaagttaaatagatacattctggccggatgcaatggctcactcccgtaatcccagcattttgggaggccaaggcaggcagatcacttgaggccaggagttcgaaaccagcctggccaacatggtgaaaccctgtctctactaaaaatacaaaaaaaaattcgctgggcatagtggctggtgcctgtaatcccagctactcgggaagctgaggcaggagaatcacttgaacctgggaggcagaggttgcagtgagccacgatcatgccactgcactacaagctgggcgacagagcaaaaacaaacaaacaaacaaacaaacaaaacaaaaaaaacccaaaaaacaaaaaaaaacactatattctgcttccctttctgtttcttttatttcaatccctctcctctgccttcatctctgttttccttggtgcaccttcatgtgcctcttccccggtccacgtgcatcttcatcaacacttgatttgtttgtttctgtgtctcttcccatctgcactcctaatctgtctgctctgaattatgtgtggatgtgctgttgcatcaccaggaaatacatacttctggccaggaaagagggagagagaaacccagttctcttcctgttcagcaagtataaaaaagtgctagacattttatgtgtgtctagtaaagacggaccgccgccggccccagaattagctatgtctgaatggaacatttttgctctatatgaatgaggcaaccccaagacacataatgatggcaggcagtacagttggcagttaagggcatgagctttagcactgggcagctatagtgtcaaatcccagctctgccacttactaactatgggatctaccaaattattcaatctttcaaatattttgtatcctcccttacaaaatgggggtagtaaaagtatccacctcactgggtttttgtggggatgtaaaaaggtaagacatgaaagtattaacacagtgttattcatctaataaacattcaataaactcattattaattattattatttaatttgattctctacaacatggaaataaaaaaataaaaatatgaaaggcttgtggattgttttgcacatcatagatggtacaagaaccataggcaagatgaaaggcaggaatgcgtgactgactgaagagctttgagtgactgtgatcggtaacagtttttgaggaaggactgtgttgtctcagctggaagaattagcaccagtttaagttatttttaaaaatttggccgaaagaatgttgagctgtggtgtattttctttttttctttttttctttttttttgttttcatttttgtttttttgagaaggagtctcactttgtcggccaggctggagtgcagtggtaccatctcggctcactgcaatctctgcctcccaggttcaagcgattctcctgcctcagcctctcgagtaggcacacgccaccacacccagctagtttttgtattaattagagaggaggtttcaccatgttggccaggctggtctcaaactcctggcctcaagtgctccaccggcctcagcctcccaaagtactgggattacaggcatgaggagctgtgatgtattttctgagaaaccagcagtgatgcttttatccatgagaaaatctccagcagacatacttggccgacaccgggcttggttccccaacaaatggctctctcactttccaagatgtgctcattacgttcacagcatctgctttctgcacccaacatgagttcctctcactgatcagaagaaaggcccctattgtagagttacgttatcagattcagaagcttacagacataaataaagggaatgaaaacacttgctgttgtcatcattcatacatttttatgggcttctgaaatggcttgatgattagacatttgaaagtaaatatttttactacactataaaaagaagcaattttttaaaatccatggggtctctaaagtcccctctcagaactgtatcactgagacttttttacatgatttaatagaaacagccaatgaatgattatacaacacacaacccctcacacacgcaaacccaacacttattcaaaatgcttagcatcaggaccttgacatttttaaataaaatcttttaaaatgaaattactgttattttatcatcagaacattattttccattaagaagttaaatacgatattcctttgaaactatctaaattatcaaagtagctagatttgctcaaaatttcccttcagttctctcagaaaactgatcactccaggggacaaaagaaagttagaatctgccatctagttttctacttttattttttattttttgtagagatgtggtctcgccatgttgcgcagtccagtctcaaactcctggactcaagcaatcctcccacctgggcctcccaaagttctgaggttataggcgtgagtcaccacatactttcaaattaaaagatctgtcactgggcgcggtggctcacgcctgtaatcccaacactttgcgaggctgagccaggtggatcacctgaggtcaggagttcgagaccagcctggccaacatggtgaaaccccatctctactaaaaattcaaaaaataagctgggcgtggcagtgggcgcctgcaatcccagctactcaggaagctgagacaggagaattgcttgaacccgggaggtggaggttgcagtgagccgagatcacgccattgcactccagcctgggcaacaagagcgaatgctttgctcaccccttaaaccatctgtgagcccagattttcgtcaccgtgggacagacaagaaccctgtctttagctgaactaaggaaagtcctgcaacagcaatagactaaacaaagactattgtgcctagttgaactattttttatgcttcttcaggtaaattgcttatatgtgtaggcaaagtcattgttttgtttgccctcagaaaatctcctgtgttattcccatttagcagaaaaatagaaacagagaagatcgagtttccctgcttaaggcaaagaaggctgttgatatgactattcttgacttttcactggacttttttcaacaagactgtacatcattaggacagggacttagtcacatcatcactcttaaaaacttaaggctgtctctgaccttatgaatcatcttccgcaggggaacattatgtattcagttttggaccacacactatttttgaggcactgatgaaagctctggaccctcctccaagaaaaatgcacatatgcacccaccaaacttggcacttacattcagtggcatcatgaacctccgtccgcagacctcctgggggccgatgccttctggccaagaatccctgatctaatgaattttaaaactgcctgttaaatattaagaaactcaagcctaggagacatatccccttaagatcacccagttaagctgtttgcatagtgtgggcccctggacaaacaaagccatcctgatcttgctatatgtaaaaaagtctatggctattgattaggaaaataaagcatattttggaaaagagtgtattctacaatgtactgcatgtagagtgctttctaaaacttaaaaaccgtttatggataatgtttctaaataaaggagattcggtcagattacagtgaataaagtgaaaaataaagaaagatgagtggataggcagaatgataccagttaatagtcaggaactgggaatcaaagtttggcgtctttgtcaacaaggacaaaaaaactttggtgatttactacaatcccattttctatcaattttggaagtcttttatttggtatatgttgtgttagcatgattccttcaaacaaagcttaattttgaaactaagttatgtaggatttctccattcttaccagtttttagaaaattcatcaaatgacttttctctctaaatatgaaaaagataagaactgatttgattcctaacagagaaacttatattttacatttatcactactatctttggggaggatgggacagatttggagtgggacaggtgcctttcagagagtaggatctagagtcatgaagacttagattcaaatcccagaatcccagctggattcaaaatggttgttctactccgcctctctcagcccatttcatcaagtggaaaatggccatcgaaacagttcttccttataaggtttaatgcagattataaagcacttagtagtccctaaaacatgactagtgctcattctgttacctcttgttgctgtttttctgctggctgaaggacatggtaagaaaggcgctctcagaaaagccctctctggggtcacctcagaaactcagccttttggcagctaccatctggggtatcactgaacaaggtacaactccatgtgtcagatggctcagtgtctaatcttttctctgtttcagatctgttttagcagctaccttgaaagtgatgggagaattatggatataaatgtctccctgtaaaaagaaaattacctttttattattaagagttcttttccattttccctacttgtttgaaatcaagacaaaagcatgcaatagtctggtacatatcaaggtctttgtcacaatgatatatacatatgtgtatgtatgtatataatttaattaatcatgtatggtcagctctccatacctgaggattcaaccaacccagatcaaaaatgtagttaggcctacaatggttgcatctgtgctaaacatgtacatacttttttccttgtcatcatttctgaacaatacagtataacaactatgtacatagcatttatattcccctgctgatactgagggatgactatatttaaaatactctttttgccttgtgaaattatcatttctcttttcatattgcataatctatggtttcattaccattaaagcatcaaccagaagcttctcaatgccaacattatatataaatattgtaataataacataaggaaaatcatatgcctaattgttacaaaatgattttgaaaaaatgtatcccaaattactaatttattcattttaattatgaaaaaactgatgcatacaaagtaatcctatgtaatatatatggaagttctaactcatcctaatgcgtatcctataaactcaccatacagcctaagacctagaacatttccaatgccccaggcccctctccaatcccttcccttcacctccccacccacagaggtaaccagtgtcctgaataattcatttattttaaaataaaatttgaaatgagatcatacgaatttaggtactagcttctccagggccctgggatccaggcattccaaagattctctccagactctcaggtaaaggtgtcagtgagagcccacttccctgagagggcaagaagtttgtctttctaaacacacaggacaggctgggcatggtggctcctgcgtgtaatgtcagcactttgggaggctgaggcgggcaaatcacttgaagtcaggagttttagactagcttggccaacatggtgaaacctcttctctactaaaaatacaaaaattagccgggcatagtagtgggcgcctgtaattccagctactggagaggctgaggcaggagaatcacttgaaaccaggaggcagaggttgcagtgagccgagatcgcaccactgcattccagcctgggtgatagagcgagaccctgcctcaagaaaaaataaaaataaacacacaagataaacgttcttatgctgtctaaagctgcaagaagtatacagtgtgaacaaagaattctcatcaaaataaaataaaaatacagaccaggtgcagtggctcactcctttgggatcccaacactttgggaggctgaggtgggagaatcacttgagcccagaagtttgagaccagcctgagcaacataggaagacctcatctctacaaataataataataaaaaaaatagctggatgtggtagtgtgtgcctgtagtaccagctactctggaggctgaggtgggaggattacttgagcctgggagttcaaggctgcagtcagctgtgagccatgattgcactactgcactccagcctggacaacagagggagaccttgtctcaaaaaaaaaaagatgtaatgaaagctatccaatacttatattgaacctctctcttttgccctatggttttctcattggccagcaggagtgacagatctgcatttgcagctgtcatttggtcaggtggaactggcagacagaaatgatgacttcagttgctttcaagtcttccaaggaagttcttgacctttattatcccaaaggtccctaaatggtgctgcaagaaagtaccacagggcatgaaacatgagcatgttggaccaatgtggtggctgtgtaagtgggctgtgtaagtggattctcattcatctgtgaatcaggttaaagaggaatcatgtgcatattttgtgaataaaatcagttctttccactagtttgctatctaatgagcactattcatcagcagtggaaaatcagtttttagcctatcctaaacctgcattaacgcagactgtttttgaatttttaatcatttattcaggaacattagtaaagtacaactttgaattatttataaataaagtctttggttaacatgttaaatatgtaagctacattccatggcttagtttttaagtactggagagtacaacttttttttaaaccttttaaataactttaaaaacattcactgacattgaacagcttaatttgttaattataaatcatttgtatgtattcaccatttgaataagcttctaatgttttgccagcatgatggaagttaccaggtaggtagacttaaacatttttcaaaattaaatttcttttaaggtattttataatttttactgggcttacttctagttgatctattttagtgagacctgacattgcatttgagatgtgtaccaatgactaggttagaatgtgagggcttattttccattttaataactccctacatcacatacagttcctttgttgggataaaaatctcagtaaagtacacatcggtcactataaatagcagctacaagcctgtacattcaggagagtctccagagtgtattttaaaccccacattgtttagaataggaaattcttccaatgttcatattttccattgtgggtgacatggactactatcccatgtcacatcttcactggcttctgttttcctgtaccatttaggaactcaactgacggtttccagcagattgttcaatatgtgctttttatttttctaagggtagcctgggtctttttgtccagtgggaattttgcatgcttcatggggctctccaaataaaagctagataactcagagccggcaccagcactaggtaatgaaagagtcctttatttctggagctagtagcactactgtgcccgcttagaataacagcagtcaacccattttttattcccacagaaaactttacactgttggaaggttttctggaggtggggggagactcaagagactaatatgaaaaataactgagcaagaagtgagcaaataaacaagcaggatgagatgatgggttatcaggctgattcaaagacaagaagcatcatcaggtctaatcacactgcatctttcccaaggcacaattggcagctacagtacatgtatatctctgcccacttcttccttgaacaattcttctgtttctctcatcaaaactgttgtgtagatcttgatctttttttagtggagtttcatttgggggatctaacattccctcactatttgtcctttgatgaagaagatgagaaaggacctattattaaggggcctcgcgcaaaagttgtgatgtagaaagaactgatatctgacacctgtctttcctgctactaccttttaagatcctttaactcttcctatctaagcaggagagtgtattttccctgagccagcatcttcatagcatatcctggctacctagggattatcattgctacagatgctcagcggcttttgaactgaacagaatgaagttttttttaaactctaggttgaggctggagagaaattcccaaatcctttagtccctaagtgcctcatgtcatataaatgatgtctcattgtggcattgtcagagctatggtagagctgaaatcagagacatatgcgcttcagaaaggtgtcagttttccatgagaactctgcctgaagtgcagaattacttctagaagacagattctggtgtccagttgggttatgtcatcagaaattaacatacactctctttcctacgttctctgaaagggggttggaagcccaaatcattggacccaggcttgtagagcaacatgtccaagagcacacagtcagtggcagggtcaaatctggaaaccttgtcattttctccaactctggcactttttttctttgcatcgtgtgaggccccactctcaatttattatcacattagagctaaatgtcctctaactcctgctgaagagactggcttttaaatcaaggataaaagaaaagacactggataaaagttcagcagatcagggcttccttatctataagagagaactaacacttctcagggtggctgagaaaattaagcaagatacagaaaaaatgtcatcgaaagtataaagggtaatgcgcatgacgtacgtttatcatgttgaagtgcctgggtgattacactggattcacttctatattaactatatgtagagttgcaggtttcatgctggtcatgtgctgtgtttcaaaggaattttcacacttctaaccctgctgccttatgctagctgactggctgtcaggtattctagtctttcagaaatcagatgctgagaaaacacaatgaaataaaatgtcacctgtcaccctccctagagcccgtcacctctggagagggcttaggacctcaattgcagattagaagaaccaaagccattttattttcccttttcctctagttgtgaattgaggagaaaatgcagacgatttaaaatcctggctttatcccaatcagaaggaaactgtgctgtgcttacgaggagaaccctactcccaccttgggtcttacgtcgcactttttacatatgttaattattatcctctattttatgtttatttgttctcgtatctgttttctccaccaaattgaaagcaaccgtagatcagaaactacatcttactcacttttatttccccaagaccagcatacaatgttgaatgaacactaacacttgtgtatcaaggcacaactgtgacaaatgtgctaagctacttgtgagggaggcagaaatgttagtgacactcgttgtgtcttctaaacactgacaccatcaatgcctctcctggggtttcatcacttctctgctgagccttcaagccattgcaatttcaactccatatcttttctccagagaaatgaagagatttatctcatgtatttttttgattattaaggataattggacctttacaacatagaattttgaccacttatgcttatttagttgcattgtggaggcaaatgatattaatatggtaagagtccatttccttttgttggcctatttactccggtactcaagcccttggtatatttgcaattagtatctgcattataaatcagataatcatcaaattacagggtttatgccaaacgtacaggagtccaacagtgaacaaactgtataatcaaaaatttctctaatgaaggatcaagcttgtggtcaggaggagtaaagtatccagttaatcccagaagaatgggcagaagtaggataagggtagggccaatctctggcatgtatttatcaacattctttctgataatagaatgtttagcatacaatagaatggagtgtttaacatacaagttgagttcaaagtttagatttcaaatggtaaatggttttccaatattgggatgtaatgatggaccaaaaaagaaaaagaagaaagtaatacattagagcccaatactttttaatcaagatatgaggacttaattatttttttccagtaaagtcgagcatttttataaatggtttatgctccttgagtggtactatttggaagaaggaggaggagtatttataaatggattttcttcatcataaaatataccctttggttaatttgttaacataaaatttgtaattaaaataaagttagtgaactggaacactcaaagtacgtaaacccagaagcacaatcgaatagcctcagaactgtatttcttaggtaagaaattttaatttttgattcttagatctactgggaaagagtcagaaggaaaggtaatttgaagttatcctagaaagactctgaattctaaaatacttaggagaatctcagattacttcagccctctctactttgcaacatattttagaaagctggattcatatttcacatcattggctttcaaatttgaagtgactgtcggctattttttttaagtatcatctattttatcttttgttgttgttgtcttcataatgtgttaacattaaaaagctttccagatggcttctggcttttaaatgagaaaattggatatttttactaaatattttcccttaaaaacctgccaggctggttgttattctataaattagtgagattaaaaaaaaggccccatttgcttttcctgttttaatcttaataagagcttgatttcactactcaataatgtcaaagtaaaatagcatcttaaaatggaaaagctttcttctcctactctatttctaatctcctgccttaggctaccatcataaagatacctaagattctacagaagagcatttctgataaatacaattcataagggtcaaactgcattaggtctcccagatttgaacaagtggagtccaactgtaatccacgatattagtgagtgtaaagaaagaatggccagtagaagctggccgcggtggctcacgcctgtaatcccagcactttgggaggccgaggcgggtggatcacctgaggtcaggagtttgagaccagcctgaccaacacggtgaggtctctaataaaaatacaaaattagccgggcatggtggcacatgcctgtaatcccagctacctgggaggctgaggcaggagaattgcttgaacctaggaagcggaggttgcagtgagccaagatcacaccattgcactccagcctgggcaacaagagtgaaactctgtctcaaaaaagaaaaaaaaaaaggaatggccagtagaagaagcctgcatgtctgccaagttcaagacctggtttggccctggggatctaggaatatccaaatgagacagaccttgaatctcagggttggttgagtttcagggtggtgacatgagatttatggcttgaatctcacagagttgtgacatgaaaagtattctctccacttggagaagtgtttcctcatgtctcccactggcttgggtaaaatattacctgtgatgatttcaccccgctttgctctgacttcacactcatgaagaagtcgctattgactacgcagcttcctaacatcctggcttggggaatgggaggtgccctggttgggaatgagagttctccaggcactgaagatggagagcatttattctatcttaattggcactagagaaggcatcagtctcttgtgcatctgtgagttcatcaatcttcctgatacctgtcgattctggacctcccaagatccaatttctggtgcagaactgttatgaatactccaaaaaaaaaaaaaaggccaatctttagaaacctttggaaaaacaagccaactgaccttggtgcagcgtctctactccatcgttgtccctcttcactccagagaaaaaatgacaagtacttattggccatctgctatataactaacaccctcctaggctgtatcaggtgcaaaagtggtggtaggaaataccccttccagcaaaaatgttacactgtaacttatttggtaaaaacaagtatatacacaggaacaatgaacaaataagactgtgtatttgtatttatccatattttctttctttcttttatttatttatttttttgagacagagtctcattctgtcacccaggctagagtacactggtgtgatctcggctcactgcagcctccacctcccaggttcaagcgattctcatgcctcagcctctggaggggttacaggcgcacaccaccatgccaggctaacttttgtacttttaacagagacggggtttcactatgttggccagtctggtctgtaactcctgacctcaggtgatcctcctgcctctgcctcccaaagtgctgggattacaggtgtgagccccgacacccggcaccatacgtttatttctatctgtagatcataatcaagtgctgatcccagtcagaggttattacaaaatataacagaacctaataaagtgttattatataatgtaaataataagcacaacacctaaagtatctgaaacacataatggattatttctctagcaataggagcaatatgctttcatccaggtctgaccaccccccaaaaagaaggaaatcaatattttttaagactttatatggtatcactggaaaaaaatctggatttcattccagctataaaagccatgtgtaaatttaatatccagatgcaaaaggtggacacccacaaataaatttatgattgtggaaatatttagacactttgaacaagagtggtacacactgagaattctgtggcttaggaactaatatgcttcctttgaagatttgaccttttcttctgcactagaattatctcctgagtccttataataatttccttcacaacctgtacctatgaacaacaaatctacattctaaaatatatcactatggcctagattcagtttcttatgggtagaaatcacattcttcatgtacacacttctttcctagaattatataaagcaggtattattattatcgttttcaccgagaccagaaccagaattttgtagatgtgcaccagccaccattcattcaagaaattgttagagccctgctatttccaagcaccgtttattgttttaaagatatgtttcaagttggagggcagaaaggagttagaggcatgatccttttcagatagaaacttttcaggaaaagaaaatagtccagttgtttaaaaaaccctggattttaaaaagagcttagagagtcggcctaagtaattggtgcaagacagtttaaacagaaacagggagtctcacagcaagttggctggaggagctgactcatacattgcaacataattatttcccaaataacatgcaaacaagagtgggctcaagctttctggtctctctctccctaacaagataaattagaaagaaataaagtcaaatccaggaagacttcatagaggtaaggcctggaactggttcttaaagaaccactagaattcagagaagcaaaaggagtaagagtgggcataggacttacaaagcaattcatttggagaagaaaaaagaaaaagcaaaaaccctggatatagcacaaaactgaatgaatgatctctctaagagatgctattatcaatgtgaaaatgatgttaggatgtgttaacaggaacgtggcaggaagcactgggacttcagccaggccttggtcagcttttattatgtccaattttggtttcccgtttgaagagttgttatagtcaggctgatattaaaaggatggaaaataggcattggcgtctagcctagaaaagacgagactaaaggatgacttaatacctgtggccctcctagagataagtaggtttctatttcagcaacaggaaatctagttcgataacaggataaattgagcgtgagagtgattaaacactgggaccttgatcacaggatgtcacctactgaagtatagttctttagctctactgctttcagagtactgttcactttctgtcttataatagaatttttgtatacatgtcttatctccctttaggactgcccttcttatctttgcatcccccacagcacttagtgcaatgacttgcttgtagtaaacattccaatagtgctacgcgaagcaaagcaaaaaggaatgtgctgggacaaaataaaactacatgctcaccattataagggcaataagacagtgtcacaacccaagcccctattacaggcctagagacagatgaggcaaagaataattaagaaacgtgtatcagcacaggccatgaagacgctggtgaagaaccactggaagactaggatgaggagtaaactgtgatttttccacagcagctcctgcattcaagatcacaggacatgacagagcaatatagtttaagtgaacacattcaacgccatggcaggggcaggggatgggagatgccgtcgtctatgaggggaaaactatgagaggccaacagaaaggaggaaagagatgctgcctttgaatatgtaaactcctttacctacattcctgttcaccttggggtgggggaacagctgtctaggcaagattttttgcctagttctaagagtacagagcctatgaatttcttcataagaaaatttatctccaacagccttttcaaacgtcccctttgtactactcgaactgttgcctccctagtggtagatttcccttaggtttatgtgtttccatagtaagtgaatggctctgtgcatgttatgtgtgtgcatgtgtgcgtatgcatgcatgcgtgtatatgtgtgtgcctgtgtgtacatgcatgtctgtatgtgtgtgcatgtgtgcgtatgcatgcatgtgtgtgtatgtgtatgtgcatgtgtgcatatgcatgcatgcgtatatgtgtttgcctgtgtgtgcatgtgtgtctctatgtgcctgcgtgtgtatgtgtgtgcatgtgtatgtgtgcgcatgtgtatgtgtgtgcatgtgtgcatatgcatgcattcgtgtatgtgtgtgtgcctgtgtgtgcatgtgtgtctgtatgtgtgtgtatgtgtgtgcatgtgtgtcataagcgcattagggcgtatgcacagcacttcccacatacctctcttccctagggaattgtttcaaggtagaagctgttcttaaacaactgctgcagactctaaagtctggaacagatcttgtggtccggtctcccacctccatgaagtaaagttatttttaaaaaatcatattttcttaataaaggaccaccctgtggtgggagctgttcctttctattacagtctgacctccctcaaaccttcccagcccagaatctctttgatgaaaaattaaacaataaagtgtccagaaacaaaggatactatgagtaatctcagaatggcccagactttcatttttcctagtaagagtcctgaagcatcatcaaattcatgatacctattatcttgctgaaggatgactggcccacttgttcatggtgccaatgaatagtcattagttcacttctcagagacaccagttctggcagctggacactgggtaccattctctgctatgcagtgaaagcacacaggcctgtaggtctctgcaggaccagaacactgtgcacaaataacctttagattgttatttctcaatcctcttaccttgcctctccagccccaggcaccaggtctcagaggactcttggaagcacttgcctagcccagccctgctctcagctcatgattcacttgttatctctatgcgtcttcccgcgttgcctgtctttcattggcctttgtgttcttcctcttcccagagagtgtctgaaccaggtccaagactcacttctctcttcactcttcccatgtcagtaccctaccaggtagcatgagctataacaccactgggttttactatcacaaactgaagacagacagctgcttcccaaatgcatgcccctaataacaaaggagggtgcgcgctgtttccctttccctcttttggcaattagggaaatagcctggtggacatcctgtgtacagctggcaattagcacactttctgtacatggattctgcacatgagtggaagactactaaattcttgctctcctccatggagaatactggccagaaagaaccacaatttttttttctaggtttttccattttatgaacctattctgaatatgccaaaaccatacctgtcacctcagaattggcgtggggggctggggaggagggaatcaggaggtgatagctttctcgcatggctgcgacaaataactagaaacttggtggctttaaacgacacaacttattctgtacagttctataggttagatgtctggcacaggtctcactgggctaacatcaaggtgtcagcagggctgtattccttcctggaggctccaggggagaatccatttccttgccttttccagcttctagaggaagtcacattcccaggctcttggaccccctctccatcttcaaagccatcaccagtctgtctgcccaccctgacagataagctcctctaaccacagctggaaaggggtctctgattttaaagagccatgtgattcattccagcacacctggataatccaggatgctctccccatctctatgcctttaatttcatcatatcgacaaggtcccttttgccacgcaaattaacatgttctcaggttctggagatttgcgggaaacgttattccacctaccatagaaaaccaccgacttttgtaagtaattgaagggaaaaaattaattgggcaaaattcggtagaaagagaagcagcagaatgcctcgatacatgtttctgtctcagttctagagcgagaaactcaggacaagtcagtgtatatttaagtcctcttgtgtgaaggcagatgtatctctacttttatgggtgtcttatgtgctactttcatcaatatatgttcggtgatcatatgtgtaatcagagatatttaaatgcatatatacataatgatatatagagataattaactttaagtttattaaactgtatttactctataaactatgacttcattttttgttttgttttgttttttgttttttgagatggagtctcactctgtcgctcaggttggagtgcagtggcgccatctcagctcactgcaacctccgcctcctgggttcaagcaattctcctgccgcagcctcccaagtagctgggactacaggcacctgccaccaagcccgggtaatttttgtatttttagtagagacggggtttcaccatgttggccaggctggtctcaaactcctgaccttgatccacctgcctcagcctccccgagtgctgggattacaggcatgagccacctcgcctggcctataaactacgactctgatgaccgcatagtatttaagcaagaaaacaaccaaaatgttctagctaaagtggagaccacttaacctaacccaattaaactttaagttgaacacaagagtagtagatgcagttcagctccatgacattgggtgagttgtctaaatgctctgtgctttggtgtccttgtctgcgtgtgacatgaagccgcagatctcaaagatctctttcattccgtgaaagcgctctcaatgtgtgaagttgactgcttctcctgctgtttaccaagagaataatcttaaccctacattgtggagatcggatttgttctcacttgacagaaagccagtcccacgagcagcttggtacccaaataccagtctgtttagtgctcattagagatgaagaaccatattcataagtcaagctgagacggagtgtcatctccagacagaatcaacaccaccccctcctcaggaactgggatttggctgctttccaagccgctgctgaccaggttccattgcccagcttggctgatgagatcactggcagagtaccatgggtgcagacggggcctgctgtttcaacatgttctcaggagggctcttgcccacatttcttggagaggtgtgagcaccaaacatgctgaaccatccagcccatcactgagcagggccatctctcttcatcccttttcatttggtttgcatttttatgtcatgctccttccctggataaaagggataagaggagtttctcagatttgatttctcagtgggaactgtttgctttggaagccacctacaccaatgctaattgagaacagagctcagaatgggagcctgagaactgcacccggatgaactttttggtgggctgatttctgttgatcttgtcagaattaggttgtatatgcatgtaataccatgatcaactattttccaaaaggctgagcaaatgcatcagtgtctttttcctttgaccagttacttaccttggaaaaattatttgtagttaagcatataaagtcttcatcaggaaaactactggagatcctggccctgactacccagcaataacatttctggaactcccgaagcaatcagtgctctctgatcgctaaacatgatgggcttctattagagagattacagtaaaaaataacaatcagctctctgatgatcctgtgaggagggaacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccagtgagtcctcatttcgcctctttggttttttcctttcttttttttttttataaaaaacaaacgaattgttgtaaaaaaaaaaaaaaaaaaaaaaatgtgggagtgggaggggagaggaggagacaccaggcaggaaaggaatgcagtgagtgtgtgagtttcagacctgtctgaaactttctggtttccacttcatggttgctctgattcgctggcttttctcgtttccattttaatggtggtttgtggaccatttgccaggagtttatacctaggcacgggtttctccgtttcaaataccaatccataaagcattgtgtttctaaaggtctgctgttaatttagaccttagccctccgttcagaatgatccatttgcagggctcagagattttggctaaagcacacattgcccaatccttagagtaaacagccaaagccctcaatatactgaccatctgactaagacagaacaagacccagagcatatgctattgatcagggaattgttcagataacggactccaagggtttaggatcatgaaatcctggaatgttaaagccagaagggaggcctttagactctttggtgcaatgctgtctttcaataggcagggaaacagaaaccagaggggcaactcaacttaccccaaagcagacaacagtcggtagcaaagccatgtctttgtactctcatgcaaagggccgttttcacactggtgtttatgaggtttgaaaaacttactgggtcttgggaaaaggtaccgcacaagaattagaacaccaaatggcctttcagtaaatcttttccatttttgagagttttggcaccgattcagcatgacaattgttgttccagttgttccagcgtttgtgcaacagttaatcaaataaacagagaaactcatcagggtcctaaaaacaagacccatgtccattacattagcagatctcttggagagctagtttccgtaagtgtggttggttattcacgtgggagagctcaaagggactttagacgttatctgtatagtccagtgcttatcaaactttttaaaaaatcaaatttaatcttaaggggaacgctattgtataaaggagatgttctggttaaagaaaaggtttgggatctagagctcctcatcctcgctctactctgcagtcatagcccactgcacaattctacccctctcctcatccctcttctaccccacctccccaccctcttcatcaaaacttccttggaatcctaggtctccatggaatagttcagaaaccactgatctcattgaaagccttcatttcagatgaggaaactgaggcacaggaagggcttgcccagggtcacacagctgatcagcaatagagcgtgggatgctaggaaaagagcccagtctggctggctgtctctctctcaactcatggtcctgaggcttgtttccactccttcatgcctatgattctatcagtctcctttctctgtgtctctcttctctgtttactctgccatttcctggatttcaacagctattacctctcaccgggatggttgtcattgcctgccatctggtcctcggcctctgtctctctcccctttctgatccagccccctacagcccccacctatgaagataaagtccattctccttactacagcattcaaatttctccacaacatgccttcactatttcttcccattctgacttccgccagggagaatgttaaaaacattgtggggaaataaataaatgatgggcataattttaccagattctgcagaaatgacaaaagaaatgcacacagggatgtcgagatttgtaaaaactataggagtacctgatccggtgaaataagatcactcacagctccccaaactcagcatatacaagccaccactgtttcttgactcattctattccctacacagggaataccctcaccctcctgtttctgacctcctttctgttctgcaaggccctgatcaaatgctcccttcctctgtaaaccttcctcattcctcacttctctcactctaataacctttgcccatccttctattactagctttgtaccgtcaatcgaggaaaatgacgaggcaagtctcaatcattttaggaggtttacttgccaaagttaaggatgtgcctgggagataggtctatgcctttatctgaagatgattttgagggctccagatttaaaggggaaagggtggggatattgagaagtacacaattttcatctaagtgaatctgtgttttgtacataagatcacataaacaaagggggcagaggaaaaatgcggggaatctgcattttacgtatgataacagacaaaatggggtagggcgacactcagatatgcatttgtgtctggtgggccagggtgactgcacctataaagataagctgtccatttgcattgccatggtgaagttttaacagctctctaggaatgtccttgtggacaaaatatgggggaggcttgtgtagcttttcaccttgtagccatcttatttaggaactaaaaggggaaggctttgagtgacccagttcccggcttgacttttccgtttgtctaaatgcgttcggggtaccaaaatttaatttcctttcaataaagttattgttgaacatagctatcttccctcccaataaatggcaattcacttgagggcaggaatgattttgaatctttgaagcttcagcatccagaacagtgctgatgctccagaaatattctttaagtttcctattattgagtaaatcaaactcaattccccttagtttacctttttcatttgaaccgtttgaacacacaaagccttcactccttttgctttgctagacgtactaggttaaatgctaaaacaggtgctcaacaaaatgaattctaagttcctttgcatttccatcagataatttatctctgtttcatcacctgtagagcaagattggctgtgattttttaatgagacatgttaaaattcctgaatgccaagacctacacaagggccatgttattttcaggagcagtcgtgaatggttgttcagttatttagatttcaaggcatgtttaatttgttcctaccaagatcactgagagattctgtcacttgcggtttaatattttcactggtacttttatcattttcccaaagcctaaggaagtttacttgcaacaagatttggggtttcctgtaaatatttgttttagtccataaagggttatttttcttatagagaagtgtgcttttatatatcttgcagctgaaagttaaaagttttttgtgtgtgttacattttgtaacaaacatggaagggtatgtaaattgtaaaatcatggagtcaaggaaacgtaggaaattatttagttcatcccactgttttctgagggaactgaatccaaaacagtgctgggaaataaataaataaataaataaataaataaataaataaataaataattggcacaatttttaaagattctgcagaaatgacaaaggaaataaacataagaatattgagatttgtcaaaagtttaggaatgcctggcttattcaatgttatcaggaaatgtagcattataattatccaggatgctaaatttggttttatatatgtatgtgtgtgtgtgtgtgtgtgtgtgtgtgtgtgtgtgtgtgtgtatgtatttagtggaaactctttgccttcattaaagcagatattacaacacatttaaaacattttcaaattgctaggagctgtccttatgaacatagttttttaatcatgctgtaaaacagtgatacctcaggggataagactcccatccaaaaatgggtccagttattatgtgatgtcttccatcacataatattgatgcttttaaatctcttctaatacctattaatgcatctgcctgtcatggtcccgctccctgttctgctgtagccaagagtaacaggacacccatttgttagaattacgttcaaagtaaaaatcaacaatctggtgagagaggccttctctcctacaaagtaatgggcacttacattttgtgactattggtttgtaggccaaagtgttaaatatagtgaacttccagtttctcttcaaagaatcagtatgtcagtatgttcagctttcttattttttaattcttgatttcaaagtttaacttcctggttctctctgcccacttgcttctagtttcagtaaacaactttcccaccagtcctattcagtaggttcacatctgttcccctggtcacctgctctgtcctgtctcatcctggtcacgtgctttgacctgaatcacccctggtcacctgctctgacctaagtcacctttggttacctgtttctaaccatccttcccgccaaactactcaccctgccactctggctcatatccctgccctctttaaaatagccagtcggaactggcttagactgtgcggtccaaccctagccaatagggaacaacacagcagtaggggccgcctgcatcaggaataagaactcctgcccctcccctgtccaggtgtgctctcgccattgttccatcttcgaggtgcaccctttctgcagaaagtaaattttgcctttctgagaaaattgcatttatgttccagtgctatttctttgtggcactgggaaacaagcattttgcatttctaacactgaccaattttgtctactttttggttcaaagaaaggtttcaaatgatctggaccctttatctggttatggataaaattgctactgctgtttatagattaaaaataaaaaagaatggcagagaaataggtcactgtgctttgcatgtattgggtactcttctatacaagatattgcagcactgcacgagcagtggtgattatggaggtggtcttgaccttctgtatatgtgtcttctctacaaatggccagcccacccacactcacactggttcaatacctggtggccacaagcctttcaaacctattgaacagcaatttgcattgctgtctgcgtttttccctctccttacctttgatctattgatccttgaaatgagccctgcctatgctgcttctcacattcctctcagcccatcaaaatcactttatagagacaggcctaacagtggcaagaggaatgagaaatggggaagaggtcctctgtcctctggaggcgaacttacccctggcatttttaatcagactagtgaggatccgtttccctatagaaacacagcttcgtttctccataccagcttcagacacaccttgggtttaaaaaggtggttgtaggctggtctgagagcccgactaccatgtgtcatgctgttgaaagtttcaaaagccaatttacaatgaaggtcttggaaacaacctcttcataaatgtagtgctgcctggatctatttccaagcctaattgaatttttaagaggagtccttagaaaatctgtaaacctcattcatttccagtcattcattcagcaaatactcattgagggtttcgcattctagtgaatactgctgtactgactgagcattaagaacatcaaaaaggacaaagctcaggctctggcctcaagggttctgttgtcttctgacctcccacccagcttagcattatctacatcagtgttctcagttttcattttttttttcctgtgaccttctgaaataaatgcattttattttgtaaccccagtacctatatacaatatatatatataaatatatatatatatatttgaagcaaatatttcacaaaacggtgctcacacttgctgtgtacaaagtcatctgatattttctatacgattctatttcattttaaaacgctggtcatccactaaatagatttcagaagctgcagatgggtcacaaaccgaagtttgaaaaccactgaacatatcacatgaccttggtatctctggtccctgccttcagggcagcttaggaagctatgttggctggtgacaacccaggctgccagctacaagggtcagcatggaggttttttgttttgttttgttttttgttttttttaatctaactaattttgttttttcaagggaaggtctctggtcactcagtctggagtgcagtggcacaaccttggctcactgcagcctcaacctcctgggcttaagcgatcctcctgcctcagcctcccaagtagctggggctacagatgtgtgccaccatgccctgataagtttttgtatttttttgtagagatggggtctcgctgtattgcccatgctggtctcaaactcctgggctcaagcagtcctcccacctcggcctcccaaaagtgataagcctccactatctcggctcactgcaacctctgcctcccaggttcaagcaattattctgcctcatcctcccgagaagctgggattacaggcgcccgccaccatgcctggctagcctgggggtttaagaaaagtttttttggatgggagtcagagggtctggattctggtctaactccttcagtaatcagtactgtgatctgcagcaagtcgcttcaacttgctgcgacacagctatgaagtggagatgctgatgcctgttctgtgtaattcacagggtgagcaagaacatccagtataataatgtgcattaatgtgtgcagaaaaatattaagtacagagcaaatccaagttattattaaacagtcttacttttacaattaaaatttaatatcagaggaacaacttggagggaccatttgttctttgtagatctgggaaaggattcttgaacaaggctataatatgatgcaacttcataaatggaaatctcagggtaactttttttgtgatattttaagtagatttgaattgaagaaactcagccaagttatcctggtccctcttcccttaaatacttttttttttggttttattttttatttttatttttttgagatggagcctcactctattgcccaggctggagtgcagtggcatggtctcggctcactgcaacctccacctcctgggttcaagcacttctccagcctcagcctcccgagtagctgggattgcaggcgtgatttttgtatttttgtagagatggagttttgccatgttggccaggctggtctcgaactcctgaactcaggtgatccgccaacctcagcctcccaaagtgccggcattataggcgtgagccactgcgcctggccatttttctggttttaaaatcaaggaagcaactaggtggttgttgggtttttaagtcatgaacctatttgtaaaggagcgtgctttgcctgatattatctactctaacccagtagatttataaacactaatttctactgttttaagaccactttttattaaaagcaactaacagtaaataaaaccaaccactaaaagagataattttatcaagaagggtttaaaacaataaacttttagatcaaatatagtactttcctcatttatctttcacttttccttttgtaactatcctagacctcatttcacacatctcacacagacattggttagaacaaatgcttctttctttttcttttttttttttttttgagatagagtttcactcttgttgaggctggagtgcaatggcacgatctcggctcactacaacctctgcctctcaggttcaagcgattctcctgcctcagcctcctgagtagctgggattacaggcgcccaccaccacacctggctaattttccatttttagtagagacggggtttcaccatgttggccacgctggtgttgaactcctgacctcaggtgatccgcccgcctggccctcacagagtgctgggatttcaggtatgagtcaccgcgcccagccagaatgcttcattcaaggcctgctgaattcctattcggagcctaacccaccctagagctgtgccttacaggctagctctgcctgctgcattagctccctgtgtctttccatgtctgtttattgatctttcttttttgtttttgtttttgttttgagacagggtcttgctctgtctcccaggctagagtgcagtggcactatctcagctcactgcagcctcaacctcctgggctcaagcaatcttcccacctcagcttcctgagtagctaggactacagatgcttgccaccactcctagttaatttaaaaatttttttttgtagagacgaggtctcactatgctgcccaggctgctctcaaactcctggactcaagagatcctcctgcctcgggatcccaaagtgtagagattacagacatgagtcaccacacccagtctgtttgctgatctgttttaaaggaatgtctacattcaccttttctaggagtcagttctccaaatcactctacctttcactttgtaagtaacggtggggaagaataaaataacaataaaataaaataaaaacaaaactatattcactccaaagagaagaaaataattcccttttgtcctttaaagagtgaaaatattcattacacaaatcagcaatgtccaccaaaggccactgctcatcagcacttagtgtagtttccagagaaaacatctaaaatgcataaaagttaagcagtttttgtatacctagcttttagctgatttcatgactgctgtatagcttctttgtagatagtttctgcagctgtttcatgaatgttatggtatgcctgcgaattgaattgaaaaagactgagttcacacggcttttgaatcagtaagctgaagcccagaggggttaggtacattggactggaagcagaagggatggttttaaagagcagctggttgttcatcttcactaactggcaggcagcctttctggggtgtagctgcgctgcaggttgcacaaaagagtctcaacgcccctcctgctacccaggcctagccctcgcagcactaaatgggtacattcttgacaaataagaaactggggcccgatatgctgattcccacatctgtatttagatcccactcatgacacagtgtatgaccacaagcaggtcacttaatttcactggcctaagtttctccatctgttaaagacatctgttgtctgtcttataggtgaaaatgaaaggaactagctatgcaaagtatataaaccacagtgggtgcctgatcagtgtgacatttccatcttttccctttccctctgaacattcccctccccaaagacccccgaagagaaatggcatgatatcttctgccaacaaactgatagacgccagggtgaaatcagcggaattcaacttgtgattggcatgcatttattaaaacatccttctgctttcaggaaaatcagagctctttatttcagatggagttatctcgttggcttactatttaaaataagaatttgtaccactatacgttggctaactctgatgttaaaggaaacttgctgaaaactgatttttgttttggcaaaatatagaattactacttttcctggtgggcctaagccagattcagtgccaagagggaggtagggagaagtagggttttttttttttttgccagcagatgccatcaatcttgaagtattctggacaagtgaggagagcataaattaagactattgacgtcaaaatccagataaacttgaatccaaatcctagtctcatcattttatcaactatgtgcccttgagcgaattactgaatctctctgagtttctcagctgattgatctacaaaaagaggaatatacatgtaaagtggctagcacagtgcctggtgcttactcagtgctcaaggggtgggaatgggggaacgtaggtgtttcacaataattattgccatgaactgggtatgtaggagatgaatctgggggagcttctgggtaatcacaaaagcatgagtgactgtgatgagttgtattagcttctgagggctgctttgcttgtaaagtacaaagtactatgagccgggtgtcttagaacaacagacacttattgtctcacagttgtggaggctagaagtctagaatcagggtgtcagcagggccatgctccctctgaaacctgtaggggaggatccttccttgcctcctgtagcttctggtagccccagatattccttggcttaggccatcgtaactccagtgcttccataatttcatacggcattctccctatgtctcttcacagaggcttccctctgtgtgtgtctgtgtttgtgtccaaagggcaccagccacactggattagggctcatcctaatgacctcatcttgattacatctgcaaatattctgtttccaaatcaggtcacatcctgaggtactgggggttaagactttaacatatatttggaggtggagtatacaatttgacccatcatctgagtatacatacttctagattaaatgcaacgagcctgggcattacctccacattctaaaattgggcacaatctccacacattgggcacatttcttgcaacctagagaggcctattgtgaaaaatgatattgtgatattggttagctttctaagtgaatattttctcgtcacaaaagagcaaaagttccctagactcaagcgtaggcagggactttctttttaaccccactgagtgaaaggcaaccaggaagtgtgtgcatgtccattcaccccaaaggaaacagccttgcatcatagacagagccatcccaggtctacataagttcataccatggagaatatttttcctacttgctttccctttcctgtatatatgttcaaatgtctgacattaatgaaacattcagtgtgatccagggaagtatcatgagtctgtttttcctgaatctgaaggttttggggctgggagggagatcatgtaaaccaccccctactcccaggaaatggagtggctctgtgatccagctacccctgggagcctaggaaggcttaggtttcatgagcccacctcggagctacagggaaatctccatccaagatccccagataccagaggacaaaaggaacacagcaaagggaaaaactgaacatccaagagaataaatttacaacctacaacagaaggcatctgaaaaagtcaggtggactgccgcttcagtgtaatgaaccactcacctgaataaacagtacaaggtgctggaaattgtggaaacatgattattaacaaagtagaatccttcaatccttaaactgactactgtattactttcctagggctaccttaacaaagtatcatgtactctgtggcttaaaataacaggttgtccttcaataggtgaatggataaatgacttcagtggatgagtggataaataaactgtggtgcacccagacaatagaatattactcagaaccaaaaacaaatgagctcttaagccatgaaaagacatgcaggaaacgtaagtgcatattactaagtgaaagaagccagtctgaaaaggctgcatactgtaggattccaactatgtgacattctgaaataggcaacactatggagacagtaaaaagatgagtggtttctaggcactagggcaagaagagagggatgaataggcagagcacaggggatttttagggcagtgaaaatagttggtatgacactacatttgtccaagcccattgaatgtacaatggcaagagtgaaccctaatgtaaactatggactttgggtgatactgatgtgtcactgcaggttcatcagttgtaacaaatgtactacacttgtgagggatgtttataatgggagaggttatgtgtgtgtgagacggaatatatgggacatttctgtatcttcctctcaattttgccatgaatgtaaaactcctctacaaaaataaaatctttaaaaataaataaatcacaagcagggttggttccttctgagaaccgtgaggaagaatctgttccatgcctctgtcctcacttctggtggtttggcagcaagctttggcatttcttggcttgtagatgcgtcactccaatctctgccttcacatggccaagattgtctccctgtgtctcttcttagcgtctgccctctgtgcaggtctgtctgtgtctgaagccaaatgtccccttttgataaggacatcagtcatattggattagaacccaccctgataacttcatcttcactcagttagctcggtcaagtccctgtttccaaataaggccacattctagggtactgggagttaggtcgtccacatatcattttttggaggacacaactgaacacatgacaaatactgaaagatttaaaaattgtaatgtgcagtttcataatttaatccataagcaataagtgggataggctaggcatggggcctcacacctgtaatcctagcactttgggagtctgaggcaggcggatcacctgagatcaggagtttgagaccagcctggtcaacatggcgaaaccccgtctctactaaaaatacaaaaattaaccagatgtggtggtgcatgcctgtaatcccagctactcgggaggctgaggcaagagaatcactttaacccaggaggcagaggttgcagtgagccaagatcatgtcatcgcactccagcctggggtacagagcaagacaccgtctcaaaataagtaaataaataaataaataaataaaagcaataagtgggataattattgaatacatttaaaatgccagctggccatgcatggtggctcacacctgtaatcccaacactttgagaggtcgaggtgggaggattgcttgatcccaggagtttgagactagcctgggcaacatggtgaaatctcgtctctacgaaaactaaaaaaattagctgggcatggtggcacacacctgcagtcccagctactcaagaggctgcggtgggaggattgcttgagctgggaggtcgttgttctcaccactgcactctggcctgggtgacacagtgagatggtgtcttaaaataaaaataataaaaatcaataaatgaaatgccagctggctgaagtttgttggggcagggaggacagctgggtccttccctcacaggtaaaaaacctgtataaaaccattgggtctagggagcttttgcctctttgtgatcaggaagtattcgcttcttagaaagctaactaatctccctgcatcgagctctgatccatcaattctccgtgaagtctgggtattaaaccagccccaaagaagaacagaaaaggggattatcctcttccactaggacacatgccttttctggcatgggaagataaagctctctgatgataaatttccaagtacattttaatgagaaatgacatggattaagaaagagatagagaaaataagagatgaaaggcattctatttgttggacatttttagccacagttctccttgtacacccctcaaaaaagaaagagaaaagtaatcaacagggaggaacaagggaacacaaagaggagataagaattttcttctacatgtattctgcgtttctcagccttctgtggtgttactatcatcaatgaaaaggcatttaagatccttaagttagaaaaatcttttctgcccaattccccacttcttgtttggaaacaagaacatgctctgcaagacctgtaagcacagatttaatttccatcatgatgatgatgataaaattttaaaaatggtgaacattcatatagtactaactatatgccaagcactgttctaagtaccgtgcaactattagttcatttaatccttacaactccactatgacttccgtggttagctaataatgtgttacctccatttgcagatgaggaaaatgaggccagaggggttcactcacttgcccacttcctccctgcttggacgtgtgtaagactggtgcctggtttttggctccaggctggctcctggtggctcccctgctctctccagcttagcatttatgaaagttattccctgtgttttcagagttctaaccgctagtctttgagtgggtgaatctggcagcagctgtgttattacatcagatcctgcttgatgagcaaacttctcctcctggaggagcagggctggagggctggagaggaaggatctagcaagagactttgagttctataactctttcccttaaatatctagcccaggggtctaaatactgctttacaggccctaaaaagaagtcatgagtgtacctctttccccagcaggagacatggacttccgtataactagccaatcctctaactccattgttattaatctcacatgactttgtatgccaattcaaggaaaagaaactcggcataattttggacctctctatatcttttttttttttttttttttttgagacagagttttgctcttgtctcccattctggagtgcagtggtgcgatcttggctcactgcaacctccttttcctgggttcaagtgattctcctgcctcaacctcccaagtagctgggattacaggcacccaccaccatgcctggctaatttttgtattgttagtagagacagggtttcacaatgttggccaggctggtctctaactcctgacctcaggtgatccacccacctgagactcccaaagtgctgggattacaggcatgagccaccatgcctggccggacttctctatatcttaagttctaacccctgtcctgtcaaagccagagaactgagacctggaaagaaatgaatgggctttgctgtcgtgtaaagagcccccactttggggttggctgggtgatggctaaaatgctgtgtgtataatcctgggcaagtgatttgacttctctgtgccaggtttgcacatctagattgtaaaatagagcaatcatgtctattcaatgttgttctaaggatgagatgagatgcatctgcctggcaccttgtaagtcctgcacaaatgcaaattatcactgttaagtaagcttcaccatcctgtaaaacaatctgtttgactcacttattccaagtaagattggctggacctgtacattcttctttatttaaaactatcaatgttactgttcatttttaaatagacagtggctatgatttttagtttttttagccttacaaatgagaaacctagaacttcaacaagcagtaaaattgagcaggttaggtattcctcactagcagcataaacccagcagggtgaggtgattcctagggcctcctatagtctcctagcagccctgataccctttgtttacgggtccctgggggaagttgaggacttaaagtctctctagtaggcttcagagctccttatttgagcagaactgtgacatcttggagaaagaagagaacaccaccagtcagaaaagcccacaattgtagtggtgtcccggttctgaatacaagttacctaacgcctctgagccaatttcctcaactatgaaatagaaataatagtgcccgtctcacagatactataactacgaagatcaaattagatcgcatatacatgatgaaagtgttctgtaaaaagttgccatctgtctttgcttggatggacctgagttcctgagttggctctgaaaacagcttaccacgaaacaggataggattagtgggacagccttgctgacacagatcataacagggagatgtctcattttgacttggaagttgcactgatatcatagaaaataaaaaaaccaggtttaactgttggttggtaccttgtgagaagaggaagaaggtgataagaactaagatcagagcatagtagagaaagtagccctgtaaacagaggagaagcagaaagagagaagggaggacagagcttttattttgctccaggttaaaaagaaaaaaaaaaagcacattacaactctatgttcaggtgtctgtcccaggtcctagaactggaatagaccaaccaagcccaacccttcttaaaagtaagactaggtgcttcctgattatatattcaactgcctggaagcatgcaagtaaaatttccttgatggcatttctaagtttcaaacatattcttcctaaaaatgcatttacaaaaaatattaggattgtgtttttttggtttggactttaaaaaaaaattgttttcaaaaccataattgtggcctaccccaaatggattctcctccctacagtgaggatttcatttttccagtcccccaccgccttttcatttttgatgaactgcacatgttgtgggagccactggtgggccctcagacacgagcaatccttctggccactgccagtgtcctaataagggaatgaacaagcgcctattggtgagggaaggggagtcaggcggtggatgatatttttgctgattaaagaggataaggtgtggtttggcaggtatctcattggtttggctggctccagacctaggttttttctcttttttcagtttgaattctgtagaacagactgctaagaattgttttttcacagatctctaactgagctttaggaatatcatgctgacacagtttatctatgttgaaaaaagataggaatttggggttacatgatgttttcattaaaagaggttgaggatataggttaaaatcttctcggtcaccaggcgatgaaggtgatactggacttgatcaaatttagtcatggagagaacaagggatataccattggatatatttaacacatgtttaaaaagttttaaacatttatctatgcaacaatattaagtaacacctacttttgcttgtaaatatttatattctccaattttaaaataataaaagaaacaaaaagagcctggcacttaggatcatagtgatgagttgctcatctatttcctgtctgatcactaaatacctgccagtgactcctctctccactctattttctgaatgactcgacactgccttttaacttaactgcatctggtccacagtgttcttaagtcactcattatacgtcagtgtttctcacatgagctgcaggctggaatcatttggggagctttcaaaagttctaatgtctagatcagacctcgagcaggattctggtttaattgatttggggcatggcctgggcatcaggattcttaggcacttctccaggcaattctaatgtgcagctgaggttgaggacctcgagaagcaactgctactctgaaatgcatcctctattggatcatctggcccggtaaagggccaggcagtttttcttcctgacattttgaaacctctcaagaaaatactatatatatatatatatgaaacaagttagacaggtttcctcccaagttggtagattcagttcggttgtttaaaactcaacagtagagaattgtgctttcaaccaaaatcaacttctagacacatgggtattgtttaaactttattttccatgcatataaggagtgaagtactctgccaggtagttgaaaacagtatccatttcaaagtcataagtaatgagatgagattttttatattttctctgtgtccctgcaagttattcatcccttgatatttaatttagttaatacatgcctcttattttactttttcttataatattaagccaacttcacatcctggaattgtgaaattgctgtagcaaggataggatgatatgatcgagaagtttaaaaaaaattttcagattatcaatttttaaaagtaagaggatatggaagtgcagtgcctgcatggagagaagttttgaattttgaaagaattttggattaatcaggtgtctagaattactcattactctcagcttccttactggatatttcattaccaaggaagaaggccatttagaaattcaggagtgcaaaggctgggcgtggtggctcacgcctgtaatcctagcattttgggaggccaaggtggatggatcacctgaggtcaggagttcgagaccagcctggccaacacagtgaaaccctgtctctactaaaaatacaaaaattagctgggcatggtggcaggcacctgtaatcccacctacttgggaggctgaggcaggagaattgcctgaaccggtgaggtggaaattgcagtgagccaagatcacgccattgcactccagcctgggagcctgggtgacaagagcaaaacgcagtctcaaaaaaaaaggaacttcgtttggaagtgcagactgagctgggaatataaattagagaatcctcaccttaaaactgacagacaagttataaacatagatgatattatccaaggagcatatgttggataggagaagaaaggagttgaggaagaaacccaataaaaggtacaaaagaaactacaaaataaatttaaaaacagagaatctcaaaaagggagatgtggtcaacagtgtcagagctctctgtgggatcaagtaagattgagagcacaaagggacattggacaatttgtctcaaaggacagcttagaaagcacaagcccataacacaatgtcattttggagttagggctactaatacctggatcaaaaatattgaatatagtcaatatagtgttccgatatatttaataatgaaactgaactgttcttttgatattttgatcaactggtcaagtgattaagatgtctggaactaaaaatcactagccccgtagagatccatctcaagatgattttaggtcaactaccaagtaggttaaactaactgataaacctaactccaaaattgaatgtaaactgacaagacagcccgtgatagggtggatttaactattttgggctattaatgacttatccattgaatttcagaaccagttttggctacagcacatgaaaatatttccaaaggactgctaaatcaaacatgctcagtttacctagttgtactgagttctttttgcttcccacagacattgcaaaaggccaaaactaacactaggcttgatagtgaaaagagaaagaatataagaaatttgcaagggaagatggtgcaggaggagttatggaggtaaaaaggcatgtgctggagttgcaggaaaatatagaactgctctattcatgagccaagccaaggccaatcacatgacaataaaaaagactgatggcacatgcacacacgtacacacacacacacacacgctcttgaagcaggccaaagtccacagtctcactggaaaacaccagttgactccgtttgactttagcacctgatcattgactaggttcaaaagtcaaatacttttcctgtccataatcacttggtcttcttagtaagtaaaatatccattttccagctctgaactcaaggggattttctgcatatagttgcaacataatgccatctccagagaaagtaacatgggaatgagaagcaaagaaatgcattaaaacatttgcattctggaccaatgagcaaaatgcaccaagaacctacctaagcaaacactggcaagaaagtttgtggctagtaattgcttctgactattggcaggaaggaattgaaagaagtgcaaagtgttgggggttccatctcctgtatttttttctaaaaattcttctgtctccaagcctagcttttagtaggctgccgccgccactcctcggttggtttaatatggttttgtcatgatgatgaaactgaaacctgagaggtcatttcctttttcttttttttttttttttttttggtgaatgatcaggcttcaccttctggaactgatggtcagaaagcgagccctgcagcccatagcaacatggcagcaggtgtagccaggtattcctggttcatatccatgagccagtatgaagtgtctgcttttaaagccactcacaaaacttccaacagagtgtatgtgtgctctgtgtgtgtgcacatgctttggttttggggatgaccttctcccgcctctgttactgagagaagataaagctgtaataactttaaacaccatttttgcagtaaatactcataagcctagcatagaattgtcagcctttccctacacatggactggagtcatatttcattgatctgccttttaaggaagcactgttgttctgtatatgacactaaaacttttaagtcttggagtatttggcctttccatgttctgatttagatgaatccacatgagcttaggcagttcacctcttattcaggtataggttagcctcatgatggctattgctttgtgttttaatgccatatgcctttcttgactgcagttaactaaaaatacttattaaatccctgctttatgcaaggcactttgagaagggtgctaaaaatgtataaaacttgacttgctttcaagaaacacatgccataatatgagagataatacacaaataacagcaatagagcaatatgtgataaataactggaacaaccacagagatttcagaggcattaaagagctccttctagttgacttccatgatggaagaatgtagcatttgagctgacattgatggacagataagcggggtctcggtaaaaatggagagaaggaaagaaccacttaagtgtaatcaaagagagcaagagagtataaaatgaagttgaaagaaaaagaaagaaagctttactgatgttcgttatgctttctggcacgagcacctcccctcaatttccgaccccatgtgactggtcctgagagcatcacacaaaaatagtgccctggaaaaatggaacatgagtcccctgcacccccagaggggagaacagtggggccttcgcttggccctgtcttttcagcattctgtgactcaaggcagtttacttgactgggtaaatggatttaccagtggtaaaccttatctagtttaaacttcatgaaatagacctgtactgagaaggatttctgcagaagcttcaagcagaggtaacactaataatgcaaacccaaggcaacgctgacacttacacacggagaggacactaatgcttgtgaacgcagaccagtgcgtcctcagctcacactttacctgttcctttcagcaaggtgagtttacagcagagagggggaatctcactgcttttcagaagtaactcatgagagaacagatcttttggaaaatggcagcatttttttgtgattttgctggtgaaaaagatgtaaacatgtaacctatcaagactatcatatcttcatactccaccttggaaacattttctaatgtatttaaaaatctccccagtgaagaatttcagtaggttttgaaactatttatttaaaatgtaaaattgaaacaccttgggattactttgaactggaacaactgattgacatcaggacagacaatttttgatacaattttctaggcaaattgtatcaaaaaattgtgcatggttagtggggcagatttaagatattagtactgtgcttccacctgtcaagccaattatgtgtttctttgtatatctttggggattaaaaaaattaagcggggctgagcgtggtggctcacatctgtaatcccagcactttgggaggctgaggcgggtggatcacctgaggttgggagttcaagaccagcctgaccaacatggagaaaccccgtctctactaaaaaaatacaaaattagctgggtgtggtggcacatgcctgtaatcccagctacttgggaggctaaggcaggagaattgcttgaaccagggacgtggaggttgcagtgagccgagattatgccattgcactccagcctaggcaacaagagtgaatctccatctcaaaaaagaaaaaaaaaattaggctatgactgtcatttaaaactaaatgcctaaataaactgaacttagaaccagaccttcacattatcgattacaatgcattcagccaagatgtttcaaaaataattaaagttttatgaacattaatagattaaatttaacattactttaaatgtatctttgttttattgtcattctgtccttttaaatttctgttcattgtgttttgtaatgtctacaaacatttaaataacactacatgtaatttataaatgactatacatatacgtataaatgtatatgcatacataaatgtatatatcagtgttattggtgcatgcttaatttttaaaattgattgtagtatagtatgaaaagtcatttagaaaccattggcttagatcatggatcaccaaacttttttgtaaatggtcagatagtatatattttcaaatttgtgagccatacagtttctgtcataataattgagctctggcactgaagtgcaaaacagccatagatgatagaggtgtggttgtattcctataaaactttatttgcaaaaacagagtgggctggctttggcctgcaggtcatagtttgccaatccctggctcagatgactgaagctctttgttagtctccagggcaccctaagaaagcttcctattgtagaaagaaaacaggtataggaacttgaagacctgggtcaatcctgattttgtaattacttttatgagtcatttcacctcttagatcccaggttaccaagtataaaatataaagcttgaattcgaaataatgtcaaaattccttctagtttcattaatctatcatcttagatgctcactaccttgccacaagcagtggatttcagctgggctctgaatggaagcagaataagtgaaaatccaatttaatacgaggtgggcaaagtgagttcaaaacagtggagaaggtgacaagaataaaaaaggacagaaattccattctgaaaaatgtaaagtcacagcttatggctcttgaggggtcctccatggtgctgctgttctaaatgattgtaggacttgctcaactgaagtctcctcttgcagctaagatggatgggatccttgatatggggtagctggccctaatttcttttatttcttggggaaagctgcagagtgaaatgaaacacctggagtggagattgaaactagaaaatgtgtgctgcccttccgggactcccttccacagggccatagcctttggaaagagccttatacttcgttaaatgattggtctgctcttctcagttcttcgaagccatctttctgtatgtaccaagcacgattggcgcctcactaatgcccttcatgccttccaagccctagccagatggaattgtgtgcttttccataaccatatttcccgattctgcaaccttgctatttgagctttctgtacatggaaaggtcctctttcattcccccagctcccaatgctagccatcccaaaagagccagcttgaataccactttctttatgaagcctcctctgatcccttagctggaattgccttcttcctcctctaaactttaaatcactttaagtcttctgtaatatttaccacattctacctattatcacatccttaacaggtcttaacttccctacagattatgaactcctttcaggggttgaatttatcttggtttctgccctcactggcttgaatggagtaaatgttcaataaatatctgttgaatggatgtgctaattccagccacctgtgtgtccatttccaggttatagcagcaagcattacctaccagcatcccacaaccgcaagttcagactccaccttggtatctggcagatggttctgaacaatggtttgccacctcctcctcagaacctaggcccccatgcctcctcctcggaacctaggccttcatgcagcccccttgctgcccagagctcaccactctgatgacagttctgaattgaactgtccttgcctccaagtctaggttccacgtggatcagtcagggagaggaatgtataccagattagcaacccataagtcagtgccagtgctgtcactttgtaattcagaaatatgaactttttttttaagtcaagtcagtgatcttcaccactgaagcagttcctcctgtattaggtaacaagtttaaggaattaatgattacattggtgatctagtcagaagacagcataagccttattggttagtaaactaatctaaccaatgaattaggatggaattgccttgttgggatagaaatctgttccaggagagacaggaaccctcaagtcatttaagtgctgtagaatgtctctaatgctcatgctccctctctcagagtcctgattccctgagtcttaagctgttggtgattctaactcaatttgcacacacaaatgtgggtgcttagttatttaatattattctatctgttaaaacattcacatttttataggggtcttctattaactcaaagggagtctttaagcatagaagattctacttggtttggtttggtcaggctggctttttaccaaatcacaacaaatgggtgtttgcttttctccctccacattgagcaggccctgtgttaagcaaggtttccactgatttaggaagatgatctatcaagagcagagaagactccttgacttcttttctcaacagtagggagatgggacccatgagcagtggttgactgccaagtcccctgcaagaataaatattctcttcaatgggcaaagcatccatgatttggcccttcatttcccatttcctgtctccactcaaggtttgtctttttactttctgccacttgtacacaaagctctccaatgctagcacatggagtgggggtatgagccaactggatgttagataggtgtgtgcaggacctctggagtcaggcaggtagggttcaccccattcttgttagaatggcagtgacttcttccctagcagagctagcaacaatgccccagtgtcagatctatcatatattacagtttcctgtctgaagaagagatgaggggtacaagagggaggaacaagatgggaggcaatgccactcgagtggaaaggagccctgggaaggaggaaatgaatagtaaatctttttccaattaagaaaaatgagagtggaagcagaaaagctccagagggcacttttaggggagggaaagatcataaaaggcctgttatgaaaatctattacccataaatttccccacattaagcagagcctgtctagagaggatgctgagaattcactcagctgacacaagatatgtgacttgatttagtggcatccacatgctgtgtaccgtttccattggcatgtctgcaataccactttcccttgcagggatcccctttaattactcgcaggcttataatctccatttaaggacatcttgctttcattttccaatcgctttatgtcttttgtcagatgtttaccgatgtgatagtggtaccataatttgaagctcaaccacatgagattatggactttagtattgcatcacatgaacatttcagatttagggatgagtcgaacttctagatcactctaaatataagacttatctaaaaggagttcatattttttacatttgaagacgacagtggaaatttctctttctaggtgattgtcttcagatacgaaaataatgtgcttgtttatatacctgtggtcaaatgtcattgcatccaacttagccagtagaaatgtgagaatatccctacatcctgctctggagcaggtgtgattcagttgcatatccagatctagacctctatgcaagagaaagagctggaaaaatatagtgctgccagccatcgacacctgggtctgaactgtttcctaatgttttactttttttaaacgactaagcccaaggtttattgtccacatctacgatgcacattaaagcaaaattgtcctttaatagataatagcagtcaaagaacagctccaactcagattttacttttgattgacaacattttttaaaagcctaagttcactgaggatcatatttatttaaaaaaaatttttatttttttgagacggagttttgttcttgttgcccaggccggagtgcaatggcgtggtctcagcttactacaacctccatttcctgggttcaagagattctcctgcctcagccacttgagtacctgggattacaggtgcgcaccaccacgcccagctaactttttgtatttttagtagagaaggagtttcaccatgttggccaggctggtctcgaactcctgacctcagatgatccacccaccttggcatcccaaagtgctgggattacaggcatgagccagcacaccaggcctatttaaaattcttactcattatttaagactgttataaacaaagaattctaggttggggatgaagaaaaggtaaagttcatgaaaacccaggtagtaactgggcttatcttttttagccacatttataccagttgaatcttaaataatgatggaaagagaggaaggagtttggttattttattttaattatcttcctggccacttaagcattcataactccttttcattcatttcagctaaagtttaattcaagtaactaagtcaggagcaatagatatcttctccaccatcaaccctgtctttccttacatattctttgtaaacatttataaattaaaaagtgaatgtttgtatctgagcaagcttattgatttaatagggtggggtagatggggtggtgcaaattctgtccctgtttgtggcaagatgaatagattttagtttatcttaggaaactgtcatggacttatccttccaaaatccatatttactggggttggcagatgcactatttcttttaaaaataaatgtgagaaaaatagcaactcaataaacgataaatccagtttctattcattttatttgtactgaatatcacaaaccatttctggatgttttaaaagaaaatggcaccaattgaaaaagaagttaaacatctatcccatacaaattataatctcaagaaatgtttggaaaagcttgtgcctcatctgttgttataaactacagctattgatataaacatagatgaatctcaaaaacatcatgtcaaataaaagaatcacagaatgcatgcagtattgttatgcatagtttatttaaggcaacactgaaaaatatgctgtttagggatgcataccatgctggtaatactacaaagaaaagcaagagaataattcagagatcttaaaattcaggctggtgcttatttggaggcatataaaaagagatagggatgcgattgaagaggagcacataaggatccctaacaactggtgctgtttacattgggtagtaggcacatggttgtgtgtctgattgttctttaaagtagtcatgtacatggctaggcgtagtggctcacgcctgtaacccagaactttgggaggccaaggcaggcagattgcttgagctcaggagtttgagaccagcctgggcaacatggggagaccctgtctctgcaaaaaatacaaaaattagccagatgtggtggtgcacacctgtagtcccagctactcagggggctgaggtgggtggatcacatgaatgaacccaggaggtcgaggctgcagtgagccaagattgtatgagtgcacaccagctgggttacagaggagaacttgtctcaataagtaaataaattaataatagtaataaaacaaagtagtcatgtaccatacattcatttgtaggtacaatataagtcatgataaaagtctttttagcttgaaataataaacccaaacaattagaatccatcattttaaaatgtcctgtgaatatgtgcatggattcagaaatgagcctgtacgcttggggatccgcctgccctggagcaggatcattctaaaaactgtccttttataactcagagtcagaatcagaactctcagtactccctgggtgccttctaaccatacaggacccaccagacctgatctatttgttggacaggatgttccagtcataatgatgctaagaaccagactgctatggtatgtgtagacacaagaagaggattttatgtcaccatgtactctgttctgcagcatatttcccctgttagggtctgtaattatagaaactcatccaattatgggatgtcaccattgtataaagcaaatgttgggctggtggtgacaacttgtgagtacatacataagaacactaaagcttccaagtacacagtgttttattattgagagcccaagtatggttggtatgcaaactttagtgactctcaaatatgtctatgtatggggagatggggtgggagaatggggaataaatgaagtgggaaatgctttgcttccttagtaactttcttccaagtaatatatccccttgcatgctctcaccccaggaaaaggcacaacactgatacagcaatgaaccccacaatgaaataatacagcacttttccatgaaaattttttttcttctaaaccaagagggctttctttcactctatcctgtattaataacagaccaattcactacagactacttactaataaatgtctaaacatattctgatatgaaaaatatttttattttcttgattttttttcctccataatttttaatgcttgccttttaaggaatccaaggaaaaaaattcagagttggattttatgtgaattaaatgaaaccacaacattttgcagacaccacatataaacaaaatcatatttaagagcctggaatgtttctataaacttcttttaactttcaaacatacagtaaatctgcaaggcaaatatgactcatttcagtagctcaggattttccctcctgatcacagtatggtctgagattttgctaagaatgtttgagcaatttatagagctatttggatatgtttggagaatgtgcttgtatttcatgctatgaaataaaatccctgggggttttggtacatgaaaaagaataatgaaagtatgtgtgagtcattttgcctccaaatagttgataagcatgtttccaacctacatgaggtttttaactttttaagttggatcccaaattaagacccaggttcagacaatgccattagcagaaccaataatgatgggaatcaaataaaagtaattgactaagaagtcatccttttttgaggctgtgagccccaggcattcttctttggggtgtggccttcatggggagtgtattgctgcagaaagctggggacagaatagtgttctggattgagtatctcagttaccagcctgaaatctccatcgaccaacactgccttctctcaaatgacttcttatatgaaagtggacagacagtggaatgcagaaattttagagctgatcttggggaccggtcaactgtctactggccagtaagttactatgaattcaaaaatggtgaacttcaatagcattcattctgtcagatagtgagtttatttgatctgttggaattttaggtgcagagttctttttcaaaatataggaatgtgcagaaacaattaaggaaaacagacttggaaactttgatctgaatggagtcctctttaagtcttttataactgggcttcactacaataccttgagccttttgttttctctgaggctttttctcacttaacctgtgtgtctgcatctgtgtctgcatttgtgtgtgtgcttatcaagcacagggaatattgaagaacacaaaaaagtttgaaggtgacaattcaaagtctatccactggcaatcttgtaatctctttcaatacagcaattgttctctagcggtgaagattttgaaagagattcccaaattcatgtccacaccaagtattttctgtagtctgatgaacagttgtctcatgtatgaaagactgtttttcaaataagcttatatgcactggtttataatatacagattcctttttatgcactattgaatttatagatattttataaaacactttatcaacaaataacaaaagtataagcaattgtcatgagatcttaattttttcataatgttttaaaaggatcctcattcttaagatgttagaaaccattgcaatacaagatctagaagattacatcttttctctaatcttaccagttagcagtggctatcttagtgtgtgttgatccaacttggctatttgaaatgacaaagcatgggaatgtaaattaaaacaactgctgtggtccggcatggtggtttacgcctgtaatcccagcactttgggaggccgaggcgggcggatcacctgaggtcaggagttcgagaccagtctggccaacatggtgaaactctctctttactaaaaatacaaaaattaattgggcgtggtggcaggagcctgtaatcccagctactcgggaggctgagacacaagaattacttgaaccaggaggtggaggttgcagtgagccgagattgggccactgcactccagtgagattctgtctcaaaaaacaaaacaaaacaaaacaaaacaaaactgatcttttaaattttaaatttaagtgaacacatactatttcacttctcaatatctaccctaaagaaatacttgcatcgtgcaataggggaaaaaatgaaagaacccaaaatgtctttctatagaatggttaaactgtgctatcctattacataaatgatgaaaataaaggtatgccctagtgaactgattttggcaagtcctcaaacacattattaaattttttacatggcaaaataactatattatatatcccatgtatgtaaaaaatacagcattgcaagatgcaaatccaaacttgattaactatttggttatctaggtaattactcagagtaatactgtgattatcaacataaaataagtaaatatttgtactctctatagacttaaactgttctttttcattctctctgagtctttaatgctcctaaacatgtaataaaatcagcaccctccccataaaaatgtctattatttttccctgatttaatttttaaacatggcttcctcataagagatcttgtcttgttaataaaatactattgccacaattttacttgaacctttaaggatgatgtcctatagtctcaaaccagaagataccaaaatggagaaaagacaaaatgaagggaataagagcaacattctttaaactacggggaacacggagtaaaaaaatcaaacaagacgacctatactatagttgagatgaaaataagaattttgccagtgttgcagaagttttgagaaatatttgctagggaagctggggtcgggggacactggggcaagaggaaaactcgttccttgctccagtgtcttgctacggaagcttctgcaagttcttctggctctcgtctggcatatatttagaccctggcccttccaaatgtaataacatctcattggtctcctcatttgccatgtctgcaagactttaattcatttgaactttctatctgaaaggcacaaactaaaacatggttatcttgttacttaaatacactgaggcagcaaggcctggtgttaaagacctaaaatatcttcagtgtaaaagccacagcattagaagagagctttcccattgcatatatgtttttttcttatcttgtaacaccagggcccttaagcaatggttccaggaatggaagaaaagccaatcctctctactttttcatgctactcgtacaatcaaataacatcatgtggttattatggacttttaaaattcgttgcatttattcgtcagtgtgaacacacacacacaagattatttctctttctccaaaatatccaatgagccatgttgctgtcagctgacctttgctgcagaaaggtacctttctccaagtgtttgtgccaacagatgagctaaaagcagttaccaagtaacaaagtggaatactccacaataaaccctcttccaaccagcataggtgggaagttcatggattctggtcaaacaaacattttatttcatagagaagtactttatagatcatttgtggattgccagtttttttaaaaaatagatccacaataaaatgcatttgatttaaactctattaaacaaaattcaataattctcagatgattcagataaacttcaggatcccacactccttctgaatcatctgggaacatcacttggctttgttctgtagcatatggcaaacaggttaatactggcatctgctgaattttcacagaaggaacaaatggattattatgcttttattacaatccagtggttggttaggtatgatttttactagtcagcagcatttcaaatacatttaaatctggcgtgtggaaaatcagaaatgtcaacattttgtctttcactgaagcatgaagcagaccctgtgctatcgtttgatataataaggatcctgtgtacttgtctttttggacaaattctgctttgtggtgaaattagctttcatgcattactggtattaaattgacaatttgtcgatgattatcaaaagcctttaaaatgagcatactcttaaactcggaaattaaactcagaaattctaacttctgagaagttttcctaagtaaataattgaacaagtgattaaagtgagtctgtaataatgtccttagcagcattgtttataagaagatataaagttgaaaacaatcttaaatgtgcctcagtagaaaattggttagtcataatagatccatgtaatcattatgtatgtgtatacctaagtggtaatactgtgttgctattgaaattatatattgctaacatgttaaaaatagtcataaacaaggtaaattaaagaaatggtttgtgaaatgatatgtatgacataaccctattttattaaaaacaaaaatgtctgtgcatgcacaggaaaatggtagaatatatcacatactcatcatgttcaaatctgggtttgcatgattctcgggagtggcttttactttctcctttatatattttgaattgtttggttttaaaaaaaatttatgtgtgcgttgcttttaaaatccaaaagaatgaacaattcagggtacttttttttcaatttcggaagaaaaaataataaacctgtggtgttagtaggatgggaagctcaccatgagggagaggcctaaaagctaagaaatgactgtttgctttgcttgcctaacgctaatgtagggagcctcagagttgaagaattttcacccctatcaagtcatttggcatggacacaattttacctataaagtcaactgatatgttcttgaaccagcaactggacatgttatgattgaaaatgccatgaaaccatttttgctctttttttgttcttaactttgtaaataattttaatatgtttctttattagtagtcataaaaagatccatagatattttgccccgtgatatcgttaggctttgtgtccctacccaaatctcatcttgaattgtactccccgtaatctccatgtgtcaagggagagaccaggtggaggtaactgaatcatgggtgcagtttcccccgtgctattctcatgacagtgagttctcacgagatctgatggttttataagggggggctcttcctccttcacttggcgcttcttcctgccacctagtgaagaaggtgccttgcttccccttcaccttctgccataattgtaagtttcctgaggcctcaccagccatgctgaactgtgaatcaattaaacctctttcctttataagttacccagtctcgggcagttctttatagcagtgtgaaacggactaatacactctagtagctgtgtatcctagaaaatgggctcccaatggagaatgattgcctataaactttaagctgtaccaagcaagaagaggtagaagagatagtggagatgatcggttgttcaggttgctccactgagaaatcaaagatgaagagaggttacatgtgatgtggcctacgtggcaaatctagttcatgtcagagctaacagccagcaatatccagccatgaagcccagtgggtaggtgaaaagagaaagatggtaagttctgaaaatagtgggaaattaaggacttaaggttatattccattaaggggacggaggagttttgcttttaggataggtgtataagttcgttcttgcactgccgtaaagaactgcccaagatgggtaatttataaagaaaagaggtttaactgactcactcatagctggggaggcctcaggaaacttacaatcatggaggaaggggaagcaggcaccttctttacaaagcagcagaagagagaagagtgagcgaaggaggaacttgccaaacacttataaaaaccttgagagaattcactcactgtcacgagcacagcatgagggaaccacccccatgatccagtcagctcccaccacattccttcctcaacacctgacacgggggattacaatgcaagatgagatttgggtggggacacaaagcctaaccctatcaatagggatgtcccatacggagttttatgcctcttgcttgtcttggaagaagaaggccccaagtaacagtcatgacctcatggctgatccagagatgtagaaaagcaaattgagacttcctgtttgattagtttaggaagcagttattaaggattgattctccctgttgcggttaaagctgtctaccaagaaataagccaaaggaacattaggccaagaatctgaagggtgaagccaaaccactgggaagggctttctacttcaactacaatgtgattgaattagaaaggaacattcgaatcctgtcatgtcacctcaaattcaacaagtctaaaattgaactcatttttcctcacgaagcggctccttaactgaactttcctaataacaggaagacactgcagtgtagaatgctttgccacaacatatctatctattatttcatttgattgtcacacacaagaaaatttaactctaaaatttaactttaaatttaactttaaaaggttaatcaaagggctgcaaattagtaagagaccaattctaaaacccaagttttctgaatcctaatctagtcatccattatcaactatatcacattgcccccccatatttgtgaaataaaccagcccattttatagaattactaagtgacattttatttgtattggcttttgaggattgcacatgagcagattttagtaaatatgaagtcagattttctcaagtagcaaagaagaaaccaaccaaccttcggaatcattaatcctgttttttatgagatacctcagtgaaaaaacattcatagcattcttattattgaagtcaaaagatgacacagatgaaataaagtactgactctaagcctaaaaatgcctaacttacaactctaacatgagcaaaccatcatcagttatattaggttaatatatggtataagtagtatggttctactgttttgttttaatttgcaaattattttggctttgcaatgatataagaattataagcctgttctagagaagtaccatgcaacattgtacctatagttaacaatatggttaacaattttaacaatttaaagtgtattgtacactttaaaatatgccaacagggtggatttcatgttaagtgttcttaccacagttttaaaaagaattattagcatgaaatgtttacatatctgggtttctattttgtagatatgtaagtaacattgtaataaaaacactgtaactctccaatacaaaaagcagcttcctacacaatgcagccccatacccatacccaacccattgacccatcaagccagcacccatcctttcttggcactctgtatctcagtacacattctaccttcaaaaacagctaagtcaaacgtgtcaaaatagctatttcctcttgagtttgagcatctgcagttgcccagccccaattctttatttggaaataagtattaggagaaacatatctagcatagtgatattgatttgtaatttcctcaaatagacattcactttagatgactacaaaagctaaatagagctcaggagctcgagaccatcctgggcaacataatgaaacaccatctcttaaaaaaaaaaatacaaaagttagctgggtgtggtggtgtgcacccatagtcccagctactcaggaggctgaggtgggacaattgcttgagcctgggaggtcaaggctgcagtgagctgtgatcacaccactgcattctggcctgggtgacagagttagactgtgtctcaaaaaaaaaaaaaaaaaaaaaaaaagctaaataatatatacacatgtgaagtcctctgtgtctcttctgccttcttcagctcatagacatctatctaaatacacacctgtgggccattgtgatgtgcccagcatgtgggtggtatgatactaaggcacattttagagcaaaagaggggggccttaaagggagctgccaccccttcaaaatgcactgactctgaagcatcctaccaattgtcagtaacaccttctctcgccagggaaaaggaactggagggaaaaacaaaatccaagcaaagaagatatcctactcccaattttaataatatttattatttaatataatatttaattttaataatatgtattatttaataatatttattataatataatatttattataattattaaataattttaataattttggcttattagcaccaaagtcccggtttggtagtgtaacttgattcttttctgatcttcgtgacagtgtctacacaaataactcatgcaacatgctgtatcttttgaagtaagcattttgtttatttttggttcaatactttgggtcccttcttctaaatcttacaaggccaggcccggtggctcacgcctgtaatcccagcactttgggaggccgaggcgggcggatcatgaggtcaggagttggagaccagcctggccagcttggcaaaaccccatctctactaaaatacaaaaattagctgggcatggtggcatgtgcctgtaatcccagctgctcgggaggctgaggtaggagaatcacttgatcccaggaggtggaagtggcagtgagccgagattgtgctgctgcactccagcccgggtgacagtgcaagactgggtctcaaaaaaaaaaaaaaaaaaaaaaaaaaaactaacccacagtttccaaaggcaacttgcttttgtgcagaatgttttagtttaagttgttatttggtcattgtaaattatcttctgtagctattggattcatgtttttcaaatagttaaaagtttgaaagctagctgactaggtcgctaaacttaaggaactgaaccatccttttagacgtatgtggttcattaagcagtgaagttcagaaaagggctcagggctgttcctgccaagaggttggtgaagacacgtggcaagtggcacgctcaagaggttgtctttgtaatgttgcagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacaggtactgtcctctttgggacggggagtttctaacttgcgtcttagcctgtccgttgaatggaatttgttgagcagagcattcctttctcagcccaactcaaccctttttcaatctaactggtttaattattttgcagtcattttaggcaactaatctgattagacaggcaatctgatttagacactaggacacactattctatttctctccaccccgttcccatctcataaacataccccagttgaaggcttttatttcatttcacaatctagcatttgtttaatttaataagtatggtgtgctatatcttaaaaataagtatggtctattttttctgtttaattctttctttaaatttcaatagttttgggggaacaggtggggttttggttacacagataagttctttaatggtgatttctgatattttggtgcactcgtcacccgagcagtacacaccacgcccaatgcgcagtattttccccctcacaccctcctacctttctccccgagtccccagtgtccattatatcacttttctacctttgcatcctcatagcttagctcccacttgtaagtgagaacatttgatatttggttttccattcctgagttacttcacttcaaataatggtctccaactccatccaggttgcggtgaattccattattgtgttcctttttatggctgaatagtattccatggtgtgtgtatatatacacatacatatgtgtgtgtgtgtgtgtatatatatatatatatatatatacaccacattttctttacccactgcttggttgatgggcatttaagctgcttccatatttttgcaattgcaaattgtgcttctataaacatgcgtgtaccagtatattttgcatataatgacttcttttcccctgggtagatacccagtagtgggactgctggatcaaatgttagttctacttttagttctttaaggaatctatactgttttctggtaggttatatctttaaataaggaaaagtatttacatttattctgtagggtgttgctatctgttttgaactgaagatatgttagtttagtagagtcctccatggctaccattaataggtaacacgtgaatttttaaagtgggcatgaattgcagatgtcttcttttttctaatatacagcctgaatcaatagtctctgatcattataatattcaacaagatacagaattccgcttaatttaatgtgattattcaaacacacttaatgagtttgctattacgtattttctcactcgggccctggttgaaatcagggaacttgagaatgcctaataggttcaacttcttcaaagagggcttttgcagcagaaataaggtcacatggttcattatgctaatggttagtatatgtcatttatattgtcatttatgtgccccaaggtctaaaaaagatgaggatatttgaggaggaaaatggagaaaataattttaatttaaaaccatggactgattataatggttacactatataagatctcacatgtggttttggttttagtttgttttgtttaattcagtctatttagaaaattctaaagggaatgggtcctggcctccttaacccaagtttgagaggctgtattagaaggtttcagaaagcagtcttgaaaatgttggccggtagcacaatattgtttaccctttccctcaataagtagcttctaattggggagtaggtatagcaaaggggaaataggtataatttctagggttcactaattgactttgactcccaatttgacctttcactaactgtatttcttcagttaaatggaaataaaaattatacctttctccaaaaaatgctgctaaacttaaactatgtaacaatacatgtaaaatgcagtgtcttacacatagtaagcactcaataaattttcactgttaccagattcttaacacgggagggcaacgtagtcattcactgccttttccattttcaagctgagagagaaataatagaaagagttttaaaaatggcattttgatgcctttcctgaatcttgttattaatgagtggtcaacaggagctttaaaaattactggtgatctgtagttttcttgcttttaaaatcttgcttttccttgtgcttctcttcggatatttggctgttattcattatttcatgctattaattgaaatcaaattctttttttttttagaaaatcatattgaggtctgagaatgtgtgatttatctctgacatattagttagccacaagaagaataagtcttcttggggctaaacaactctaactggcatttgatatctactgataattgtggtcatgatttataaataggcaaagaaatgttcaatacagtttgttggtttcttagcataagagtactttaatctggctagcactttggaattttggtgccttttaaaaattattagaattcaattgatccaaatggcccctctatagacttccccttaaattataaattttttgcatttgtagggacatttaatccttatatgtctaatttcatggaggcaatatcctgaagcaaaagtaaaggccaagaaagttttaaagctagtttttactctgccattttcattgttaaatatgaaatgtgttttttccaaaattaagtgaatttgaacgttgaaagggccaagtttggtctgaactatgaaatttgatggagtttctaaacattgcaagacaaattcttccaactctggtcacagttctggtatcacatgactggttgtttcctgcaaatagaaaccaacaccctggcttggacagtgtccagcatcctgcagtagtgagggaggtgatggacaacagtttaacttttggagattttctgtcctttttaaaataaatgtcaaatttaactgccctttttccactgtagaaaagatggacaagaaaccctttattcatggaaatcttgacaaagaaggtagattgtgtatacattagttagggtaacgctggctgctataacgattagtgcccccaaattttaagtttagtgcagtaacacttaccattatgcatatttctgtctagttggtagaaccagccacctgtcttcttttctcttgtgactctcaatccctagggcttggtgctccctgatctaccaacagacagagatagagaagacagggagtgcacctctgtttgttcattgccttggttggacacttctgtttacatttcattggcagttattggtcacatggcccgcctaggtgcaaagaagggagagggtgcaaatttaatccttgagtggtgatcactccccccaactatggaaggaggagcaggaattgtaagggacacttagatgtctcttccattggggtcactggcgtgagtgtggaatctcaacactgtaatgtacattttcttcctctcaaagtaccttgggagcctccaatccagatcaggaattctagatgacttgatgacatgggagaatactacatgacatggaaggaattcacttattatttcagtttgatccttaagtttgaattccccaagaagcaagtccagaaacaacgatttgactgcaagtcgtttatttgtaaggtgatgctaggaaacactggtggaggtgtgggaaggtaagacagaaaagggaaggccaccaaataaacgttgcatgaccaagcacatcaccactgtgggtatctggagcttcactccactgggaaactctgagatccagtgtggaatacacacctcggagttatcccactcaaaaagtgaggggtgctgaggtatctaaacactcaggctatcaatttttgtttgaaaactgctcccaggggacattaataccgaaagcacttctggcatgttgagtagactccagtccccagagaaaggcttgcaaatgctgtcagctgaaagccaggcaggcgtgtactaaaatggtaacgtactggggatatgggcaagcttggcactactggcatctgctgtagtcctgggtagcacaggctgtatgaatgctgctgactgatgaatgagcaagctgtctttggtgttgttctttctgttgtacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacgtgccatgcaagagacaaagataaaaggggaaaaggtagaacagaaaatagaagggaaatgggtaaatgaaaagaaagcacaagaagataaacttcagacagctgtcctaaagaaacaggtacagtaaacattttgcaccaaatgtgtgatgcctgtgacttgtgagaaatgtaatgcacatctgatttgggactgaggccacatgcatatagctcacatgcttgatcatttggcaagctgttcattttttcaggccatagcgatacacaagcatgcagcaattgattgatggctgaatattcaatcaaccaaatttactgggacagccagtaaatttggctgtccagaagacagagagaaattaattgctctgtgcttgattgttatgaatacccaaaaaaagaattaatccaaagatgataaatgtggtggtggtgtgttggcttctgattctgcgcttgcatctaaactcgttcttttaattatctttcctctatccataggtctgcatgaggcaagaggcccataactccttacctcactcatgggtttgacgttgaattaaaaaaatgataaaagctggggtgggaaagagacatgaagaataatggtcagacatttcatcttaagaaggcaaaaacaggctgggtacagtggctcacacctgtaatcccagcactttgggaggctgaggtgggtggatcacaaggtcaggagatcgagaccatcctggccaacatggtgaaaccccatctctactaaaaatacaaaattagctgggtgtaccggcacatgtctgtaatcccagctactcaggaggctgaggcaggagaatcacttgaacctgggaggcagaggttgcaatgagctgagattgtgccactgcactccactgggcaacagggagagactccatctcaacaacaaaaacaacaacaacaacaaaaaggcaaaaacaaacccctggaaattaactggtaataaagagggggaaaggaactggttggaaactttccttaaaaaaaaaagtcaaaaccctgatttgccaacatgtagacctcagcttaatgtagacttgcagaaagccattaatttagggtagtattgatttatatttgactggtaattaagagcatacatgctgcttctttattatctgggtgacacaaattcatgtggcctgaggaagggtggaaatagtaggggggaaatgtttgtaagctttgagaaagattttttttctgtctgcaagactgcattgaaagcactgtacctaatcaccaccacaccaccaccaccactcctaaaaaaagaaaaaaagagatgctttcacattcacctttccagagcaaattctctgtcactaagcctgcattgcactgaaggtatctttaactcctgcttctgtacaagaggctcatgaacacagctaaaattgagaccatgagcaaagtgcaccaaaccacacacgaggtttgtaaacacacgaggagtgccacatcatgctagatttcagtgagcgcaatggcaggcacacgagaagatgttggggtgggaagaaaatatcccaccttgctgtttagaaccactgtgctgtgagcgctgagacggcagaagagaagccatcccacgcagcacttgcaaggcgatccgagcaccctgtcactcttgtaaactagaaagggcttcttttacttgtgtgaccttaccattcttgaaaataaaaagggagaagagaagggaactaaagtgcaagctaaaagagaaaagctccaagaagacaagcctaccttcaaaaaagaagaggtaaatatgattgaaaagtaatgatcgtaaagcaacagaaaaagcagtcagtgttccaagatatctcaggtctgatgatctcaaaattgtaacctcatatccagtgtatttcaagccatgactcacagtccactgaatagtgagatcagcttagagtgtctcaaaattaattaaatgtatcagtcagcattttttaaaaaatgaaatggatagaagccatcagagggcattgtaggtagtaagtattgcattgtcaggtaaattgtctttttttctgtgggacgtcatcaaaaaggcttgaaaaacactgctggaatcaatttatcctgttttctattcttctgaatgctaattttttttccttgagccattctactttcatttcaatcatgaaatatttccaactggccttgattaatgctttaacttttcaaaggaaaaacacccacacacatctcagtagaaaatatggtgaactgaagatgatatttggttttcaaaagaaaagtttggccaaatgttctgcattgcatttctgaggcacacacaggagcgggtgccagggtatttgactgtaggtaagtgaacaaggagctatacagatagaatggcacggggtttgacagtaatcagaacaccacatcagaacacttgattgcacttcaactctcatgctgtgtttgccccaaataatcttaaaaattgtgactatatcgaataagttcacaatacttattaggatgtggtgaaactgaattatttgaagtaggaagacccgaagttcttcgcctatgagactggtgaagtgatttgtagccaacatgctccaacccatctattaagaaaactatggcatctattaagaaaattcaaaatcttaaacagagaaatccatatttagaaaacatggccagattaaatagggggtgggttattttcttaaatacgttttgtcaatttcacgtgaaaaatgaaaacccctagttcatgttacatattacatttctgttaagatgtatgttcctctgtttctaatagaagttgtggtggtttggaagtgaaaattgaatgtgagcacaggccatgtaaaggaaggagaaagtgtaaatgttaataacaggaaaactgaatttagctctcatgaggcagtcaaggaaatcattcattgaacatgttgggaaatacttttcatttggtgaccaaatacctacaaattcatttacaaaaaagaaaaatgaaagttacctcagaactaaactcagaaatatgtcccacatgggttcttgtaatgtttcttggtgaatgtctttatagaaagaagtgggcatgaaatgatgactcagtaattaaacacatgggggaagggaggctgtagaaaacactggattctatatttaaaatttcattcagttcactaatttgtttttactgaccaaagctttctatacctatgtagagtgtctgagaactagaagggcccatcagttgccactcggatgatccttttgtctcttttcagataaggccccagttcaacagcgtcctctgtgtcaatcagatactcccaggaatgagtgagccctgccgttttcccaagttgcccctcagcacattccagccagttccaaaacttttggcttgtttttgacacaaggccagataagctactcaaactggtttttttaaaaaaagaaaacaaccccaatctatattccttttttaatactgtgtacataacctgctgctcgaaagactaggttttcccctttccagctagttgtgttgtttctttatgtagacagctttaaatcatgtttacatgattcagccattttaaacaacctcttcctatttttttttcctttttgtacaaaaaaaaaaagaagaagaagaaagaaagcaactaactaaaacctttcctttcaaggatttatgcagcataggatagggcaaccacaagtaaacacaaacatcacgtgagccttcttaaagaaaacatttccagaaatcactccaatgtcttaaaaaacacacaaaataaaacctttctccactgcagtttaactgtggcaatgagttgcagacgatcaccaacactgaaacttaatttagcttttttctctcctctccaatcataaaaagtctctttttggttcttcatgcaggagctattttctttcttttctggcctctaacaggaaaacagagtttctagccgagctgctcctgaggtattaaaagtgatgttcgtgtcatgcggatcaatcctgcccaaacattagtgtgcatgcaaatcacctggcagtcttattaaatgcagaatctgattccatgaggtccatgttgtccgtggaccaaacttgcagtagtagcgaggagtctagaagacgtccatgttatagaaattgaacccaggaaaggatttggggcttatgaagctaacaaaagcacgtaaaacccagcctgagaaacagtagctacacccagctcttgttgctattctggaaccaaataatgcaaaatatgctcgagacacatctcagttcttgcttgcttgactttctgagtgtctctctggcacaagggcctgtcatttgaattcccatcccccacctcatccccatgtattattccactggatatcccaaatatctagagtttcaaaacccaaatgatcccatttggccagagccttttttatgagtatgctaatgttatctgtgtatgaagcacacaaactttttcaggatacccggctatctattaatccttcagcacggacgttctccatggtaacagtctgacctataagatctaatgcctttcccagggggctcagaatcccatgagtttgggttaaatctgccataacatctaaaaaaaaatgtaaaggctctacggaattactttatttattcatttcccagaaagagaaaataattttcagttgaactcaaatcgtcattattacattgacaaggtttctaaggttttccaaaaagaatataagcctgccatccactatagcctttgccaataaaggcagagcttgaaaaaaggggggattttttttctgttagacatgtatcatcttacaaatctattttaaacacttttgggaccagtaaatcagatataatacatttggggagaatggaaatttttctgactgcaacataggataaatgagttaaagggaatgtctccatgcgtagtgctccacagaccgtgagctcctactcggaatttatttcatggttatccctaaaatgggtttccctcacatttggagccacagatgcttcttaactagaacataaactccagtccatggtttctggggctaagtctaacaacaataggccaaaatgagaatatattttgtttcctccttcctgtccagtgaatactgatatattcttgggcaaggacagccatcagggagccacagtgaagctgtcattcaggctatgagcttgctccttttttctgtagcctctcatgacccatgaggacccaagagggaaatgacaggatgaaaaattcggaaggaatcatctggtccaaccgcattttttcacgtacttgggaccagcatcccagagcagtcaagtgatttgtccaagtaacacaactagtttgttgtcagcactggagccaaaagtcaggtttcctgatttacagacaaagctcttgcagagaatggcaaagtacagcccccattttcagtgtgtccgagggacatcctaggtatataccccatggtgaaagattgaagtcttaactaattagggcagcatagaagtgaatccctagtaattaatcagataatacccaaagaagacaatcaaatgacttaaaacttatcaataaagagcaaaaaactgtgctctgctttgtaaaacatgcactttaggccaggtgcagtggctcacacctgtaatcccagcactttgggaggccgaggtgggcagatcacttgaggtcaggagtttgagaccagcctggccaacaaggtgaaacccattctctactaaaaaatacaaaaattatctgggtgtggtgttgcatgcctgtaatcccagctactcaggatgctaaggcgggagaatcccttgaacccgggaggtggaagctgcagtgagctgagatcgcaccactgcactccagcctgggcaacagagcaagactctgtctcttaaaaaaaaaaatgcactttaggagtaaatcttcacagagtatctgaagaataggtgagaagaggtgagtgatcaggtcaggatagaacctcctaggccacaacacctaaagtcctgagttcttatggcctacctttcctctggatttctttagaatgctcatggtttgtaactgtcttgaaaagaaccatcgtgaatgcacctcacctgttttcacactcatcttttaagaatggatgagatgatataagtgaagtgatttgaattcctttaccccctcccccacaaaaagctatgtaaattcagtatacttttaaataatctgtctcacttactgaaagaaacacaaaacgcacaaaatatgaaagctaacacctgccctccatatatcatcttcctatgtctcccaccacaaccacaaaactacttccagagaactaaatttttattgacaatggaaatcaaggtaaaccctggaatttttcctattccattctaactttaatggtttagatgactacagacatgttctcacagaccccacatatctttggatcctcctactaaaggtagggttagtaaatgtcccatccttgggacataatttactcagttgattaaaatactggtcttcgccagagttggtttggcagatctagctaaactgataggtttccttttctttctttcccatttgtgtctctctcacagattctctcaccatccaggaagaaacctgtctaagcaacgtggtcattcttccatcaaagccatcctaataattgctcttcccagtgggaactgcaaacagctacttttacatgaagttcccagaacttagtggtttccaaacaatagtactaccactgctcttgaaaataaaaacctcagtgagatcagggatgatcttaccttcttaaaattgtggtaaaggtgtttgttcacaggctaaaggaccatagctcattctctaagaatttcacctgattccaactctaccacatctgagtggtttctttctgagttttctgccttcctaacaattttgggtcttacttgatgataccaaccaaaacctaataagatttttcttgttctgtttcttcctgatatgtactgttggttagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcaggtaagaagtagcaactagttaatagaaactgtgttcacatgcaaagaaaaaaaaaaaaaagtcagtcttcccatcctgtgcttccagacagaaacgtgctaagcaggcagcatgcttttgttgtgaggtcattagccattgtcttagagatactcagtcagcaggtccagttcttatatcactaacagaagaccagcagtcatcgctcagacagggcttagtctgcttttcccattattttgaaaggcagatcatgcttggcatccatgtttttgttcactgaccttttgtgagattagtgtattagaaaacattataactgggattcatgtcattcaatgattctctatatggtctgaccaccttcctaagagacctttctcagtaccattttcaagaatgcattttctaaaggttgtaaataaatattgcataagactaagattgttttgtggcgaaatacttgggaaacactggattaagctaaattcctcagatttctttaccacatgactttgagagcccttcatgttcattttcattggaagtctctaagagggagtgagaggtatggacctactgctctattttatacagtttggaaaaactctcttgtatagcttgagctttcccctcaacataatcccttaccccatcaaactgaaaatctgggcaactgattatcagacagacgagaccagtatattcaggtaaatcctcatttctaaatacagtcgaatcctgagagctctctaccaattttgtagaagaacttgaggtgcagacactgggctggctacgtgattcctgtgctccttccccacaaaacactctctccaaccactggggccaaattccaacctctgttttgtcactggttgctgtgccagatgtgccggagaggagtcttgggtccctgcaatgtggatttccccgggcttgttccttggctgcaggcttgcctagtgaccctgtttttctgaacacttcaaataagaaagtcatcaagcaggtttgagggagaaatctgacatgctcctcacaccaaagcctttgtaatattcaaaagcaggcggagctactagggatggatatttcagtctcatccaagaggctaagatggataaatacggttgccccaaaacaatttttttgtacgtaaatttaagcagaaacctattcatatttatccaaaggagaacctaaagctcacagaagaaaaggtgtacataaaagatctaaataaaatgatgaaggtgtaagaaaggtagaatctatagatattacttgggattgccaagagaatagatgtgaaaattaagtttattgaacattcatagaaaatctacaaagcgagttgattcaggttggtaagttgagtctaaaacttgctgaagtgtctgtagtttaatgttttaaagccctagaatagtgttaggttcatgaaaagtgttcaatgaatattacctaatattactattttttaatagtttaaaagatgtcttgtaaacataaggttcttttaaggtataagttttttgttaagagaaataacgtttaagaaaatctgtcagtagaaaaaagtctgtttaacaattagcaaacttgccaacaagcttcaaagctcaaattaataattaacatgcctattgtgtagaaatccaaaaagctgggtaattcgaagaaaggaatagtcacaagagatggtgacaagttaagtgctaagaacacttacgtgtgactctggccttaatttttctattttgggcaggaaaaaaaaatacaggaacaagctgctaccatattatttatttttgtttagccaccaacgtatgtgagttttagtttcaattagaagttcacgctgattgaagtagagaagtatagttttgctccatatacatataaaatgaggagagaggaagagagtatccgcctagcctctatttaggtaagtttagtacctaccagcttcactgaaaacaagctgtgttcttaatggtcaaaggcctgatactcatcttgacttacacctaaggaagccaaggacgggggtagggtggtgggggtggggtgcggggagaaagaactttatggaacgatttccacattaagtggcaccctaatgctgaggtcatgcacataggcagaggtggtgtgaacaaaacttttgctcctgttttgagcatagctgcttatgtgtgatttaattactgttccctttgatatctgcattttcttgtaactcgttttctctaaaacatgacataaaaatctcaattcaatgagcaagatatagcgatgcaaattataccaagggttttatagaaagtgcaaaatggttttttgattttttatttttgaaggtagaaattaaaagattttttccgattatagaaaaaaatactcattataaaaacgctcagaaaatagaagaataaaaataagcacccaccacccaaagataactagcagtaacactttttccagatatttatctatgtatataatattcaagataaatgcacacacgtgtgtatatttatatgtagtatatacgtgtgtgagtatacttataattttacattgattcttgcactgtgcataagaatgtgtcatagcttgctttctatgccaataaatataagcctataattaatgatattagattctactggatggatgtattaggacttatttagccagtccctaatgacggacattttgattgtccaaaatgaagactgagtgacacctagtggaatccatagatgtttctataggcatgtgttttgccggtccagttcctgtacagtaatatgatgaacacaaagagagagcaaactcatttttggaaggaaagaccctaaattgactgagagaggagtcacaggcctgtgaacctagaagaccctgaaagagcctttgacagcaaggttttgagggaccctttaaccttgtttgagttcaaaataaaagtttacctgtaactggcatgagcctagaccaatagttctaaattttttaacctaagcccttagtaagaaataaattttacataatgacccagtacacacctgtatatatttttataactgaaacaagtgtgtcaagaaatggtactttgttttgctctatgcagtgcactctgatattttctgttttttttttttttaaatgttgattacaatctactaaattgattttctggtctgcagcttgaaaattattgttctggaggacacaggatattcagaactacttcagtgtttaaaaagcatgatatataatatacatatatatattataaaatcaatattgcacagtgtatttcttgagcccatttcttgttttattcttcctcttgtttcacagctagaaacactgtaccattctttacatgtagtaaatgatgttagggtgtgataattcctttgttccttagacaaaagtgtcaggaataggatatctacgttgacatctagttaagaatgaccttactacttgctaataagtatttaaatggcaaagctgtatctctgtctcttaaagactacttataacaagggcttcaagcctaaattaagccactaaattctgcttagtgaagtcccaggcaaatccaacttaggtgaactctgtgttagtgaaaactctgcattctactgaagttctactttgagtatcgacatgttttaaaattatcagtgttctaactgtatcatacagtaaatttattaaagaaactcaggggtcacagtaggtgctaatgatatgtcttcatctttttatagttgtgtaaaatactaaaaataccagttccaaaataaaattttaccataaggactcttgggatagcattctgtctgaagtcttaatatgttcccaattctgcaatgaaatccctgtgtatcctccttaatcacaaaagaaaattcaacataatttcaattttagttcttacttacataaaaacgtacccatttcttcctgttttataagctgttctacctgatgaagcttctgcttcatctcaggcacggaaggtagctagacctagactgtagaaactctagagacagaggtaggaaacgcttctctcagactctatcctgaaggtttgaggtaagaggtggagagatggaataacatgttctatttcagtttattcattgtttcataacaaaacgtatttaatttcaggtataattatagttacaagaagagtacaactaatagataagcattagaatctgatcatggctcgactgctttctagcttccaaaagtttgagtatattattctctgtcttacctgtggtttccttgtttgtaagatggggataataaacctaacctgacatcttcccagttattgtgactgttaaatgaagtagtggatatgaaaagggtttagagagcataaagaatgacatgtaagtaataaccttaaccacatcataccaagctaatttcataattttaagtctgtataaggagtattccagttgtattggggtcaaagagcatagaaaattcacaaattgaagccataggttaatgcagtcattaaggactttcctggagcagctctgtaagaatagacataaatcactgtgtttagctcttaatcaagaggcaatgggtaatttcatctgccagagatcagctgctagagtcaagctcaaggcacagttgtggacagatggatttacttcaatgcctacccttagttacagccactttttcccattcccagcgcctgaacctttctgtcttccctcctgatccattactccaggcagacccaagttaaccagtaacttacgggaaaggactagtaaggccactacaagacttttgaactcattcacaagtaaccttttggactacatgcctccctttctaataacaactaatatttatactgtagatgatatagaaattatagtatatcagtatgatatcagtatgatatcatactgatataatacataagcccatgcaacccactgaggtaaatagaataaatagtatttacccatttttccatgttgtagcatgtatcttcttaaaaattgtggtaaaaacaaacatcacctaaaatttaccatcttaagcatttttaaaagtacagttaagtagtgtgaggcatattcatattgttgtgcaacagatctccaaaactcttttcatcttgcaagactgaaagactacacccattaaacagcaactctttatttcctgctaccgcccaccctctgcctctggtaactacagttctatttctgtctctatgaatttgactactttagatccctcatataagtggaatcacacaatatttgtatgatttccgtgattggcttatttcacttagcatagtatcttcaaggtttatccatgttgtaacaggtaacaagatctccttccttttttttttttttctctttttttcttacagacagagtctcgctttgttgcccaggctggagtgcagtggcacaatctcggctcactgcaacccctgcctcctgggctcaagcaattctcctgcctcagcctccagagtagctgggaccacaggcacacgccgccacgcccggctaatttttttttttttgtattttagtagagacagggtttcactgtgttgcccaggctgtcttaaactcctgagctcaggcaatccgcccgcctcggcctcccaaagtgctaggattacaggcgtgagccactgcacccggcctctccttcctttttaaggctgaataatattccatggtatggctagaccaccttttatttatccattcctgctatgatggacacttgggttgcgtccatctcttggtccttgtaaataatgctgctatgaacacgggtatacaaatgtctcttcaagaccttgctttccattcttttagaagtgtatcagaagtgggattgctggatcacgtggtagttctcttgttgattttttgaggaacctccatactgtttccatagcagctgcacaactttacaatcccattttacagtgcatatttgtcccattttacagctgaggaaacgaagcacaagtggaagagcagaggctcctggactctgtgattccgggcagaccccttccccagcctaccccctgggctaatgagaggcagtgggtatttagtcggggatgcagaagccgcagaccgacctccccttcctccagggagactacaggcaaaagcatgtaaacccctttccattgccccccaaccacagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggtaaggcgggcgctagcccactgagaacgttgcccgggaaaattccctagtgccgtgcggctgttcttttgagcatgggctctcaaaaatatttttttaagaataataaacttaccatgtgctaggtactgttttataacttgtagatgtattaatttgtccactgcttctaagaactcgctgacctaggtactaatccccattttacagatgagaaaactgaggcacagagaggttttgtttttgtttttgtttttgtttgtaactttcccaaggtctcccttgagtctgcctgacatgcaggaggagccccatcattaaaaccctttactgcctctcaaaaaggaaaagttagaaagctgaaaaggatgaaaggtctgcaaattagttaccagaatgaagttatggttttctaatagttggagagtttttatagagaagatttttttaaatctttttttttttttaatgagcaagtaagtacattagaatataaagaggcagggacagtatctgcgttgttcattactgtatacccaggaccccataccgtgcctgacatgcaggaagagccccatcattataaacagatggatttgtttcatcttttaagacagagctaaaaacagcagatagagttacaaggaggaacattttggctcagcatatgaaataatgtttaaccaactacaacttacagtactacagtttacaaagtgcattctttcatttcatcctgaggtacatcgttctcattttatgggcaaagaaaccaggaatcaaatagtttgagtgacttatttgaagattcttgactaataaatggtagaatcagtaaggagaccccgcttttccaactcagagcccagagcttttgagatagcgatctcccatcattcaaaatatgaagaaaaaaaaagactttcaatggcattttgacaaggatcctatgcaaaattttcctgaactgtatggaaaatttggatacattattttgaggtctcttttaactccaactttcaatgagccaatgacctttggttgggaagtatgggaagtaatcaggatgatagagtttgggggttaaacacaccccaggcttttttttttttattgtttttttagacatagtcttgctctgtcacccaggctggagtgcaggaatgcagtggtgcaatctcggaacacacccagtcttctatcctaactctgtcactaacaagctggggccttgggaaaactggactactctgtgtcttcttttccttatctgtgaaataatatctactttgcaggattcttccaataatttaatagatcattgtgctcccagtgcctggcacattctaggcactcaaaaattagtaggtatcattattgccatcattgttattatgattattattcagaggaggagagtatcaggaaaggctgaagagaaatcacgaagtcttagaactggattggacctaggagattatttgggctaaactaccaaacacaggatccttctgtgacatcctctgacagatgaacatctagtctctgcttgagaacatgcagtgataatgatctcacagcttaagaactaccaaagactgcattaaatctctcagaaaatcaagttgtgcaacttgatcagagccctgatagagaagacagagtattctagactaggaatgaagacacagaggggttaatgagacagtctgtaaacatttgcaattgcactaccatggttcaacgtctagagcatttcaggtttgtcaaaccatctaaaattatatattcacttgaagcggggagcaaccataaaatcacctcttgtaccatctggcaaatatagtaccacagatttagatagcttttcacataagttattcatttgtcttcacaactctcctaggatgtaggtagaaggaatattcatatcccttttacatatacagaagtgtgaggtcattgttaatgacccacaggatggtggtgattatgtatcatcctatgggaaatcatcataatgagtgttagtctaagccaggggtgtccaatcttttggcttccctgggtcacattggaagaagaattgccttgggccacacataaaatacactaacactaatgatcgctgatgagccaaaaaaaaaaaaatcacaaaaaggtctcataatgttttaagaaagtttacgaatttgtgttaggctacattcaaagccatcctgggcatgatgtggcccctgggccatgggttggacaagtttggtgtaagcattttacatgtgctatctcactgagccctcacgaaagccctaaaaaatgagtactattgttatccctgttttacagatgaagaaactgagccacagagcagataaataacatggccaaggtcaggcagttggaaagtagcagcaccagaatgcaaatgcaggcagctcgactccagctctcaggctaaacctctggtgaccacctagaaggggagtgtccagcctgcggcctgagtctgctgcctctccaactgtgctctctctcctacagcactcttccctttggctgtgaagctggtactgatgcctcgttatttgttctttctctcttaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaaggtatttttttccccagaaaacttctattagaatatgatagagactggattttagccccttgtttagttattgattatacagggcctttgttcatttatctttttgctatccttccaagttaatctgttcaggctgctataacaaaatactttagactggggccaggcacggtggctcatgcctgtaatcccagcactttgggaggcagatgtgggcagatcacctgaggtcaggagttcgagaccagcctggccaccgtggtgaaaccccatctctaccaaaaattcaaaaactagccggacgtggtggcacacacctgtaataatctcagctacttgggaggcttaggcaggagaatcacttgaacccaggaggcagaggttgcagtgagctaagataatgccactgcactctagcctgggcaacagagcaagattccatctcaaaatttatcactcacagttttggaggctggaaagtcaaagatcaaggtgccagcagatgtggtgtctagtgagggcctattcctcataggtggcaccttctccctgtgtccttacatggtggaaggagaaagggagaaaacaggcttccttaggcctcttttataagggcactagtcccattcacaagggcctcaccctcatcacctagttaccacccaaaggtctcacctcttaataccaacacatcaaggactcagtttcaacatataaatgttggaccatagcacctcctttcagctgtttcacagcttctctttgtttacaacatatggaaaggagggacagtagtgaaatttttatctgttgtttattagatgctttggcatacattaaaatgacattcggtgattatctctcaattttactgatccacattctccatgtgcctcattcctttgagcaactgagaatagagacatctaaaatttataaaataggaaagtatattttaaaagtttaagctgcttttcatgctagctgttcattttttctttgtcatgattaaaagccagctggaaatggtacaggtgcaaattttaaagcaattattatgggaggaggtgaaatgtgacttggaaagggtccttttccaggatggctttggtcctatgacagccttcatggagcacagctcctatttgatgtaaaacagagtgctgccaagagaacagaaaaggagcaggaatcagctgagtcagggagatgatagaatagttgagatgtagggaaaacacagtggactcaagaaagtagcatccttgatttataatcagtccaccattattgccagtggcagtttctttgagaattaacatcattgagcatctagcacagtgccttacatcatattgaagatacttaataaaaatttgttaaatgatgaataaaggaatgaatcttcagagattgggacttttaacatttcattttccatcaacctagctaggttataaagcatcaacaatggacaaagccatgagagaattatacccaggtctggccgggcacagtggctctcacctgtgatcccagcattttgggaggccgaggtggatggatcacctgaggtcaggagttctagaccttcctggccaatctggtgaaaccccatccctactaaaaatacaaaaattagccaggtgtgatggcgcacacctgtaatcccaggtatttgggaggctgaggcaggagaaccacttgaacttgggaggcagaggttacagtgagccgagatcgtgccactgcactccagcctgtgtgacagaatgagaccctatcccaaaaaaaagaaaaaaagaatcatagcgaggtctggatggttaattatgtacatatgtgtacggttatatcaagtggcacaccaaaatgaccaaaaactgcttacattttacagttattacttgttccacatgaaaatcagaattttttaatccccaaataacttcccttactctttttttttttttttgagatagagtctcgctgtgttgcccaggctggagtgcagtggcaccatcttggctcactgcaacttccgcctcccaggttcaagcgattcttctgcctcagcctctcgagtagctgggactacaggtgcacgccaccatgcccagctaatttttgtatttttagtagagacagggtttcaccatattggccaggctggtctcgaactcctcacctcatgatccgcccaccttggtctcccaaagtgctgggattacacgcatgagccaccatgcccggctcacttagtctttatgatggtctgggtcccagtcatatttctgatacctcccaaataaattatttgtacttgaacccttgtctcaaggtctgcttcagggaaaatttaaactaagccacagagggattatacatttaatatctgattatttatgaaatacttaatgcatgctatgtcctatgagggaaagaacaaagcaaggtggctgccctgatggctctaatgactgcctcaaagaaacaattcaagaattacaaaagtgagcagagcaaaatgagtagagaaaggccttgtggagtaggcaagctttatttataaactctgaaatttgaattttatgtaattttattgtgcttttctaatgtcatgaaatattattcttcttttgatttttttttaaccgtttaacagtgtgaaaaccattctcaaggccaggtgcggtggctcacacctgtaatgccagcacgttgggaggctgaggcaggtgtatcacctgaggtcaggagtttgaaaccaacctggccaacatggtgaaacctcgtctctactaaaaatacaaaaattagccaggcaaagtggcaggtgcctgtaatccctactcaggagcctgagacaggagaatcacttgaacctgggaggcagaggttagctgggcgcagtggcgcatgcctgtaatcccagctacttgagaggctgaggcagaagaactgcttgaacctgggaggcagcaacaaaagcaaaactccgtctcaaaaaaaaaaaaagaaaagaaaaagaaaaccatgttctctctttctaccttctttaaaatcccacccaagccttccttgaacagtcttggtaacatgaagaaaatagtagtcatctagacttccaaattctactgtggtttttttttttttttttttttttcaggagaaactacaacctaccctaccctcctctaattatttcttctctaccaaatttctcaacgtacctatttctctggtctttccctcagccagatgctggcttcccatttcatctagtacccccaggaagccatttatctactccctctgatggagaggcatttgtctgcaattgattaaagtagatgtataaaaaaggtctaggttattttaaatttctatgtaagagagacacatattcaggggcagacagtctatgcttccctccatgtatgtgccttgaagaacttgctgtgactctgattttcaagctcaatttcatattctacaatgtaattgggatagctattgatacccttggccctgcaacttttataagtggtcacaagttagcattgtagaataccaatgggaggaaaaatatttgctatttgacatcaaaatactaccaactactgtatttttaaaaaatatctcatgatttctattccttgtttgggaaagtctgtacctagtttttcatcattaaattatgttagcagtgactgattttcatatgcaataaagaatagattttaagtaaattaaattcaaagattttttaatttctattgcctttattggttggggcagggtgtggagtaacgagagcaccaattttctaaaacgaatggtgtgcttttattccaagttttatcgagacaatactgccacctcttggtcttcagaagaaccaatttcccttgttaaattccttaaacagaacatttaatatacaaattcagtacaaattgtttagagccactaagttaggatattttctagcaggagtgcatcagtaaacggacagtgcatcctgacaaaatgtgcgaaatgcaatgatgaagtcaggctatgttagctatgatagaagcaaaaggaggagtaggaatctgagaatctcggtgatttgaataaatgccatggccaaggttagaaagatgatccctgagtcataaagatgctgcaggtgggacaaagaacagttctcacctccgctatccccttctgcagtgcctctatcctcccaccacactgaatttttctttatccccagtctcaccacgctgcgtgccttgtggctctccaaatctttgtacatgtgcttgctttgccagaaatgccctttcctggctaagccatgcacttccttcctcactttcataaactcatttctgaaaccatgtaaaccagaaactactaatctcagctcaaatatcaacactactgaaaagccttctccacctcccccagatagttacttcttatacacacagcatttttttctttaatattgtacctactgttaatttttaaatattttattttatatactttactagtcttccctactaaattctgtgttccttaaagaataagaccttgtcagtcaggcacagtggttcacacctgtaatcccagcactttgggagtccaaggtgggcgaatcatgaggtcaagagatcgaggccatcctggccaacatggtgaaatcccatctctactgaaaatacaaaaattagctgggcatggtggcgcgcatctgtagtcccagctactcgaggctgaggcagaagaatcacttgaacccgggaggtggagattgcagtgagccgagattccaccactgcactccatcctggcaacagagtgagactctgtctcaaaaaagaaaaagaaaaagaccttgtctatcttagcttgcttaggttgccataacaaaataccatagactggatggattaaacaatagaaatgtatttctcacagtcctggaggctggaagtccaaaatcaaggtgcaagcagattcagtttctggtgagagccctcttcatggcttgcagatggctgccttcttactgtgtcttcacatggaggaaagagagcaagtgagctctctagtgtgtcttcctgtagggataacaatcctgtaggatcagggttccaccgctctgatctcatttaaccttaattacttccttagaggccccatttccaagtacaatcacattgggggttagggcctcaacacatgcattttagggggacacagttcgatcaatagcactattttatttattagtattcaattttatatagaaggtactgagtatattatttattggctaattgtttggctgacaggctggcagggataaaaataggatagatggatggatagatggatggatggatggacggacggacggatgggtaatatttattaaaagtgccagtgcattgcatagttctaaactgtttcaccttactcacctgggaattttttctacagaaatatacttctaagtttataattaaaatcagaaaaataagagttactttacagatgttttatatatcccataaagtcagcactacttatagtacttttttgcataaagttttttaagtaagagtttgcttttgtctttgtaggaaatcatcagaaagaatgaaatgctcttactagtatctataaaactgttattcaactgatattagagaggaagcatgttttcaaaaaaaaaaaactctgtggtatttattaattgctcatgaatcccagaccagtctgggtcagaaagaacccctcacatcttggagaattgtgtgtatcccctcaaaattcatatgttgaaatcctaatctgcaatatgatggtattaggaggtgggatctttggaagacaattaggtcatgagggtggaggcccccttaatgggattagtgcccttgtaagaagagacacagaaccttatttgctccctctctattctgcactatatgaggacacagcaggaaggtggccatctgcaaaccgtgaagagaggtctcaccagaccccaaccatgctggcaacctaatcttagacttcccagtctccggaactgtgagaaatgtttgttgttttaaggcacccagtctatggtaatttctcacattaaccaagactcactgagacaaggggccactcaaacatactagcctagggcaactaaaatccagtagatttcttgactgtcctgaacagggaagaaaatggaacttttcagcgtgcatgtgctttggcacatgcagtcataagcaaagaaggtatttgctcatggtattgataggtgatgggtggtagaggatatttctagcctggagttgggtgtggcatggattcaacaaatatttgcttattgctaacatctaaatttaagtgttacagtttcagtaaaatataatgtttgatttagcagcttcagttgtagcaaaaaagttcctagctttaaaaaaaaaagaactcatcaaagactactaactgctgattttttctatgtccaaccctgtttctctgggctcatttcctcatttcacacttgggctaagaggggcttcatgggaagcctcagccattacagatgagctgtgccccatcctcattctacctgtatcccgccttttacgttccaaggctaattaagttcagcaataggcttgatcattgacccttgtcaagttaggaaatcaggttaagcaataagggactagttcacatttcctagttattcaatcctgttacataccaaatacatagttaaaacattatgggaaaattttgttactcgaatagcatggtatgtctctagtaaatacatcctaaagggtaacagtgtgtgtttttgaaaaaattatttgtttgttgttgttgcattttgtttgttttgagacagatgctcactctgtcacccaggctggagtgcagtggcacaatcttggctcactgcaatctctccctcccaggttcaagcaattctcccacctcagccttccaagtagctggggctacaggcgcgtgtcaccacacccagctactttttgtattttttagtagagatagggtttcaccatgttggccaggctggtcttgaactcctgacctcaagtgatttgcctgcctcggcctctcaaagtgctaggattataggtgtgagcctcagcgctcagccaattatgttagtcttaaactttaattattttgccactgatttatattgttttagaggcatttttattccatttctgtctggtctttattttgccttgaaaacttgatttttttttttttacacgttttctctatcctgtatcaatcctaccttcattcccccaaatctcactatcaaataccttatatgtagttttgctttctagcagagctacgcacagtaactcaaatacccttatatgctcttcggtgtgtttaacaggttcagggatgatattggcctgggctgagaaacactgtttataagcttgaaatattaattgggtttattttcttttgtaattcctagatagaagagcgagcagaatttttgaataagtctgtgcagaaaaggtaaatatgcttgatggttcaattgagctaatcagctagcatatgtatgagaagattctctctcatatttttatatgtatgtgtttacttttttagcagtggtgtcaaatcgacccatcaagcagcaatagtctccaagattgacagcagactggagcagtataccagtgcaattgaggtgagaattgtcctcagcgttatggtcctgctgaacagaaatagattctgactacatagaagagcataaaaacacttaggacaataatcaagtccaatagccccaggagtgttagaattttttttttttttttttttgagacggagtctcactctgttgcccaggctggagtgcaatggcaatctcagctcactgcaacgtctgcctcctggggtcaagcaattctgcctcaacctcccgagtagctgggattacaggggcccaccaccacacttggctaatttttgtatttttagtagagacggagtttcaccctgttggccaggcaggtctcgaattcctgacctcaagtgatccacccgccttggcctcccaaagccgaatgtgagccaccacacctggcccccaatagtgtcagaatattaatgatgctttattacactttgaaattctaagttctaagaaatacaataataaagataaattttaggagagttttaaataaattattttctactttcagcgtgaatattgtttaatgaaaaggtttttttgtaacgaatgggtttactggtatttaaatatatatatatatatatatatatatatatatatatatttaactatatatatatttaagtcttctttcaagtattctgtcaaatctgggtttaaatgtcacttcctcagagtagccttctttgcacccccaaactaagtactgccccccaattgtgtgccatgctttatggcacatcattatttttcatagcacttagcacaatgtgaaataaatacttgtataactagttactatctttcctttctattaaaatataagcccactgcagctgactgtcttgttttttgtttgtttttttgttttttatttttatttttatttttgagatggagtttcgctcttgttgcccaagctagagtgcaatggtgcaatctcggctcactgcaacctctgcattccaggttcaagcgattctcctgcctcagcctcccaaccgtcttgttttgagcacgactgtatccccagagcctagcaaagtgcccttcatacagtaggcatttaagaagtattgttgaggccaagtgtggtgactcatgcctgtcgtcacagcacttcaggaggccgaggcaggaggatcccttgagcccaggaatttgaaaccagcctgggcaacatagggactatgcctggctaattttttcatttttttctctacaaaatagagagaggcctatggttccagctactcgggaagctgaagtgggaggatcacttgagccctggaggtcgtggctgtagtgagccttgattgtgccactgcactccagcctgggtgacagagcaagaccctgtctcaaaaaaaaacaaaaaagtatctgttgaagaaacaaagtagaatatcaatttcacaacaaatggtgtcccaacaaaaagcatatttcatttttgaaagatcctctgatctagctgtgatggtttattttgagggacatatgtcatcagcatacagttttacaacagaaattatcactctcatttttggtggaggtgtttacacaatgaatttttaagatgataatgttgaggaagacaaactcactataattttatgagaacaaacttcccagcaccaatcctaaaaataactcacaaatttcagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggtgagcatctgatttttgtctcttaagtgtagaggggcatatttttttgcatgtcgattttgatttaggaatcacactagtaaataataaaagcagtgaagaaggtgcaatttgtactttgttttgcaatgaccacaaaagcaagctcagagagaatgtgtttgtgaggttgcatgaggtactaagcccgggccatcttactccaaataaagtgcctgggctgaaatgtccacccttggagttggagtggggtgagttaccagggaaagaaaaccagataacatattctgtaaatatcaagtgttaaggtttatggttatgtgaaatcatacttaatgatattttgaatttgctttgaaaattccttcccaggtaaagtttacttcattctttaatattttggatgattgcccctttgtaggaaactgctggcttgaaggtaggggtttctagccgcatcaatgaatggctaactaaaaccccagatggaaacaagtcacctgctcccaaaccttctgtaagtacctttaggtttttctgagtttctttgatctcccagcttctaccagcagaagaaaacaagcagttggtctgtttacctaggaatggcagtgcccctgttctttgctttccctgatgaatagcaaacaggaaagtgttcagatttacaacagttctaagaagctgcatctcagttactcagagggtaaaatggaaccaaataatcacctctacaccctaactgagaggaggaatcagctagaatactgaggcagttcaaatttagatcctttactcgtctatttgtttagcttctattctataaattctggatagaaatttgaaaatgaaaggtcacatcattttggctacttctttgtcaagagcacccctaaacttattcccaaaagaatatgtatgttgcctattgggaacccatatgttccaatttgcctcatttttataacttggcacaaaaatgcagttattgggtagctgttgaaataattggtctaattgtgttgtcaacacctcctgaggaaagtcataaaactggaaactagaaaaactggttatgaatgatgtttttgagaatctaaaattttcttaatttattaagtgcagctatcttactaaaaagtacatttcttttcacctttttgttgaatgtatacgacaattgcttgcatttgtcattataataagaaaacgtatcaagctccccactgtatattgctgagctttccctgttaagtttgcttttatagctttgttggtgcccaagggagctgagagtccactgtcataatcctacattctagaggaagaagaaaaagtttccaatcctaggcctctgtgcatttaattgcatccattggctccatgccatttaattgcatttgttggctccatatataatctccaaagtcattaaattttgtcactttccaatttaaaaaggaagaaatggaaatgttcacaaatccttcttgggcacaactccttgaaccgtttaattaatctacaccccgagattctttgcataaaggctcacaggaggtatacactaatgtcaacccaatttacaattggaaaatctttatacattgaaaaaagcaacttttcctccccctctcaataggtacaagaatgcgggtttataaaaggacacagttgaggcaagagaccggacccaaaagttatgtgctctttagtgcctcaagttttccaagcatctctggtaacataaggagtagaaattattttcaaaaacaaaataatcactggttccagaccagtgattattaaccctttttgaattatgaacccctttaaaacctaatgaaatttaaggaccctctcccccaaaatatacatataaaaaaacaaggcagtctatggacctactgagtaactctcaagatagtaagtaaggagagaaagatctatgtttccctctttgataagtatgaaatatttggaggagatgctaatttttgcacgtttatgatatttgcaatctttcatttttgtagcagattatactcaaaaatttgatccagaacttggcccctattcttttatcagcactttaacttgtaaactgaaaagtttaccatcatctgtatgacatcctaatgaggttaaaaagataaaatgcagttatgattatgataggtataactgtatccaggtttccacagcaaaaacaaaacaaaacatacaccatgttctggggttattgacagcctcctaaaaaaaaaaaaaaaaaaaaaaaggcattgcagagaaattacaaaatcattgcctgctttacctactaattagtatgtgacttgctagatcaccccctagagggtgaagaaaaggaaagaagaacatggcagttagtatagattttagtgagatccttcttcccattagattttgtagactagtgtggcttcctgaatgagaaccagatggaagaaagttctatgaaatcaatgttgtaaatacaccagattgctactgggatgtcccttgctatttgtgggtagaatttataggatttcagtgtaactttgtaactgcaattcaattctgagtatgtctgtttgagctggtttgtctattctttgtgtctaaactaatgttacacagaaattaaaaagctaatttgtctttctttttgtttaaaaaaaaacaaccaacaatgtctttctcagctgaccttctgttcctcactctttggtctctggttgattggaaacctgcttctcctgccttcatttctccctcttcttccggagtgggtctttctctaaaatgtagtctggtcaggtaattccatttatatttcccctttgatttaaaatgccaacttataactcagatgttcatattttcttaaaaggactctttaaactctttaagtgatcttgaaagattcatcggcaggatttatgggaagtgcaatccattttcttaggtagaagaacgtgcatgagaaggaaaaatatttgtctcatatgaatcaaataaacaaagcgataatagctgctttccagagcttccctcagcatgttcctaattatagtttccaaaattttaaaacagtcttccagacagtttggcagcttccacctacgctggcaaatgtagtggaattctacaaaaataatctgatttgttgcttaatggctccaagttaaataggtgtaactctctaatagaatatcaggaattcatgccacagaggaaatccagaaactcagtaaagtttaggcaaatctgaaatgcttcacaggtatcatttaactgtgcattttcagtgttacaatctcaatactatctatcagaaatatgtccatttagatcagtgtccacgggtaaatgcaattgctgttagctttgccttcctcctgagaaaagggtttgccaagataagcattactatttcagtaaaacacatttattttctacaaactaccttttgccaagtactaatataagcaaatgctggaagaaaagtaaattgaaacagaaatttggatccttatccaaatgaaattaattaggaggtagtaaataaagactctaagctgtataactgttatcgatcatattttagtgtttccatcccaagatttccacatgttcttacacatgtcatcaactgtcaacttctcgcatgggttcaatttgtgatgaatgtttatatttgctaggttctactgatccacttctgaattacccacttgcccctcgggagacacataatgattttagggtgaggaaaatgctgctagaaaagggactttgtggctgggcgcggtggctcacgcctgtaatcccagcactttgagaggctgaggcgggcagattatgaggtcaggagatcgagaccatcctggctaacatggtgaaaccccatctctactaaaaatacaaaaattagctgagcgtggtggcttgtgcctgtaatctcagctacttgggaggctgaggcaggagaatcgcttgaacccgggagtcggaggttgcagtgagccgagattgcgccactgcactccagcctgggcgacagagcaagactgtctcacaacagaaaaagaagaaagaaaagtgactttgtttgggctgcccggcaacggatcccaagatagtgattccagagcaagttgtttacgtggaggtgaagaaaaccctacaggggctgaggttgggagaagaaggcagtcctcacagaaggtgttattaagcaagtccccacatggactgttaaactttcatcccatggaggaaatcctggaagccaccaaagaacacatacttcagagttacccaagctgaggcgagagtgagcctgaaaataatattgcaccaacattcaccagtcagccattgaggactgctcctggggatgttataataactctctcaactttccagcctgcccctgggcaggcaaatcaggcatctgtacccagagaaagtccctaggcagagaagcgctgtgtgggcagttggcagtcaggctggtgtgcactaaagtagtaagggctggggggaaagaggtgagtacaaattgagttcatctgtgaggcaggaaatgcttatcaaaccccaaattaatcatttttaaataacccatgatctattgacttgtaagagtgcagaaatttaaaatgaggctacattattttaaacatgctcctgtttcacttttactgatcaataaacagtaagtccttaggaaagggcaaggaccccgaggctatagttccagcccattctcatatcataagacatgtcacggtctatataaaatcaaacaacagctaaccccatctctactacacatacaaaaaaattagccaggcatggtggcacacgcctgtaatcccagctactcgagaggctgagacaggagaatcacttgaaatcagtagatggaggtcgcagtgagccaagatcacgccactacactccagcttgggctacagagtgagactctgtctcaaaaaaaataaaaaaataaaaaaatcaaacaacagctgatggtcctttcaattccatttcagatcactggggtaaagtgtattaaacaacaaactgattcaaataaacaatagatgtggccatttatttagagctggctagaaaatataaatggccacctatcgatgtttttctgcttcctttttatcaggacttgagaccaggagacgtatccagcaagcggaacctctgggaaaagcaatctgtggataaggtcacttcccccactaaggtaatctattgggaagactagtatttcagaggtttgttttcctgatgtatggtgtagtataatgtcctggagtcagatgagaaatatcactgacctacagatctttgcctgcacacccatcagtgtctaaaagaccagtacataacacagtgaaatgaaaagcgcattgcaagtttgtcagtcatacaacataaacggcccaaatccatggaatggttctcagtaggacattctcaatacaccacagtggtaggaacattggcagcagaaggccgtatgggataccatggtctacgtttccttacaaggtcccagcttagtgccacagtcatttaaaaatcacttggggaaaacatctgtctccctgagtgtttccaaaactgctttctggaaccattttagattacattgccactgccagcagcctaagactcagggttgctatggcaaaaaaaaaaaaaaaaatattcaaaagtaaggcaaccatttaccaccctgtgaaaatgaatgattaagaatgattgggttcctcttacttttagtcttctggtcaaaggatatggtcattcttcagaaaggaggctctgaagaacatctaaatgatgcttacactgcaaatgggaccctttgtggtacaatgagctcattcaactcccaactgtagcctttccccatttcaagtaatagacctcgtgttctccttcaataaaaagaaaattaaaaagggagaaactggagaccaacaataagcaaggttagaacaggctgcttatgggttgatttaaacagaagcacttcgtaagcaaactcaggactaaagagcacatcaacggcaactagagaatcactacaattcactgcagtgagagaattaccttccctttcccactttctcatgctcttagttctggtgcagctacctaaacatattaccccaccttcactattagctacgtattgcgcttttattccattaaaatccactagcctttctaagtcattgctaaacatatgaaaagtacctgctggtaattatcacattgctaactactagcgctacaagtgagcaccccactatatgccagacactattctaccttcttaccctccattatttcatttgatcctccagtcaccatgtgaggtaagtagtttatcattctcattttgcagctgagaaaaatgaggcattgagagatgaagtaactttcccaaagtcacacagtgaataagtagcatagcctgcattgatactccagcacctgatccgagcctgcatttttaaccattatacatggtactttcttttaggatgcatattcaggagaaaatgtatagttattcaattccttgtataattttctctcggtggcaggggagaaaagaactttctttgttattttttaaacaaagaatgagcttgttgacctaagcttttatgacctctctagcctatgctattagcgcattgcaggtttgtcagccatgcaatgtaaatagcccaaacccatggaatggttcccaggaagacattctccacacaccactgtgggaggaacattgacagcagaaggctctcctctcagacctctgagaggtatctgacttctcagaatggcagtcccagtgtttatataggttcctgtctgaaaagcagatgtcagctggccatagaccatcatcaccagtataacggagtctctctggataacattcctcctagccagagctctggaaagtggaacaaagatgatgtggaatggtcagactcagagaacaccactcacatacaaacatgaatggtactccctggagttatgtagcaccagggcagtacaaggtaggagggtgacagtgtgagttttcatgtgccactaacttctttctacagtagtaataatataaccaccagacccagaactagtttatgaggtagcagattaggtacctcttttgctccaaactgtcaaactcatttcttgttactcagtcattccttagaaatgaatacaatgaacacccttgaaaattggaattcacaacactttaagatttcttaatagcttggcaaaaatttttagcaactagctgagggggagagaatggtgtaagaataggactataggtcagataagtctcgtggggtaggggtgtaagaataggagggagaaaatagagattgctagattaaaaatgggagaaaactaaagataaacatcctccttcaccatcatacattgatgtggccctcactgagctattcagtcgcatgtgcctgttctggaatacacactgtagatttttggctcttacagtggggcttaaaaatgaaaaaaacaaagcaacttacttgactctaaatgctataagcaaggccaaaagttaagacaggaaaagagaacatcaaggagaaagacaggaagagggaagtgaaaaaaatcagcagaaggaaggctaaaataaaataagatccagccaggcgcagtggctcacacctgtaattccaacactttgggaggccgaggcaggcagatcactggaggtcaggagtttgagatcagcctggccaacatatagggaaaccccgtctctaccaaaaatacaaaaattagccgggcgtggtggtgtatgcccgtaatccccagctactcaggaggctgagatgggagaatcacttgaatctgggaggcagaggttgcagtgagctgagatcacaccactgcactccagcctgggtgacagagcaagattccatctcaaaaaaataaaaagtaaaataaaagatcatatttgaatggaatgccgataataatcctccctttcataaatatttattcctgccatactattattcatttttcttctgactataaaaaccatctgcctgaaacactgcaggctgtcagtttcacactacaggctgtcaatttcaagttctcttctcttggcaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaacctgtatttcaggttgagtcttggtttcactctttaaagaagaaaagcattttcatatttttaaattacctaataaaatatagaaaattggtcttatgttgacaactgacctaacacgtatggaaaaggttgaagagggattttgcaaatccttcctaaaagaaactatcgtccaggcacagtggctcacgcctctaatcccagcactttgggaagcaggaggattgcttgagcccaggagttcaagaccagcctgggcaacatagcaagacccctttctgtacaaaaaaaattaaaaagccaggcatggtggcatatgcctgtagtcccagatacttgggagcctgaggcaggaggatcgcttgagcccaggaggtcgaggctacagtgagccctgatagcaccactgcactccagcctaggtgacaaagcaagaccctgtctcaaaaaaaaagtaactatcgattgtccctccatcctccttctcattgccagtgttgtcacataccagcccctctggctcctaagatgggcagtactgttttctcaaaggtagtgtctcttatatagaaagacccatttaatatataccattcatttgtagaatacttactacttacaag

SEQ ID NO: 12351 - DNA, 25755 bp, Human
attgaggcagaaaaaggactgtcaaacattggtgttcactcaattcaggagggataaagaaaggcctaagtcttatttgtgggatctgagtttaactcctgtgactgtctttttagcaacagcaaactacttaaccccttttttttcttttttttgagacagagtcttgctctgttgcccaggctagagtgcagtggcgcaatctcggctcactgcaacctctgcctcccgggttcaagcgattctcctgcctcagcctctcaagtagctgggattacaggcgcccaccactgcacccggctaattttttttgtatttttagtaaagacagggtttcaccatcttggccaggctggtctcgaactcctgacctcgtgatccacctgcctcggcctcccaaagtcctgggattacaggcatgagccaccgcgccgggacttaacctctttaaactcggccttaacctctttaaaccttatcctctttaaattggaattcctatcccgagggattgttgaaaggctgaaacaaacaaatgtattatgaaaatgtaaaagcatgcaataaactcagcaaggggtaaccatatataaaactaagtatatttctgtgcagaatatagtccctatagtcgaataggcgcaagtgttagaaacaggctctgccatggggtccctgaatctgacttctgaatgtcaagaactttttgaaatctgatgcagaatgtcgtgctcacatgtgttggtgaattcttctgcgaaaatgattcacagtttgcttcagggtctgaaatgagttcacgacccaaaataggaaggggatcggtagggcagtgtatatagcacaccattgacgtaaccattaataactccatcttaggagaagaccccatttttacatttcataaggcatttgccaacaagcatactatactttaataaacaaataaaaaaaatagtccgcatccagccaggtaaggacacaaacaagcactctcttccattaccagttctcaccacaggactctgtgactataaaagatggggccttcggcagctcccaacagccggcttaattgacgccgtctttgcagaaggacctctcggcccaaaccaggcttcttttcctcttcttcactccctctggattggttcgttaatctctttgccccatctctttttcctcatgatgttaaatgctactttgttgtgggatgcttaacttgtaacatttatatgtggattaagtacactactatgatgcgtgagcggcttgagcctgtgtgtcaggctctgactacccagtgaccagcaagtgctgagaactgcctccttgggaactccacgcagctcgtggcttttgtgatcgaaagagcgtccacagcagcctgacatggtggaaaacacagcatgcgtggacctggttatttctagcctggcaccctgatgacaggaggttaaggcttttgatttagggagagagacctgagggtaacccaaagaaaggcctcaggtcatcgcagaggagacagaaattaccggtgggcgtcccggcctgctcctcttcttcccagagctcaaactgggcagcaggcctggctttgtctcccttctaggtacccgttgggcctggcgcggtttccaagtctccctcaatttccctccagaatcccgcgctgggagcggaagcccgcggactctcaggaagacctagatttcaaatccggggcgggggagccgggccgagcctcagggcgggaccaaagcgggaggactggcgcgggacgcgagggcgggaccagggcgtgaggacgcggggcgcgggggcggggcgcgctgcggtggggcgggcgcctcctggggcccagcctggggctgggttctcgggcgggcgggagctaggggacgggccgcagcggaggcggcgcgaggggccgacaggggcgggcgggaggcggggctggcgctggagcacatctcccggcggcgggccgcggaagcagtgcagacgcggctcctagcggatgggtgctattgtgaggcggttgtagaaggtatgaggaggctgtgcggtgactgccgccctcgctccgggccgtcagccctgcccccgctccctgcgtcctcccaggccctgcgcccgcccggggacctgcccggtctggaaggcggagtgtttgttttgccacctcgcccgggcgggggcgagcagtgaagctcgcggagcgagagacttggcccggaggcgggagcctgggccggggccggggaagccaggcagcgggttaaggcttttgatttagggagagggacctgggggtaacctaaggaaaggcctcaggtcatcggaggggagacctggcccgggggcgggaggctgggctgggaccggggaggccgggcagcgcgaggccgggccggggaggccaggcagcgggaggcctggccaggggaaccgagcccggggccgggaggtcgggcacggggcaccgagctccgagggcgggagacctggcggccggccgagtgccggaaggccgggtcaggcggcggaaggcagcggcaagctgggaaacggacggcgctaccgccggcggaggagtggccccgggaagcggtgctgcgagggctggggcggccgggtgctgactgtgagatactcgccctgggggctgatccttccaattttggacgaggcttccgtctctgctgccttccatgcctggggcctggattatcccgggttgacaatgtggtttagctcttccagagagatagttgcagggtttaaactccaattccttttcggccctgcagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcagtaagtggcacccaagcaggaaaccggaaaacatcgttcgcagccccctctcgcccacccacttcttttcctgcttagtcgccaagccttgtcgaccttgtaaatgtctgccagatctgtccgcgtctctctatctctgatttcagccgtctgaccacagcagcctcttccctggtctctccacttccagacccgcctgctcctttgcagtccactttttacagcacaggcagagggatctttatgaaatgaaagtctagaaagctcgtcctttgcccttaggttaaacccagcacttaatatggctaacaaacccctgcgtgtgttgggtcctgagtgcccccacccctccttatctttagcaccggttcgatttctgcacggcaatgctgaccttcatacctagtgtctgcctgcaacacctctgcactccctttctcccgccatcacatttgattagaagagctgctacttaaatttctgttttcattaaacagtttaaggttaaatcttcctatgctgtgttctttctgcagccagcattccctaagagagatgtgtcatatcctttgcagttgcttgtttactatcttccctgctagatttgcaagcaaactccaggagggacggacttggtttatcttggtatccttagtgtcttgccccaaatgcggggcctggcataacacagtgaatgcccatccattgtatttttacttttatgccctatctagaaaaagtagacctggtttaggattattcagcaaataataattagaaaagaaatggtagaggtgacatacggagtcactgaaacgatgtaaacctgcaagatagctgaaagagggccaggcaaggtggttagaccagactgtatcaaaatgggctcagccactgtgaatgtgcgtgctgtggttacataatctctaaaaatgaaatataaagcttaaatcatctctatcacagcccgatgcttggactttggttttgctttgcctttttgcaaaagaaggtttttgaaagtgaaaattattttagtgaatggatgaacagtttattggagtatggcaataaaacctgttcaaagtaagagacattagacattgtacctagttaaatcagatttgcttttgctatcctgaataaaggccttgcctcttgccatttgaagagactggcatctgatataggcaattataatgcttctttactgttttgttttcaaacctcgtttaacacaatctcctactgcttcatccccctacaaagcagtctttattttgatgaatgatatattacattgcttctggtgcctactattagatctttaagctctgccccaaagataagaagcactggtgtttgggcctaaacaaagatgggagaattcttagatttatataatattctttctctgcatgttttgttcttaccttcacatgttgcctgtagagcttctttgcattacaataatgaaatcaagctacctgatatgtattggacacggtctggcatctgccttgttgagccacttttgaataccagtgagcatcggtataagccctgaatagagatagggtttgtctcttccactgcttgatacactcagggtctagtatagtactctgcacacagttggtgttcagtaaattgttatggtgcaaatatcaaatgaataaatgctactgaatctgagttttggcagtttcagtcttcctgacagcaggatttcttcaagcggttttaaacttgaatctgattctgcaaagtagtcatccttggtgggagtgctgaggctttaaagtcatctgtaatttttataaaaaggcatccgagatcctccattttacacttatatcatacaaatcatttagatctgtgaaggctttcccattttctccttttgtccttccaaaaacaccatcttaggacttcacctggcacagggaagacagatcgtttgcacatactaagtgcccttctttctaacttgtgtcataaactcagaggctttgaatagtggagagtgctctgtactgtcttcctggtcacgtggcccttgccagaggaaaggaaaggatggtttgtttgtatagtacaatggaacttatttcaatgtattctgtatttgattttacattcctgttctcatatttttaccttaattacataacaaatattaaaagattgacttcaccaggcccagttacaatcgccagtttgataattcttatacgtactcaaatgaattcagagaccagatgggaaaagattttgataaaacctctggtacatcacaactgaagtcttttcttgtccaaactattgtgaaacagatgttctttctgtttcatttgctaaatctggaaacgtgactgcttttgagactttgtcctctctgacaggtaataaatataatcctgatatttttcaagttgtttgacagaagtgtaatctccccagaagtcctgctggacaggcttcacttttcctttggaggaacacagagatacagggaatatgttttaatgacatatacctaacgctgaacatgaaaccagttattttacttttattattattatttttagaaacagccttgctgtgtcacccaagctcaagtgcagtggtgcgatcatagctcactgcagcctccaattcctatgctcaagtaatcctcttgcctcagcctcctgagtagctgggactacaggtgtgtgccaccatgccaggctacttgtttttactttgttatagagatggggtctctctgtgttgcccagactggtcttgaacacatgatctcaaccattcctcccaccttggcctcccaaagtgctgggattacaggcgcgagccactgtgtctggcctatttcactttagaagtaaattgaatgccacatgcgaagtttgttaaatttttttaaaaaaggaaagaaaacacaaaagtaaactacctagtcgcatcagaaatgccatagtcatttttgccattttttcattcattagaattcagtgcattatgttattttgttatctctgcagtaactttctatcatgttatttattttctttgtcttatttaaagcttctgagattatggatttttgtttccttccctgaagttaagtgttatcattcctatatagtactaagctgtctacagaatagtgggagtctgccctcttgagttgggaagatcctagtttgaatcttggctgtgcgactttaaagttcattaacttctcttagcctcagtcacctgaactctgcagtggggatccttatgcctcagagtgtcattgggaggactcacgaaaatacgcttgtactttgagttcagtacctagcctgtatgagccagcattaagagggacagtcatcacgcagcgctttgcacacagctctcacgccacatcctttggctactgttttggtaaatctttactagtaaatgtttcttaaaagcatttacattcatggacatgattcagaaactaacagttgttttttaggtctcactttgagatttaaaaacccttagggcagagaccagattttatttcttacctcagagtttccctgtaggacaggaaccagcaacagcctaatgagctgattaagaattttagagatttaaaatttaaattaggattgccagttttagagactggcacataaatgttttcatttaaggcagtgactgtttcctttaggatatgattttttatctttctaagatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctgtaaggatttcctttaccatcatataaatttttaaagtatatcaaaataaactgataactgagaaaatatatgttgttcagatactaataatgaagttaatgaagtccactatagtatttgtccctgagaaatctttatcaaatattttaaatcctattgtaaaataatgtattttttctttcagttttagagactggcaatcctaatttaacatctccttttgaattccccaccacaggcacactttcacacattcactctttaataacaggttgtttcaaattgttaatactttatagcttaatatagaaatttcactttagaaattaatttttatttctctgccttaatgctatagatgttgtagtctgctttacttcagtattgtaatgagtagttggctaaccaccatgtaaatagggagaacattctagttttttacttgtgtaggaaaacacagcttgaaatgtctaagtatctattttagagtgaagtaaatttatactgacaatatttttttgtgtttgaagacctgactgttacagcgttggtggcaagtgttaagggatccaggaactagacaagtgattctgagacctgagttccaggtttctaagtaatatcagttggtctactgagaactttgccataaacatatgtgttcagaaatttcctttcttagcagcagcatcctgaattgaacagaattacacacacatcagcccagtaagaaacaattcatgttaagtccattgctatgccaggataaatcttttaaatcacaattatttttcctatttatattttgtcaaataagaatgttctaaaaaccaaaatttctgttttcttttttttttttttttttttttgagacggagtctcactctgtcgcccaggctggagtgcagtggcgcgatctcggctcacggcaagctccacctcccgggttcacgccattctcctgcctcagcctcctgagtagctgggactacaggcacccaccaccacgcctggctaattttttatatttttagtagagacggggtttcaccgtgttagccaggatggtcttgatctcccgaacttgtgatccgcccgcctcggcctcccaaagtgctgggattacaggcaaaatttctgttttcatttaaggcagtgactatttcccttaggatgtgatttttttatccttctaagatgagatcaccatcctcagaataatttgtaccctgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctgtaaggatttcatctaccatcatataaatttttagaagtatatcaaaataaactgataactgaggcaatgtatgttgttcagatactaataatgaagttaatgaagtccactatagtatttgtatagtatttgtatattacagtactctgaaaagctggtcactatttaaagtttccattaccagtcacaaggagagaataattttatcccacaattttattgctggcaaaagacacaagtttattaaaagtcagtatttcagtgtaagagttactagactgtttgcagaagtgttcaaaagagatctttaggtccttggttgtctgtggaagctgatcagcatttaggggttcctgagcacagactgtgaaccctgcatttggcacatgcattcagagagccaatttgaggcagactgggggctagaaaggatactgccaggagctccaggttcagcttccgaagttattaagtcttatttcccagtttttaaattagacttcattttttagagcagttttaggttcaaaccaaaattgagaagaacgtacagagacatcctgtatcccacctgccccccaacacgtgcgtagtctcccccattatcaacatcctgcaccagagtagtacattcttacaaaggaacctacactgacacgtcatcatcacccaaacgccatcgttcacaatcaagttcactcttggtgctgtttatcctatggttttggacaaatttacaaggacttgtatccaccattatattgtcacactgagtagtttcactgccttaaaaagtctccgtgcgggccgggcacggtggctcacgcctgtaatcccagcactttgggaggccaaggcgggcagatcacgaggttaggagttcgagaccagcctggccaacatggtgaaaccccgtctctactaaaaatacaaaaattagcctggcatggtggcatgcgcctgtaatcccagctactcaggaggctgaggcaggagaatcgcttgaaacctaaaggcggaggttgcagtgagccgagaccacgccactgcactccagcctgagcaaggagcgaaattccatctcaaaacaaaaaaaaaaaaaaaaaaaaattctctgtgctgtctccctccctcctagccactggcaaccactgatctttttactgtctccatagttttgccttttccagattgtcagatagttggaatcatgcggtatatatggccttttcaaactggcttctttcacttagtaataatgcatttaaagtgttcatggcttgctagcttatttctttttagtgctcagtaatattctgttctctggatataccacggtttatttattcattcaccgactgaaggacatcttagttgcttctagttttgacagttatgaataaaactgctataaacatctgtgtgcaggcttttgtgtgaacataagttttcaactcctttgggtaaataccaaagagtgcgtatttaccatatggctggatcatatggtaagagtatgtttagttttgtaggaaactgccaaactgtctttcgagttggctgtaccattttgcatttccacgagcagtgattgagaatccctgttgctccacatcctcaccagcatttggtgttgatggtgttctggttttggccattctgctaggtatgtaatgatacctcattgttgctttaattagcatttcccattatttgcagtctgtgtatctttgatgaggcccactggattttcactttagattttctatagattggccataaagtcttgaaacaaagatattttctcatggattataatgcaatatcagtaaactattatgtgttcacctacgtttccagacttgttagctaccctgtactgttctctcagttaatcaagttaaccacaatttgtttctcaaccacaggtggctaatgattttgtatgtggtctgtccgctttgaattgatgtgcatggggcaagttggtctctatgatattcatggttcaaggaagttcgagatttcctggtacctaatacatgtttattgtacatatgaaagaaaaaagggcagatagaggggaacatggtactgagcatgatagaggcaaggaagggtggctactttgataggagaatacccctatttttgtcactcttgaaacagggccaagagttgaaattggctagaacaatcctgacctttgttgatattattttatagaataatatttgttactgttttctcacttttaaaaaatgcagatgttatagaaaaattagaagatatagaggaatgttaaggagtaaataaggtgtcagtaatgccatcacccagacagccactgttaataaatatgttaatatgtgaagacatactaatatgtaatatgtactgagtgactaatggcaggtcacttagtagctgtctcgattatcagatcaactgtcatggtatggcagtgtttatgttcaggtacccgtattagttattgttgttaatccctttctgcgcccaagttataaactaaactttttcataggtatgtacgtataggaaaaaatatgctgcatataggctcagtactgtatttggtttcaagcatctactgggggacttgggaggtaccccctgcccctgccccacaggtatactactgtataattattcttctatctaaagtaagatctaatggaagataggaactttgtcttgtcttccactctgtcctatttcccaggatgatacctggcacaaagtatttgtttactgacaaactaaaagatgatttatcccaattatactcacatcttcccttgattttccagaaagcctacaggaagtaagatggtagaaaagcaaagtcttcgtagaaatgcagagcatagactggctcttggagaaggtcaaacatcaccctctcctgtggttaaattgagatggtggcactggctgtcttctatattattgctgcacctttcctcaccaggggtgcacacaaaactgggagagaggggaggaaggagcttagctttgtcttaatagaagggaagaaatgatgttttccaagagaccttgaaattggggaccttggtaaaggtttcagtttgggaagataaaaaagtcctgggatggattccaacagtgtaactgtactcaatgccactgagctgtacgcttaagagtggtaaattttatgtctatttcaccacagttttaaagattaaaatttttaaaagtgggggaagttacctaggactttctagaaggacttttgagggtgagcaagttctgttataggcttgtgtattattttggtatttctgattttatcataggagtgaggttaaagttgtattttgactggaatttttgacattgtcagggtttctagagtgtggagaaggtcactcagtattttttgtttttgttttttgttttgcctttgttcttgttttcctctatttagggaggtggattgccatgggaagtacctttgcttcgaaaagccagaaaatgcctggtagaactccagaaaagtagtaaggagctggcttcttcagaggcagcatagcagagtgggaagagggccctgtcacttagattgtgactgtcgacaaagtcacttaaccaccagaagttgggttttctgacgtttagaattttgaaaagattaaaactgagtgccttgcaaagtacctggtatatattaagtgctcaataagtgatagttgctttgattctaagaactggttcaccttgtgagatataattgtgtaatggaagaatgaaagcagaaactttagtttctacttttacatttcctgggccattttactaccctaaatgagaagctgggcttccaaaacccactttaaaagtaaagactaggccgggtgcggtggctcttgcctgtaatcccagcactttaggaggcctaggtgggcagatcacttgaactcaggagtttgagaccagcctgggcaatacagcgagaccgtatgtctacaaaaaatacaaaaattagccagacatggtggtgcatgcctgtaatcccagctactcgggaggctgaggcgggagaatttgagtccaggagatcgaagctgcagtgagccgtgattgcgccgctgccctccagcctgggtgacagagtgagaccctgcctcaaaagaaaaaaaaaaaaagaataaagattaatggagatttggaacatcttgatactgtatcttgggaatctaagcattgtagaattgtgttatgtgagttataccattgtggtgggaagtttttgatttttgttttaactgtgttgagttgcagttcttagaaatgacccgaggtgttgtcttacaaaagaaataaactgtaatctgtatcttgatctgatgagggtatgtaaatataaaaaatcgagctgtatactttctatatgctttatgtagttcactatatataattcatagctcaattaaaaagagagagagaggctaaattgtatgtaccattgcaaagaaatcattatccccagaactgactcacatacacctttaacagtagagggagaactgaggtattaatttggaaaaataatcactgggataattaatataatgcagtggttttatgactgattttttattaacttctattttctttgtattctagttaataaaggtatccatggagaacactgaaaactcagtggattcaaaatccattaaaaatttggaaccgtgagtatttaaattgaattctttataatcagagaaagatggggatgtgtaataagcaaacctcgaggagtggggcaagaggaaagagagtggtctctctctcaggccagagagaccaagtgacttcctacctcagacagctgtgtggctttgcataaactgacttttcttctctgaacctcgtctttaacatggggctaaaactttcacagaactgaagggaagatgaaaggaaaggcctagtagggtgtgtgacccatagttggaaacctagtcctggaaccaaaaggacaccacaggagaggcaggactcccaagcgccggtgctttctaccctcccgaatcgctctataggattagagggtttaggtttgggaggagtttcttgacctcttgtttatgagtttttacgactaaaatgcaatgccagttttcagtccggggacaaactgcctagttatggatgaattttaccccttttttccccgtgtctttttggaatattctgcttattaatgcttccaataactagcagatggaaaaaggaaaaagataaaactcaaattcactttttaattcttgtctgttattatttatttgggatctctcgtaatactttaaattctgaaagtttatttctgaaacccagtattgttattctcggctgccctgaatattacaaactaattttattactaaacaatatgattacagaaatactattaacaagttaccactaaagatttcacaattttgtttagcaaagggatttttctagaaagtaaacttttaaaatgcagtcccattttagagagttgttgctgtcatttaaatcattttagccagtgcagtggcttgctcctgtaatcccagctacgtgggagctgtggcaggaggatcacttgaggtggagagtttgaaaccagcctgggcaacataacgagaccctgtctctacaaaaaaacaaaaaacaattagtccaccatagtgtgtgtgcttgtagtcagtcctagctacacgccagaggttacagtgaagtaagaccccatctcttcaaaaaaatcctttgaaagtgatttacacattttcctactattttttttttctttcttttttgagacaggctggagtgcagtgatctgattatggctcactgcactcctgggctccagtaatcctcctgagtagctaggactacagacatgtgccaccatgcctggttatttttgttttttatttttgtagagatgggggtcttgctgtgttgcccaggctggtctccaatgcctggcctcaagggatcctcctgcctcggcctcccaaagtgctgggagtacaggtgtgaaccaccctgcctggccctaccttttcatgtcatgcagaacaccacttcaataacaagttgcacggaagccccagacaggtttagggttgtttcgatcctttggtaagttgccctcacagtcctggctttcacagcctctgccttttattaggagtatcccctcgtggactagctatcatatgcttgtaaagtacctacctccttaggaggcacccagagcacgtggggaaggggtgtcgggagctgggagtcataagtcccatgatccatcatctgtaggactcaaaggtcaagtcacgctttcaggatttaacttcagtctgtaaatgtgaggctgttcacctctggttaaaaatcataactgttttctcacgttgactcctttaatttactacatttaatctttttccaacagtatttttggaattgtgtataatgtgagatgctcttaaggttaagtgcatgagtatatggactgtaggtgttagtgtttggtagttcctagacctgtttttgcctgactcttggtctagatcagggatcaagcttaaggcctgtttttatcaactttcgttggaatataggcacatccattcgcttacatattgtcctaagcccgtttcaccagtataattgagcagctatggctgggcacagtggctcacaactgtaatcccagcacttttggaggccaaggcaggaggatcacttgaggccaggagttcaagactagcctgggcaacatagcgagatcctgtctctaaaaaagaaaatacagaaattagctgggcatggtggggcatgcctgtctgtagtcctagctactcagaaggctgaggaaggagtatcactggagcccaagagttcaaagttgcagtgagctatgatggcaccactgcactccagcttgggtgacagagccaggccatgtctcaaaaaaaaaaaaaaaaagaatagaattgagtagctgtaacagaaaccagatggcccacaagcctaaaacacttaatatttagcccattaaaaaaaaagtttactgaccccaatctagatagcagaggtttttttagataagtgacttccagacagatattttcaattatttacaataatgcttttatatattaataaattactaatttgtttagctcatggggtttaaggaataatttatgaattgtgataaatattgtgctttgagttatatttgcattttgttgatttcccatcatttcagggtaatttttaagatttttactcttacctcaaaggataaaatatttcacaaagttaataagtaatttttaaattataaaggtatttgatgaaattttgaagaatttagaggaaaatgtaaaacatggaagttaaaagcctgaactctgaagtccaacagatgctttccttccttcttggctgtgacacaatatttgcataacctttagcacattacttagcctcacgtcaggtcattttctcatctgtataactgttgatgtgaaattgaaatgaagacagcctggtttataacattcaacaagtgttaactgttactgtgagttataaaaattgcactaatataaacagaaggcgtggtcatttctacctttgtaaagctattatttgatttctaaacagaaagatcatacatggaagcgaatcaatggactctggaatatccctggacaacagttataaaatggattatcctgagatgggtttatgtataataattaataataagaattttcataaaagcactggtatgtgtcttacataatttttaatccttttcaaatgtttgtgccatttacatttgatataatattaaaagcagtattattgaggtattagacagtaaaccgtgacacagactagctgtgaagtagagattgggcaggacctacaggtcctctgatacactgtgaacgcgtcactcttctgcccaacttcatagcctcctcttgctggcctcctatctgtatgcttggttgcctctgccctgacttctctgtagcccttgcttctttttcttctttctgcttcctctttgatcccaatggaaggttctcaaaaaaacagttaagtggtagtatttattttttccccagaaactgcaagagatatcacaagcattgccttatttaatttatgacaacctggaaagtaacgatgagattctgaaaggttaaagacctcgcgcagtcacacagtatggcggcagagctaggtctgtgtggctccaaagcccaagctctgaatccatcttctgttctgcttcacttccttgtatcctcatgtgctctgttgcctgtcttcccttaccctacgaagctccccatcttagagagacctttcttttactctgttccttttcattcctttgatattttgtctccttcccttcttccttaaattttgaatacatgtagtttaagcttgtactcttcatttgtttccattccttcttgagtctttttccattttctgtctctactactaaaactgcttgctttaaatttaccatggccttgccaccagatccccctctcgatttctgtactatgtacaacttgaatgtagtactacatttgagaatgtttttttagaaatatagataataaaatccttcacagtgccaaaaaagctaattaatatttggtgtattgttattttttcttggcagttctttttaaagcttgattttattcataacgtataagcaatgttgtcttctgcttgtttcacttaaaggaatagcatttttcatattgctgcataattttcatatctgttataatgattatataatactgcatccccaaaactaccattcacttaatttgaataatttactgtatgaatgaacattatggctgtttcccttttaaattgatgctatgataattctttgaattggcctattaatcatattagagttaatttttaattagagaagctgtagtagatctaacgtgggccagtacctatcagagtggtggtggaaatggaaggaagccagattacactgggaagatagcagggtttgtgtcagattaattataaggagtgagaagagaatagttgaaaatggagctctaaatggcatcagttttattgcttttggctataagttgagatgccaccttcaaccattaacttaaaaacacaacaccttgtttacttttgctttacgcatatttgaaaatttacttctagatattctgcctcacatttctagttaggatacctccttcctatagaattttgcactgttggctctattgtttcaaaaaccaaaaacaagcatattattccactaccaccagcacctccccccacatatttagaccagcagtctgggttttgcccagtgagctcctttcctactttgcaatgtaaaggtcaggttctcatgagatctctggcaggctggtgttgggccaggcgccatggctcacacatgtaatcccaacactttgggaggccaaggcaggaggatccttgagcaccaaagttcaagatcagtctgggcaacacagggaaatcccatctctacaaaacagaaaaaaggtagcagggtgtggtggtgcgcacctgtagtcccagctactcgggaggctgaggtgggaagatagcttgaatctgggaggttgaggctgcagtgagctgtggttgctgtactctagcctgggccacagagcaagatcctgtctaaaaaataaaaataaataaaaattaaaaggcagccaacacatcagcaccagaagccagtgaccttgtcacacagctgagataatcaacaacattttggagatacatgtagactttctgtatttaatcttcatacccatcaaatttactcaattctgagggatgtttcccaccaagatttagcattttgaaatctaagtgcatcatgcagtcaatctgtacgttaatgtggaaggttctctaaaggagtggtagaaagcccaggagccctggatacaggcccagcatagctttgtcactttggactggtttgttaactctgctacatgtcccacatctgcacaagtgaaactagtaataatatgactctcatggtgattggaaggattagagattagccatagcagaatacctgatgaacagtaataatgtttgggggttttccttgaaggcactataaatgttgtaatgctatcttaaaattgttgggaagttagagtcagagaaacgcatttcctctgagtgtgacagatgtgtgtatgtattataggatcgtattgttttctagtcttatttttttaaactgatgattttcccatggcaacattttatctgtgaaaatgacaacatagtatatcccattatataagttagtatagcttgtctaaccaaacccttattgttagacatttgtgtttttcactacctaaaccgctgtgaaagacatcattttggctataacactgatgagcttatattatgaagtatcttataagctacaaaattgaagaaattttgttcaccatgttcaaaatagttagaattctcttaccatttaaaaggaagaatttattgtggacttctgaattgctgagtagttaatttcatttcaaagtagttattctttgttttccatacaattaaaagtaattctttctgttccaaggaatgacatctcggtctggtacagatgtcgatgcagcaaacctcagggaaacattcagaaacttgaaatatgaagtcaggaataaaaatgatcttacacgtgaagaaattgtggaattgatgcgtgatggtaagaagaaacaattagaatgaacttcattgtacaattaattttatactatggtctagcaataattaaatgtataataaaatatgagaattgtggaattatactgtacataaccctaatcttacatactttagtaagaagtttaaaaaaagttatttatgccaacttcctaaaatggtttgagatgtgttgccgtgccccaggttaggttaagatgacctcttagttttagtctcagtttcttcatcatgttcccatacagtatatctgaagttgttgaataaagtcatggattttttttccttttatttgcaaatgtctttccagtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggtaatgtctaactgagtgatttggttattgacgattaagcaggggttactattctcaactgtaaattatccaaaggataatttttttcctgaagctaatgaactattgttacttttcatttatttaccacttaaaagatatagagtaaattttaattttatacttatatcaaaaagactcagcataattaacatcctttttttttttttttttttttttttttgagacagagtcttgctctgtcgcccaggctggagtacagtggcgcgatctccgctcactgcaagctctgcctcctgggttcacgccattctcctgcctcagcctcctgagtagctgggactacaggcgcctgccaccaggcccagctaatttttaaatttttttttaatagagacagggtttcaccatgttagccaggatggtctcgatctcctgacctcaagtcatccgcccgccttggcctcccaaattgctgggattaaaggcgtgagccaccgcgcccggccaattaacatccatttttacatagcatttcaattttttagaactaagttatgtgttcacacacaaatttttataaataaatatttattttctaacacccaggcctgccgtggtacagaactggactgtggcattgagacagacagtggtgttgatgatgacatggcgtgtcataaaataccagtggaggccgacttcttgtatgcatactccacagcacctggtgagaacgttacacataatgaatgttacatgtggattttaaatgaattaactgtgactgatcatagaattatacaatgaaaagtgtgtttcagagactgtcaagattttgatatccctaaagatatcaaaacttgtctatattttagggaaccttcatcaaagagaagtctcaaaaagttgtctttagccaaaagtttggctagaaaatatgcatatatagccgggcacagtgactcacgcctgtaatcctagcgctttgggaggccgaggcaggtggatcacttgaggtcaggagttcaaaaccagcctggccaacctcatctctactaaaaatacagaaaaattagctgggcatggtggcacacgcctgtaatcccagctactggggaggctgaggcaggagaatcgcttgaacctgggaagcaaaggttgcagtgagccaagatcgcaccactgcacttcagcctgggcgacagagtgagactccgtctcaaaggaaaaaaagaaaagaaaatatgcatatgtagagtagactagcacgatgtcattcattggactttatcaggtagatctccgctactaatatcaggtagaatattacgtggcaacagaggccaagtcagagcttcccctgcatcttagagaagaagagaggtacgtttctcaggagttatttgaaaggtagtaaataaaaaagataaacatgactagtatacaagaggatagatgtggagtgggagaaaagaaggtaaaaaacgatacatgaatgtgccgttaacctccacgtttttactgttctgctgcacacgtcatcatctaaataaacatttgtggattataccaccatttactcacacagctaagggtgtcggagagtttggaaactttaggtaaatgtattcttaagcagtgttgcattttaaaatatgctcaatatggtttatcttatcctctaggcatctttccaagcaaagtacctctaagttaaaagcaatgggtctaatagttaacctagaaaaaaaagtatgataaatatactattttccctttttggaccaatacttggtagtgtgtttattatactttattcagatgctctgtagacaagtaggacactcaaagcaatttgtttcttggctaagtcagtattaaaataaggtgaaatctgattggaacactgtgctacttacaatgatcctttttatacatctttacttttgcatcttaccttctgcgtgtttgctcttcttgcctattgaaaggggagtccagaaagtaaaactttcaataattcagtgttcgtgaagctggtccccggccagctttgctgaaagcagggggtgtacgcatagcacacattcgtccttcagcatcatttcttctgaaaccaaaggtgtcttttttttttttatttgtatgactaataagacttatgtaagtttatgcttatttttgcctttatgactacataataatttatagaatcaactaaaatcagctatccatggtattttgcttgtattttgccttttaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaattaccaatgtctttgagttttttgttgctgttgtttttgatgttgtgccactaattggaagttaaaatgtttttaatcagaagcttgatttggaagagtcaaagaggaagcaccagaaccctagcctagttttttgaggtggtggcagttagatcagggcagacagatcgcttatgcttcccaagtcctcgcagaagttcctgaccctgaaatgaccacaatgccaggaagatactttgtttgcatagatctcaggccttaaatatgaccatatgtgtgaatttgaaactttttccacaagataagtgtctaatgggaagaacaacctaagaggatatacaacaagccgttgatgtttactgatggcctcctctgggcgctgggattttgacagaggaatttgctgtctttttacttcatatgcttagaaaaggaatataggaaagtggggttgtgggtggttttaaatttcttccaatatttctgtaatgaaaatatattacttttaaatcagaaacaaaataaattgtcctaactaggaaaaggagacttctgtttctgaggagtagagagtagcataaatgagttctttaaggccatatgaaagcggtggttctatagtgttgaggaaaatctggcttattctagtctccctgttaagtaaagaggtttcagatacaaaggaaaagaccagcaacccaataggaaaatgagccaaggacatgaacaaacagttcacagaaaaaagaaaacccaaatgtcccttaaattcaataaacagcttgatctgcatcataataagagaaatgcacattaaagtatctgtcgtctatcagaccggcaaaaaccccagtttggtgacatattctgttggcaagatgtgggaaatgtatactctcccgttggtgggagtatgatacggtaaaatactctgtggaggggaatctgacaatacctatcaaattattctttgaagtagcagtcccatttcttggaatccagcctacccatacacctgtgtgtgtacaaaattatatatgagcttttcatcacaacgttgttttggtgttaaaaaatggcagcaactcagctgtgaagtgttccgggaagtcagggaccccgaacggagggacctgctgaggctctgacagaggaacataaattgtgaagatttcatgaacctttatcacttccccagtcaatactcttgtggtttcctatgcctgtttttgctttgatctcttggtcccgtcatcttcgtaagctgaggatgtctgtcgcctcaggaccctgtgatgattgtgttacctgcacaaattgttcatagggcatgtgtgtttgaacagtgtgaaatctgggcaccttaagaataggataatagcgatttttcagggaacaaaggaaatagccttaaagtctggctgcctgtgggccgggcagaacagagccatatttctcttattaccaaaaatgggtaagagaaatatcactgaattctttctccagtaaggaatattaataattaacagccctgggaaaagaatgcattctggggaggggagggggcctctgaaatggccgctctgggggtgtctgccttatgcagttgcagataagggatgaaacacaccctggcctcctgcaacgcccccaggcttgctaggattaggaaattccagcctggcaaattctagtcagaccagttctctgctcttgaaccctgttaagatgtttatcaatgacaatgtgagcacagtgggacatagaagttcattagtgattccagttttgccctgaccttgtgatctcaccctgaccttctgccttgtgatctttcgtcacccttgaagcatgtgatctctgtgacccacaccttatttgtacactccctcccctttgaaaattgctaataaaaacttgctggttttacggctcagggggcatcacggaacctgccgacatgtgatgtctcccccggacacccagctttaaaatttctctc

SEQ ID NO: 12352 - DNA, 34312 bp, Human
aggctctcttaaaaggttcagtaagggacctttgccgtccttcctttcgacacggcctgagggcgtgatgtgaggtcccgaggtgggtaggggccagctctcccggtggtcggggtgaggccagagtccttcgcccctggagcgcacgcggggcttgatttcgtttggcaacgacgaaatggcgcgcgctgagcaggggtcagatccatgatgagatcttgcggccaccgtcggatcctaagcttctttgcttccgaggcttggaattcattgttttgcacctgtcgagagccggaggcaacgaaaatctagccccgtctccaaagcggcggggaggctcagcacgcgttcgttccccagagtctagggaggtgtctggggcgataattcggaatgattgtggcttgatctttcccgttgccctcccaactgtagccggcccctaggtctgctcgacagacttaggaggcgggagaggaaggggtgatttgcagtgaagcccaggagaggttgggccacgcggctgggagtgggagcggggacccggagccgggcgggcaggcagtgccttggcgaagctgtccgcggtccctgcggcgcagccggagcgcacgggcccaagaagaagtggggttggacccgcagaggccactttccacccgcatggagaaagaaaattctctcctctgaaagcgagggcccttagctttgcagccactgctgtttttcttttgccaccgacgcgcgtaccgtttcacgatgcaggaccgtggttacatgcgtaaaggaaaaaaagaaaaacgcattttgcaggcctcgtcgtgtttttcaaagagccacaggccgccacaacgaagaacgacgccgcgaggcctgcaagatcctgaaacttgttttgaggggagagcagagaggaaaggggttgttggccccaggctacttagggtccctaggagactcccttccgcctgtccccggtttggcacaggggccaccgaggctgggaccaaagccgcgcagggctgggagcagcaaaggccgccggccgggcgtggacgacgcgcaaaatcccgtgtggggtggaggctcttgggtcagaataatgtgcgggacgagggaggtgagtaacctctttggggcggctcccagtgcggcgtcaccggccctgagaccccgcggcccccagcccggggttgcagaagtcacaggcccgaagcagcaagagctggggaagcccggccgcggccagcggggaggaggagcgaaggggttgcgccccagcgtcagggagctacgacccgagagagggcggcaagggcgccttccgtgggacccggacgttctaagcaaatttctagcatttgccccgggctcccagagctctcgggggccctgggctgtggcactggggcctcctccgcggggtggcgccttccgcccctccccgttgggcggcctccggcaggccccgttcctccccgcgaacgccaccgaggtgcccgcgatgggggctccgccgattggctgtgcgacgcgtcgctccgccagccccgccccgcgggccccgggggtactaaccccgcgcgggcggccgcggccccgccacttgattctggaggatttgttctggggctgcggccgcggagtcggggcggccgcgggcgagcttcggggcgggaggcggcggcagcggcacagccccgcgcgggccccgccgcggcccaggcagccgggacagccacgaggggcggccgcacgcggggccgcgcgccgaggatgcgggactagccgggcaggctgcgggcggccgtcgggccagcgaggcctcgcagcgggcgggccctggcgagtagtggccgggcgccgccccctgcgccttgaggcccgggccccgccgcttctgctttcccgcttctcgcggcagcggcggccgaggaggcgcccgcgccggccgcccccgggggaagccgcgccgtctccgcctgcccggcgccctgacggccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtgagtgcgggacccggggcgggagggcgccggccctggggctccgggcgtctgagctgcgggagccagagcctcgggagcagtggggatgggaggtgcccgagacgccgcggcgacacccgggcacccggttcagtctggctgcgcgctcggctccgggacctcggcgttccgttttggatgcgccctgcaggaatgacttttaacggggttgccccgctccacctgggttttggggcgccttgcgtagagacgttggtgcggaaatgggcggatggggttttgcgcccccctaacccggatcgctcagatacagccctgcgggtaacggagaagaggatcccgggacaggggcaaggacaccgcgggtggggtgcgaacggtgaaagggcctaccctccgcctccagcacccctcctcccgcgccgcttcgcaaaagcttcctgctcacaccctcgggcttccgaaattttaccggacggcgctaggccgggatcggggcactgctctccagacgtttgctcggggatattatgcgtcccgaatggcgagttgagattgggggacccctaaccctggcagcccccagccatttagaggacctttttctttatgccagggagtaggcgactgtttcattttcatttttttaagggggcagcgagatgaaacgaaaacgcctcggttttcccctaaacctctcacagctgccgtgagaaaagggcagggcaggaagggccggcggctgggggtggtgctgcccgaggtggctggaagctgaggccgtccctgctcccattaagacgactctaaatgggaaaaaaaggaagagtggctctttgaggtctcccgggtgacatcttaaaataccagtgggggaaatctcgccgggaggggcgggaggcccgtgtgactttaatcgtcagatcggaggttttactgtcacttggagcttaaaaggagtctttgaaattaaaagaagacaggatgttgacaggaaatctggtcttcttaatcagatcccaaacattttctccttgaaatttttaccatatggatccccagtccctgcacgcggcggccacgtttaaatagttgtgactctgtttaaagtctgattctttttcaaaaggcatccgcctctccgtgctcctgggggtgggggatttgggggagatggtgtttagggggacatcgccacccccatcctgcaattcccggcaggtgcatccttccattatcaaaagccccactctcactttaaaggggttttctggtggcctttttcaaaacaccagtgagttttgcattctgcattttctctgcataacgaatttaggctctgcagaggccaataaactgggcctggtccacatttcagggccaaatttcatgccctaaacagctcttgcataaattgagtgggggtagcagccctgttgttattattgttgttactctttctcatttggagacttcgttgctaggagcatgttgattcctctttcgctgcagccgaagacaacaggggaactgcaccccacatcatagtgactgagctgattcacagctctggcttagatttcattgaaaggatgatttcttgggacacagtttatgtaagcagttgatctaggattttggtgtggaagctcgagattccatcttcttgttttcgtgatatttgggggaaggtctttattgtttttaagcctcttctccaccctgcattggagaaatactcagtgtgcctgggacctgggggagctgcccagcccagcccctcccctcctttccctggtcaccctcttcctttctaagctgtccccctgcatccccccgccccgtgtcttcaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgaggtaagtggaagggaggcctcgccatttcagcattggcaatggcaggggcagcagggaaggaggttgaaagaggggccttagaatcccgaaaaacaggtctccagatgcagctctgtctaaaaacagcaatttgtaatcctgtaggatattacagatcgctttgaggaggtgaggaaagttatggtctcttgccagaaaaagacaattttctcccagtttctagggtttaccaactcctgaaaccgttcatgccaccccctctttcccggttaagcacacctggtctcacaaaaaatgctggcaggagatggtggattaacaagctcaaaaagggagcttataggtctttcagcaaggcggttgcaggacaagtccctgatctgtggggcccaagcaccccagccactctctccatagggggcagaatatcccccacactctgaggctgtctctccagctgtggtctcccagacccagtttcccagcgcctttgagccctaggtggtctagaacggaagctaacgcagctgaatgttggaaagcacagctcgaaggctgccatctcctgccccagagtcaaggcgggtgtgccaccctgcctgtctgaccgaccttgagcagcagaaggaaggcgggacgggggtggggggctgttgaatgggaggcttctgggacctgaaacccatcatcacttaactcctggatgggaaagtcctggaaaccctgcccctgtggaacggaggcctgagggtccactggccctttaagaccagcctgcctacgagaagtggctgaagtgggagtcgcccttcccaagcaccaggcccgcctctagctttgttaagaagtaagctgggttccctctgctccccaactccacagcaggctgaagtggctgaagcagaaccgtgcttttcatcaccaataaacaggaccttctcaaggttctagttccctctgagctgccagccccgctctgaaacaggcatctgggcaccattttttcctttccagccgttcgatgtatacatacaaatgtcagccatattttgacttttcagcattaattaaaaccaggacattatttgcatgtaataactgtttacttgttactttttatgaaactgaaatagtttacattctttcaaacatttcctgttcctgttggctcccttccccacacacagatttctttcaaacggtgcccttaactggttgcaggttgatggatggaaaatgtttgcttttatgaattaagctttcattgctgctcctaattagtctccaagtcccttttgtcatccccaatctctcaaaccctttgcgacttaatcccaaccctgagaggacagtcactggtccttggtcggtggcagacaaggctgatgagctctgctgactgcggggcagtggccaggtctgctagcccaggtatgtgtcaggagcactatagctgctgcctgttgcgaggcgggcagaaggtgctgtcgatctgggagcccagcaaggcatcaggaacttgattctcccttcccactctctctcctgggaagcgagagaaagagaagagacgacgattttctgagttaccgagaccttgtctggccattctgcacactgagaatgatttttttaggggttttcatgcccacagaccttgagcccccctccccaggcctgcagggagggaaatgggtttccaaggcgttggttgggagcttgtccttgtagcaggaatggccgaggctgggactgtggctctgggagatgcaagaggctgagtttataaaccattctctcatccatctcctctcagaggtccataaccagtctcagtggtcctgggaggcaggaagtgatctgaggaggagttccgatgtctgaggaactgtggctaaggcgttcagccttcagaggctcgaggtctttgagagcctgcattctagtatcagccaccctgcgtttgagtcccagctctgctaatgacttgctggatgacattgggcaaatgacttaaccactctgtgcctcagtttcctcatctgtgagatggggatgataatggtacctacctcatgagattttgggaaggttagggaaattgacacaagtgtatcagctggcgcatattgagagctggatacatgttagagattttgttacttcaaatgcctgggactggaggaggactttgaggtccctttgagcggtgacagccactgattctctgattactgtgtggtttgggcgggggtgggggaaacccagaaggtgtgaactgctgagtgggagaggtggaggcggttggcagggaggaaggagggtgccgggtccgctggcatgcagacacacatctgcagtgcccatcctgctgactgggaaattcccacctgagagaacagtcagtggttgacagtgacaatctgggccactttaggagatgggacactttgggagttaagactgggggttgggacccagaacccttgcctgggtctcttgacttctgccagaactaagaagtctgatggaaacctctgcttgttgcctcaatttttagttctacattctgtctgaattccaggaagatggctttccatgaaagacatgcacccagtaacaccacagagctcttaacaatagggctgaaggtgtgaaccaagaaaaggaagggaggaaaaccaggtcattgctgtctcctgcagtgattagggctgaggtccctgccctgccagacatgaggagcctttcttacaatacatattttatatcaagccttactattctacgttgaaatgtataaataatgaaacctacctatttacatgcagttgcaaactatgttattccatagctatgatggagaaaaaaagggaaagtaatttataataaaacactgatttgaatatgtaaacgttggggccacaggactccatgaggtggacgaatgccctccatgcagaagcccacagcagagggaacaggcagggtggcagggctcaatctgaacctggccttgctgccaataccatgactttctgaagttgtcaacacctgttggcaaagcgctgaacaaaattaaaaaaaaaaaaagaactgtctttccttctggaaaattcagtagatattaaaagtacaaaaaaaaacccttgttttatgtaaaactgagttaggttcatgactcagataatttttttttcttttacttttttttgggacaaggtctcgctctgtcacccaggccagggtgcagtggtgcgatcactgcagtctcaacctcctggtctcaagcagtcctcccacctcaatagctgggactataggcatgcgccaccatgctcagctgattttttaaaattatttgttgtagagatgggggtgttgttcactgtgttgctcaggctggtcttgaactcctggactcaagcgatcctcctgcctcagcctctcaaagtgttgggattacaggcatgagccactgcgaccagccagagaacttttataagcaagtttttccctcccaggaagaattgaatcttcaccaccctgggcagcgttgggtgctggcatcccccaccacatacacgcaccccacccctaacgctggcagtgccaccccaacactatgttgaccacacgccaccacaaatcccaaaaatgcccctctagcaggcggccactggcctaagtgaaaatgaaaagcacatgagctctcgagctgtgatcaactggttaaaaagcaactgtgtgtcgacagagattcggggtgcagtgtgccggtgcaggctgaggggaaccgctggttgggggagagatgaatggcttcttggctgaagctgagaaaaccccgaggtcccctgagactgagacacgtcccctccccccacccatgcagctcctgtgggtggggcggggaccttatacacataggaacccaggcagagaatgctcaaggacttgcctgaggccctgctgccaccccggctggttgatgatgggtcctggaggagtttctggagccctaaaggaaacccatttcccagaccaagacttctcccctgcaaccagggccagccctcagagagcctgggtttacacttcctgggctcctgatggattgcaggtttgcctgggactcctgcacagagttatatctagaggctgagagagagggatggatgggtttgccactgccaggcagagagagagctgggcagggccggggtagctgaggggcactcagggagacagctttctcccacccctgctccccaggctccctgtctcccgaggtccaggactcctgcccctccctctcactcctcctcttaggccccacactcctctcctttgtacctgggaggggtggtgacaggcgtggaagctggtggaagcggccgaggagtgctggtgacctcaggggtggcatgtggtttgctacctggtatgggtgggggcttctcacttctcaggagcgggacgttagtacctgtgtgcaaaatgggagccattatctctgcccttaatttatttaacaaatgttgttgagcacctactctgtgccggatgccgtcctaggggctggagacactgcatgaacaagacaaaaacttgggcccctggggaggttataatctagtagaaggagacaaaatgagtagatggattattaaaagcatatgcattgtgagaaaattccagcaggtgcagggaatagagaaagggagtggtagggcctgtgatacttcaggttgagctgcttagcgctttttttttttttttttttttttttgccctgtgggcccctctgatagctggtgaagcccgcacacctttctcagaacaatgatatttttaaggtataaaatcaaatacaaagtattacaatagaaaccatttctattaaaacatagcaaaatactttaaaaattgtggtaaatgtgctgctttattcaatgtattaaataagatctagcattgggcctaatgacaaccatggttttgaagttgtgatgagcataaaagatatttagagcaatctgcagcaactgtaatgtgatatgtaagtatctgtgacgtctgttggtgacaaggtcacaggtacggctgataatacctctgtggtttgttgcctacgctcgtacttgagagtgatgctaaatttcagttagaggttagggacaatacaattgtaattttttcctaccctagttctcaggctcattcaactctacggagccaagttaaaaatgccttccaggtgtagtggtttacgactgtaatcccaacactttgggaggccaaggcaggaggatcacttgagcccaggagttcaagaccagcctgggcacatagtaaaagcttgaaaaaaaaaaaaaagaaagaaaggaaagaaagaaaagaaaggaaaggaaggaaggaagggagggaaggaaaagaaggaagggaaaaaaagaaatagccgggcatggtggcgctcacctgttgtcccagctactcaggaggctgagacaggaggatcacttgagcccgggaggtccaggctgcagtgagctatgatcatgccactgcactccaacctgggtgacagagcaagaccttgtctcaaaaaaattaattaaaattaaaaatgcctacttcagataaagtgaccagggaaggcctgactgagaaggtgggcgacctgaaggagggttttagtaagctttcaaatgctgctgtgggcccggggccctgtggcagggcactgggacccattagtcctccgtgtctccagtctggcccctagggctctgggctgtctgcctaaactccccgtcataaccaagaaggtgctggacaatgctggcagggtcagaggctcagggaccccaggagagtgctgggctggttggaggagaaagaggtccagcagagaaatgacctcagagtgaggaaaggcagtaggaggggtcgggcagggagcccgaggcatctgcctggcacttccctagaccatctgcacttctgcttccagaaatcatacaaagtggcccctgtgacctgagagtgggagaccaggtctgttctgacctggggctccgggggcaagtgcagtcagaatttctatccctgcctcagccgactggcttaggaaaaggcttccagagaagcccctcatttcccagctggagtgacactcagtgggtcttgagctttaaattccccctggtgtctcagagggccttgggtcctgtggcatggctcctggcagcctggctggtttaattttgttccggattctcctgcctctggggctagaattttcacttgatcagttgactaacaagtacccggccatgcaaagagaactgtgagatactggtctccaccctgagcttcatctcccacctgcaacgtggggctgttgaaacctacctgctcactttggaggcgtgtcagggggacaccagagggatgcgcttgggcagcctctctccttgaccatcctgtgccagccctggggtacaggtgagagtgcgagaccattggcccctacccacagggagttcccaggcctgtacgtgggatccagaggcagggatagggggataaagtctggcttgggggatccgcaaatctcccccgctcccggccaccaatctcataaagcatgaggctgtggatcgtaatagagaatagggtgagaggaggactcttacccagacccccaaactcccagacacatcagagaattcactgtagaaagtagagagaagactgtcgaaagtaaatcttcataaactgctttctacacggagaaacccgtctgaacataaaacgatagaagaacgagaaatagaagtgaaaatgaaaaaccacccagcgtgtgaaggcaaaatgtgcaggcctgtgcccggggaaactgatggccacaaatacagcatggaaagtattaacaagcttaatatatagcaatttttaaaaggcactaaaaccttcacaggaaagtaaaagaacatgaagcagtaatttgtgttggattatgatggataataatcatataaaaagtttcattctcactagtaatagaaaaaaaggcaaacaaaatcaagagcgtgtaaaagatcttccatcttgatagacacatccctggggtgtgacgcagcctcacacgcgagggtgacgactaaatctctccggagagtcatctcactccaagagggatccgcgcccgtaatatgtcccaaccctctgctgccgtgaaatcactcaccgcttcttggaatctcttctaaggaaataagcagagatgcagacaaagatttttataaacagaaggtcactttcattttattttaaatggtaaaaaaaaaaaaaagtagtattttaaaagttttttcccctctcaggaattttgaatggagactttggagccaaatgtctatctaaaaatagaacattctggaaataacagttgtgtctacagaagaaatgtctgcagctcccaaatcagtcctttttcagctccagctgcacacatcaataagaaattagcaacgatgtaaatacccgagagtaaggaggtagataaataaaagatgaggaggcttccttgagttgaaatattttgcagccattaaaaacgaagtttatggagttttaatgacgtgggaaagtgcttctgatgtgaggttaaatgaaaaaaaaaacagtatgaaaatctgtattttagtaccactgcgactgtgtaaatatacaaacccatacaaaaagagctgaaagggaaaacaccaaatggtaacggtgtctatctccagctagtggaaccgtggggggggggtgtcttttcttctttatttatattttgtatgttcttgaatttttctacaaagatcaccaattactttcagaaaatagaatatacccatcctgctccccaccacaaaatcgtgtgggtctctgaatagaagagacagcagaaaggccaagaagaggggaacatgagccagggtggtcacggcatggggcggggggttgacaaagttggcgtcagacccccaggggccttgaatgccaagcccaagagcttgaacttcacccagagccctatcttctgcccatgttcaaagaggacagagtgccccttcttgacagttaggggcttccaggggtagatacaggtgggagagcagggtattgtggaagctccaggtgccaaccacctgcctctattccccactctccccagggaagagtttcaccctgaccatcactgtgttcaccaaccccacccaagtggcgacctaccaccgagccatcaaggtgaccgtggacggaccccgggagcccagacgtaagtgccaccgagccccctgagcccctgcgcgggggaggagggtccagtgcgggaaggacagcagctaggtcagacagatggagccctcctcggggggttgcagtccttggctctgtgcccccacacactgcgtgcctgctggcaaacccctaaaccctctgggcttagcctgagaccgtgggaggccagcgaggaggctgggagtggagatgactgtccatggagactactgagggagtcaaggaaaggaaaaggatggagaaagctttcagatatggcatttgtcgggtgcttgtgtgtttctgggtggaggttgagccaggcttgctttactctgcccccagcttctctgcgggtggctgagggatgcatggagggcaggagtgatcaaaagtcaggggctggtctggctgtgaggccaggcctcttccttggaaactgagtctttgaatcttagcatgtgacttgctcaggtcacccagagtccgggcacccagaccctatgagcagggagttctggtccatcaaagcgagtttgtgtttaattctctctgcttgctgaaggtcagattaaggctggggaagtgggagggtaggctgaggctctgtgtccacagaatgaatgaatgactgactgactgactgactgaatgaatgaatgaatgaatgaaatagagccagccagcttcctgagctccatcccacctccccaaggcattttcagcttggtgcactgaaggttggcccacccctctctttctcagaaatgtgaccctttgtagtttagaagaccttttagcagtcactattgaatgggatcttgatgacagcagagccagaggggtcacccaagttccagtgaggagagaatccaggcctgagggagttgggtacctgaataggacctaatgctgtgcaaggagcaggaaggcgccccaggcttcagtcttcccagaggcaagattctaggctgagcaggcctggggcaggaggcctggggcaggaggcctagccctgggctggcccctcccttcttgggagtcagctgggcctgacaccccatcatccaattcctgggcccatcccagcatctggccacttgggaaaggcttggagctgagtccagcagccctggaagagtttccctccagggctctcagggtcacctctgccagccctgagccccggcacgcatcctcaggcctgcaccgtcagctcccagccagcacttgccctggccacactcctgctggttccctcctgctgagatcagacatagaccagcccatgcccttggccttgggcttcatgaccctaggcaagtcatgtcttctttgtggcctcagttttgtcatctgagaactggatcagtgactccaggagtctcaaggtggtgatggctgggaagccctcatgagccatagaccaccatggtgtagagagcagtttccaagccagccttcctggctgtgggtccttgggctagtcatctccgtgcctcagtttcctgaactgaaaaatgatattcgcacaagcagctacctcatgatgctattgcgaggaaacagtggcttaatctatagaaagcacttagcggtgggggttagcaagggatccgtcactttagccagggctgttatctgcagtgtgacctagggcaagtcactgacctctctgggcctcagctccctcctccatgaagtgtgatgatgccacccaccctgcggacctggagatcaggggcgacatgtggacagcacgtggccgtagcacagaggggtcccatgagtcactgggtccgcagcgttttgtcgtcctcagtacccagcccccttcctgcactcccaccaccaccattagtcaacggtgagctctctcatgggcagcagctgggtggctgccttggtaatagaggtgcaggtatcaagtctccattgaaggaggtggcagccctgccctatgtctccaggggcagggtcagcatggacaggagcctcagttgggctctgggtggggatgcggcactcagaagccactccagaaagaggggagccactccagaaagagggaggcacgggacggggtcttgacgcttggtgggaagatccaagggaccgggcaaggttggcccctctgagagccctccatgctcagcccagcccaccccagagccgcccactctgccctgctgggacccctggatgagcatggagactcagccctgcctgtgggagattccagcagaatcccctgcctgctcttccctgcctgggtctcccagacctgagatggccccttctggggtgagctggaaggtaaatgcgtggctcaggacgaggcaacaagagggagggacagaggctgggcctggagacccacggcgtcagaagccaggcttgctgcaccacctgagacaggtgacctccctctctgggccccggcagcggctggatcagtggttttatttacagaacagagcagagatggagtcggggggcagtctactaggtcccccatccttaggacctgcctgttcctgtccctggcatatcctggccctgagatcaggtccccccccataccctgggttgcagccccactcctttgtctttggccctggacaaatccttggcctttcgggtcctcagcgtccccatctgtaagagtgaagggaccagctcagcggctcctggtcactgagcaaccccctcccttgcgtcaggccctgtgcaaagtccccagtaactgatctcttgggcaaccccaggagaggatagaggccagggcgcaaaaccttttgcccaaggtgactgtcagcacaccctgggggctccgacccgggggctgcgggaagtgagggccacttggaagggccttttcacctcagtgtgctcagctgtcaaatggatggtattggtgtctgcctaggggagtcgctgtgaaggttgactgagtttaccggggcctggccccaggaagtgcccccacaaccttcacaggttgttacaggccttttgtgctcctggacttcctttcccggcttttttcctgttttgccacctccgaccctctgaaatctgagcccgctgtggggtgaagtgggagtaggggctggtcctgggagccaaggactgggaatctgtagatccctgaggccggctgtgggttctgtggccgggtcgttcccctctggtgccctgcagagcgtgcccggcctgcagccaggtggccagctgggtttgaaggctggcttggtggcttcctgcctgtgtggcctcggtttctgaggttctcagtgctggtgtccctcagagtcactgggggctggttaagaagcaggttgctgagccaggtccaggatcccagcaggaggggcggtgacacctggcaagtctggcatggaccacggtgggggaaaggccctcacgcccccctagcctgtgcccgttaccccctgccctccctcccacatcctgctctggccaccctggtatcctggctggtctttgaacttgccagggacactcctgcctcgggggcctttgcactgctcttttttctatctggaacactcctccccggacacccccagatgcatggcacactccttcacaccctaaagcctctgcacttctcagcagcccgcctgtttcaagtggcacacacacagccttcctcacctctcccccttttccttcctggctttaaggttaccccgagcacttaccactaccaccttctaaggtgctatctagtccgatagtttgtttcatttgttattcatttctcccattttgttttgttttgttttttgagatggagtcttgctctgttgcccaggctggagtgcagtggcaagatctcggctcacagcaacctccgcctcccaggttcaggagattctcttgcctcagcctccctaggagctgggattacaggcacacgccaccacacccagctaatttttgtatttttaatagagacagggtttcaccatgttggccaggctagtcttgaactcccgacctcaagtgatccgcccacctcagcctcccaaagtgctgggactacaggcgtgagccaccgcacccggccccctgttgtttatgctctacaagggcagagttctttgctctggtttgccaggccctggtatagctagaccctgagaatgtgggcaggagcccttcacagctgctccataaatcgttgatgaataagcaaatgattcattaatgtcatttcgggtagtaggaagtcctatgaagaaaaacaaagctgggagaaggagtggagcgtgcaagggatggaacaagggatggggcggggaggcctcctgaagaggtgacctttgagcaggggcctgaagtgagcagccagcagagtgtggctgccgagggtttggcgtgggcaggagaagtgaccctgagcccgcagttgggcctttgaaggccttagagtttctgtagtttcttcctgggctgaggagaggcagctgctccaggtccctggctcccaagatccccacaacccccaggagtgtctcctgcgctaggggcagggctagcggagtctgcccagcaggagggaaggggttaaccacagacctcccgggttctcctaatcaaccccaggccgctggaagccccacttgcagccctgggagggaaccgctcgcctccctgcccgctggcccccggccagcccgtttccctgcccagccaccgacccggctttcatctgctcacagggggccgattcacagcagaccaccccaggcccggcacccgcctgcgattccgcgaggctgttaagagtcgggtgtaaatctcctgacaggccgcagagccggcctcgggcccggcgccccaccctgctgctgggtagacagtggctgctgtgtctgggtcacagccgcaccaggcggccaagaaggctgccgagtggcttcagatgggtgacgggcctggtcattggagcccacactgtccccagcagacgatgctgttcctgtggccctgcccgactctgcttttcccaagaggctgaacactgagctggcctcttgccagctggaccttacggccaggtgacccagctcttctctcatggaggtcttgggaagcgatgaccttagcagctgagctccatgtgtgacctttccaggtttgaatctcaggggtgccacacaccgtgtgaccttgaccgtgtgcctccacttttccatctgtaaaacgggggtgatagtcacagcctgtcagagggatatgacccttggagacgacatgcatggccccccttgcacagtgcccggcacatcatggatgcctgctaaaatggttgccactcctatgacaggggcttgtgttgggcctgcatggaggcaagggggtaaccctgatggtctcttggttcccccagaagcatcaggtacctggcgggggtaggaccccaggctggccaggctggtggtggggaaggattccctggggacagtggtaaaggagctgccaacccagaatccagccctggtcctctagctcccacactgcgtgaccctggtgagtccccagactggctggggcccagcattcctgctcccactttggcctttatcatatgcctgtgaggtgggtcacccccactgcacagacgcatcagagaggagctgtttgcctaggagcagatggccaagtcagaatgggaacccagaacaccttcctcaaaggccaaggcctggtgggctgtgtaattcttgaaacctttcctgaccctcgggggttagaggtgtgatccccattttgcagataagacagctgaggcccagaaggcaagagtggcttgcccaagacagtgaccactggtgggtgagagctgcctggtatgagcttggggccactgggcccttgggaggggcaggctgggatctgccctcccataagtgagggtcatagacactaatccaggccatgctggaggagctgtctgatctgagcccagcagctggaggctgacagcagccaggacaggccctgagggccaacgcggggctttccccagccatctcagtcctctgcttttaaaagcatgtggcctgtcctccagctcatcggcaccctcaggggttagacagtatgataaccactttacagatgtggaaactgtggcccagaggcagagagtgacttggtggtctagagcagggtatgattggaaattgcactctcaaccctgagcttcagagcagggaagggcccctggtggagtccactgagaccttctcatcttcctctcccaagtcctatcctcctgggcctgcagatagcagctctgggcctggggctggacggggccctaacatctattgtggagtcccgatacatctattgatgtatcgaacccaggctggctgtgaaccccgccctcttccgccacaatagatgtgttttcacaggctctagggagagcaggtggctgtgtgtcttctgcttgaccttgagctcactggctgtccagagcctcagttttttcacccatatgataggatggtggcagacattactcaaggggatgctgccaggcgaaacaagatggtgcttgtcagctgcttagacgctgccgtggaggaagcacccagcaagcatctgctgccgttttgatgatttccactcctgctggcgactgctttaaaggacagccctagcctgcagaggtgtgatggggatctactgtgggagaaggggggcttcctggaggaggggctcctggactgggcttcacaggacagaaagcattgctggcagaggctgtcctgagctgaggctctgaagagtggggggcagagaatattcaagaaatactgggaacagcagcagcaggaagaagtggtagtgggtgggccctggggccagcagccctgccttcttttctttctggggcccctctgaccagcggctgatctttgctaccttaaatcagggactttcaaaaggaaggggcctcagtgagcagactgtgcagaggggaaactgaggcgtagcaggactgggcccaaggtgacggagtgggttagagccagagctccccacgcagctcttgctctgggtaaccgaatgaaagaggctttttctgaagaccatcttctttcctcaggcactggaacttctgtcctattcccagtgtgagagccctggccctgtggctctgagactctctggcgccctggccacgtggggccgccttggctcccctctcccctccctggcagtggctccagcgttccacagtaacaaggaagctatttccgaagtgctgttggactcccctcctccgggaagtctgccctacggagggcaagggagcatgtggtgggagcgtgggttccggggtcagattacctgacccacagcctgggtcccggaacaggcgctcagcgtcggtctcatggtgaagcctcggtggccccgtctaaacaatgggaacaaaagggaaagtgtcaggaaaagagccctgggcttggagtcgggggatccgggtgtgaatcctgccttgctgctcaggctctgtgttcctcacacgacttcagcatcctggcctccacaccccggtctccagcatggggatgatagttctgcttcctttgggcatgagcagagataaaagcgatggtcatgatggtggtgacccacgtgactggaaagtgtccacaccttaggccagcacctcaacccacaaagacagtgtgatggggacaccgcagctcggggtgggggaaaggagtgtgacttgagtgaggccaccagactgcaagtgacaggacccgtcctcgaacccaggctggctgtcaaccccgccctcttccgccaggccgcaggagtaactgtaaacactctttgtacatggtgtgactcagaaacaggggactttattctcctgtgacgaaagtaacaaggcctgaggttttgcaccagccctattggctcccttcaagcttgtggctgactaaaacacccagatcctttgcactcaggctgttgtcggatcagtctgtggtccccacgtccacccggcaggcttcatgcctgttaagattcttctgctcacttgtcccccagctcatccacatctccctgccatttccagtggcctcaggagcaaggacaacatttcctccaaggcctgttagggctgaggactcggtctggaattggaagctctggccgtactgggcctgccctcctcagggtagcagtcaggtgctttccacaaggcatctcctccccatccgctccaggccccacccatcccacttgcctcgttcacgtgacttgccccatccccatgggcatctgagtttgcagccccagctccagctaaactcgcccccagcccatgttttcccctttgttgccaagggccctgggaggcagcagtgggggcctggccagagaccaaatggtcttattcctgccaccaagtgtcccatggattcctggtctggggcctcattggaggagaaggtggggctccctggttcttggtgactggctgagcccctgtggctcccaggccccctgctttctttctgaggctcccagatacctgtttgagcttccaacagggatgcgtagggagcttgggggcctacaagtaccagaatccattgcgttcccattctgaaaatcagaaatcaggcccatgcgaggcctcgggctctgtcccctcatgccctacagtggtcgacaggcttttcccacttttcgagtccccagcaatcacttgttcaggccccaaaaagcgcagtgagttctgttttacctcccacctacatcttgcctcttctccctctgccaaactagaaaacgcacatgtcattctagacccaaggccttaggcaaaccttctcctcccccttaccccctcccacatttttttttttttttttttttgagatggaatcttgctctgtcacctaggctggagtgcagtggtgtgatcttggctcactgcaacctccgcctcccgggttcaagcgattctcctgcctcagcctcccaagtagttgggatcataggcgcccgccaccacgcccggctaatttttgtacttttagtagagacggggtttcaccatattggtcaggctggtttcaaactcctgacctcactcaggtgatccgcccgcctcggcttcccaaagcgctgggattacaggcgtagccaccatgcctagcctccatcttttctaaagggtcccaggtccaggaaatcccaccccttgttcggcgtgtggcctccaacaagcttcctcgcctctccgcagttgcagttctcttacttgtaaaagagggcctggccaccctgcctgactggcagcctcccaccaagtcacgtgaggtagaatggccgtgaccgtgttagggttgatcagccgaaccctggagtgcacagtcctccaagggagccgtcctttcctcgggtcagccctggagaagctgcagccactagggggtgcgaacagggacgttcccgggagtgttgcatgtaagggaactaaaggggaagcttgagaaggactgaaatgtgggtggagaggactgcggagtgaactgtgcctccagtggccagcaggaaagagggagagcagcgtcattctcgccatgcttgttgaatcccttccgtagcagggaggatccccagggttttatgggaactccgtcatttctgtggggctggattactgtccccattttgcagatagggaaactgagtttgagctccaaggtgtgctactaagaaagcaagttacagaatgacacacccggactgaggctgttcaagagagttccatgagaagcctactttgcgttttccattcatggaagatgaaaaatgtctggaaagaaactggtcacggtggggactctggagaggagcttagagcggtggacagagccttatctgtaatgcttttatttttgtaaatattcacgtgttgcttgtgaaatgtaaaattagtaattaaaaaagtgtgtgtggcgggggaggtccctgcaagcttgatatcactccagaagtgtccctcggcctcagcaggccgcaggagggtgggagcctggccaccttgaccctcccagcacctctgagtcctcggatgtgaggctgggattcttcctgtgtgggctctggcagatagggagtggaaaatgctggcagttttctccaggtgtgacatctcgtcccctgaccccagcttccaggcagagatggctgtctagtccctcatgcaagccccctacacctctgcccagcatcctggtggagttatttttctgcctgaggcccagagagaagaaggcatgttctggggatcccagagtgacttagggctggaaaagcctgcagtcccctcctggggccacctcccattgttcttgtagacatgggagacagtgtgcaaggcaggctgggatgctgggaggcagagggtggcagtgctcctgggttatctccctgcctcccttgggggcatgagccactttctcatgtctgttgcctcagtttcctttttttagatctagggtccttgttccgttgcccagactgggatgcagtggtacaatcagctcactgcagcctccacctcctgggctcaagtgatcctcctgcctcagtcatcccagtagctgggactacaggcttgtgccaccccacctggctaagtttttcttttttcttttttttttttaatttttgtacagacaggggtctcgatagttgcccaggctgatctcaaactcctgggttcaactgatcctcccatctcagtctcccaaagtgctgagattataggcgtaagccactgcacctggccctcagtttcctcttctgccaaacagtgtgttgtagaggtttggatcaccgtgtgtcgtagaggtttggatcaccacatgtcgtagaggtttggatcaccgcgtgtcgtagaggttcagatcaccgcgtgtcatagaggttcagatcaccgcgtgtcgtagaggttcggatcaccgcgtgtcgtagagcttcggatcaccgcgtgtcgtagaggttcggatcaccgcgtgtcatagaggtttggatcaccgcgtgtcgtagaggttcggatcaccgcgtgtcgtagaggttcggatcaccgtgtgtcgtagaggttcggatcaccgcgtgtggttgaggttcggatcaccgcgtgttgtagaggtttagatcaccgcgtgttgtagaggtttagatcaccgcgtgtggttgaggtttagatcaccgcgtgttgtagaggtttacatcacagtgtgttgtagaggtttagatcaccgcgtgttgtagaggtttacatcacagtgtgttgtagaggtttagatcaccgtgtgttgtagaggtttagatcaccgtgtgttgtagaggtttggatcaccgtgtgttgtagaggtttagatcaccgcgtgttgtagaggtttacatcacagtgtgttgtagaggtttagatcaccgcgtgttgtagaggtttagatcaccgcgtgttgtagaggtttagatcaccgcgtgttgtagaggtttggatcaccgtgtgttgtagaggtttagatatgtggggtggcacataacgaccattctctgttcagaaagtcttttgacaacctctgtgaagaggctggcggtgacctcagggttctcccagcagaggcctaaggtcagacctcaggaagaacttcccagcagagtgaggcatttctgtctccactgagactctggggaagcaacggctgatgggcttcctgtgctctgcagggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggtacggcacggagggaggggctgcagcggggtgaggtgggggtggagggcctcgatgtggtccaatctgccccagaccaaaagcctgtccgaagatcagtcactgcacccccttgttttgtagaggagctgctggtgctcattggcacctgcagacggttcctgtgggctttctgtgtgctagccatcattcgttcactcagcaaacactgacattactgacacatgcctggtgcctggccccagggatctgcataccaggagttcactgtgcctggggaaatggggttaaccccatagtgcccctattaaaattggggcatgacttgtccaaggagccgtgacagactcgcccctgccatgtacagtttccccacccctgccccacagcctgcgatttttcatctgaaagtggattggggcggatgcctccacccagggctgggatgacattcaaatgacattactgtactcacacaaactttgcacactgttaagtgacattccaaccctagagaggcacatagcattcctgggaaaggtctcccaccctgcccagagcatcctcccaaacaggaggagctgaggtggaagggaagaccgagctggggtctccatctccactgcctagacggatacagcaagcacagttgcagccaggcctcaggcaggtcttctggagtatcgaggtgcctggcgcatagtagccgctcactaaacggctgccggctgcatctctcctctgttctctcagtcagtgagctggggacatgggaggctgtgtgcacagccggcccttgggctaagtggggtgccaagggtgcttggtggccgggtggacagaggcaggcagctggctgccgtcacggactgtgcccattctttctcaattccccagagcctggttagaaccccttggcagatgaatgaattgagaggcctaagaggttcagagccaccctcgggtcacacagcccatctgtgaccaggtccacagtctccacagtacctgctcccaagaactttctgtacttctgaggggacagataaaggggcctggaacagggctgccaaccggtctgcctgccccacccccttttccggtgccacgctgaggtgggggccgactgggtctctctactgacattgttccaggcatagtgctgcagccaggggctggatgcaggccttcagtgtgaagagaggacccctccccttctggcctgggctcaggacttttggccttggtcctgctgagacgccaaggttgggagaagccccaggcccagcctctctgagcccaggagctagtgcatttgagactctcagctctcgagcccaggagttggaggtctgctctcaagaggtagcggaaggagccctgcacgctgtgctcacgcccacccctgccgcgtagctgcctctgcttctgctacccatgggccagcatctgtcgaggtgcagtagcctgagagccagcctttctctgccatggacagagccaggccaggggatcggggctcagcgggggagccagaatccaggaggtggggtgaacagtggcttcctgtccaccagcccccatggaaggagagcccacatctgcccatccactgctgggtgggcacagcttgggaatcaatgcctggccccacggcaggcacagctgctgcttccatcctgggctgggaggaaaggagcccagcctgtgtggggcagtggctgacttctgcttctctgcctgctccctcctgaggcctggcccagtccctcgctagccccccacagcactgggccacaggcagccaggcatctccatcctcaggcccatcccctttgggtgagagaaagggcctcggatgaccaggacagggcgagcatgaactctgcagtcagctggaccaggctaggaattcaggctctgccaggcattggctgtatgatcttagacaagtcacttaaactcagcctcagttttctcatctgtgaagtggggagaaggaggtccctgacaaagaggggttgctggcagacctaggcttgggaagtcactctcacaggccctcctccctctgccctcggactccctcctggggatcccccttgggacaccccaccaccacttccctcggtgcctgttaagtgctttgaccctccaatattggtcactggcaagcagtgcagagaccccagcacctcccataccccagccccagcccccagccgcagccgcccacaatgggggcttctcacagctgaaagggctcattcagccaccatgcagcagcccggacaatctggagaagaaaataaacatttctttccactgttgggattggccactcgacagtgccccgggcagctcgggtttcctggggctgcgaggccgcagggtgggggtacaggagctccaaggaagctgctggggggtctgagggagtgctgagggcaggtacttcccccaccaccccggaggaggggtggtggccctgaggaaagaggctggaggggatggtggcaggtccagggaggcccagcccagcgccctgcagcccgcgtgagctctgaggggcacagtcctgccgttgtatcctgcggtccccatttgtttccttcgtcttgagaatggggttcccatcaggcggccagcacccacttccaccccacccatctcagctgtgctgacgtgcccagcacctgcaacaggacctctccccccgaggggctccccagatgaaaactggcagccaggtgcctcggaggctctcggcctcaaggggccgggacagccaagtgacctactagggaacatcccagatgtcccagaaggcccccgccacccagactgctgtccccacatcttcttaccttaagccaggagcatcactccgttcggatccacgcccagggccagagtacgctgctgagggaaacataccccagctgacttgggaagaccccaaagccccgagaagttccaagtcccagccgaagtcacacacacctcaggctcatagctctccgtcctcagccaagcctcggcgtggcaggcagagcccactccggctagcaccggcccttatcctttggtgggtgacacagaggggttgctgggctggacagactgcacctctggaccactgctgggggctcatccacctcccccggctgccagagtagaagggaggccctgcaccagggcctcaacttggcagggccctgaatgagccagttctcctgggtacccagagtaagagacaccacagccacagtggccttgcaaagcctcatggacccctgctctgtgcccagtgccattctaagtactcgatgtgaattaactgaatcctgatgaactgttatcgtctcatgttttatatggggaaactgatgcgcagagaggttaagtgacttgcccaaggacacaaagctagtaagtgtccaaaccaggataactgtccggctccagaagccacacagtaagccttgatcctgtgctgcctcaaagacgggacagctccctctcaagtacgtgttggggctcaggaccagaggccctaggattgtgtgccaggtccaatgtgctgtgtgaccctgagggaagtgcctcaccctgtctgggcctcagtttccccatcaagggtgttagactcaatccctgagcccctttgaatgctgaggttttgggggtctgtgatgacaaaagttggggacagaggatggaacacccttgccttggagcccattgagaagccacattcctgggggagcaggggcagagtctgggctggacactgtgaccaggttggggtctgggtccccaagtttgtctgactgctgtctcactttgctgccaaggcaggttagggtggcatccagtcactgtgtggccacgagtcggctccagagacacaggcccagggtgaggtggaggccagagctcctgtgaactcagtgcccacaacccaggtgtgagcgcacagaacctccgcgtgctgcacctgggcaggagaggcacgtgtgtccccagcagaggccttgtgatgagaaccagtcctttctctgccacagagactcagtcttgctctctctctgcctccattttcttgtcttcaaaagcgggttccaactcccagtctcacacggtcattggagccctttacacatccacggccttcccagctgttaacatgggccggtggggagaggaacctgcctgggcagggctgctgggaggcctgagctgactctgccctcagccccaccaccgcatcctaggcctctcctctgcgaggctgggaaggaggatttaaaaagaagaatagaccccctcctctgttctgttgctgctgtgggggggctcccatggcccctcttggcccggggcacgctccaaccagcttcccggcaggtctgtgttcggagtcctggcgggggaggccccgggcagcctagggcaggaagaggagagccaggtctagaactaggggtcccccagatgggccttgggaaccagagcccaaggtcattcttcaggaagccctcctggggttgtctcgagctggaactgacctcttccctgctgtcctccaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgtggaaggagtccagtgcccggtttctagggctatgcatggaggtggggtggggtgggggagaggatggagacctcctgctgttgcccaggaggaacaggaacagagacacccagcaccttcatctccttgcttccaacttcttcaggaatggccgcagagaccaccctggccacaggacagccggtgaggcctgctcctgtatggctgggaccccaggagagcatcaaataggtcttcaaagtgccacaacccttccaccaatcatgagcgggctgtgagtcttcccagccgtgttgggaggaattcctatgcctgttcctcagattcacatttcgggagggggcagaggcagagggagagtccaagtgccttggtgagaacccccctctgaggctcgtgtttcaagatctgtggcaagctagcagcagtggggattgggagtaagcggcaacttcagtgcccccattttgcagatgagacaactgcggtgcaaagaaggagtgtcatcaaggtccatgtctccctggggttgtccatggctgaactgggaccacagcccaacaatggtagcatgggtgtgatggtgtggggacctggcttgacagcccccctcccaccttgccagcaaggaggcctggtccacttgggatttgtaccaacacacagcccagagcctggccagttgggatttgtgaagggaaatttttacaaaacagaccttatttttgagtgatgcccaccgacttcaaaaaccactcccaaagctttgccctgctcagtttggttggtctgcctgaaactcagctcccaacaagaagcttccatttccctagcccggcatccccttttacccaaaagacagcaggtccatctctggacaggacctcagccgtggctacagaacttctctgttggtctgctctgggcagcctctgccagggttggtcctgaaacggcatctacatggccaaaactgtttctatttatttggggtcactttgtaggggatggtagcactcctcaccaggcacactttggtgccacagcagatcggagaggagctgtgccctccagagttcctgactcaaatctccatcacctgcaccctagcaggcacgaaccagcacacccagcttgccaaggggaaactcaaggtcccgagaagtctcagcttgcctgaggtcccagggctgcgggaggaagtgctgcagtagccacagcagcctgcaggtggcaatagggggcggcatccctgggcagcaggtggagagagtggacatcatcccctttggacaagggtgaggagaggctgccttggttacagcaagaattcaggtaaggtattaagaagaacttcccaacctcaggtgactcattcccgaaagggccagctaaaggtcttgatgtggggaaggttttcccttcccgagccgtgtggcagtgggaggtccctgtccctctctgagtctccctttttggtcatacgctgaatgagcaccggccgtgtgccaggtgtggagtaggaccccacaccccataatcgtctgctttgggacagggtgtacctggcttgaaggcagggttgactttcatagttttacaaccctggcctcctggaccctgggcccagccccacccatgtcccctgagccaccagcaagagcttaggtcatgtagaagccagttcagattgaggaagccatttagttccacagcctgggagcccctggactccagaattccgctttggaggctctaggagtcctgttgatctgggctggactttgagtccctccagtttcttcagcccccacagcttgaggttggcccagatgggcccaatgatggacccagagagccggctgtggcctgggggctcccagaagtggcctcctgtggggtgaagtggcccagatggacccgccttgccggcccctaggagcagccctgc

SEQ ID NO: 12353 - DNA, 8399 bp, Human
tggacttgaggactcacttctaacaaacagaagatggtgggagtggtggtgcatgacttctgagagtggcttattaaaggctttgtagcctcctccttgtactctctctgggattactctctctggggcagcaagctgccatgtcataaggacattcaagtagcccttgtggagaggcccatgtcgggaggaactgaggcttcctcccaaaagccatgggggtgaaaaggcctagaagacccaaaccacccttcacatgatttcctgagagaccctgagctcgaaccatccagctaagccattcctggattactgaccctcagaaactttatgagatcaaaaatatttattgccatttacatggctaagttttggagtaatttgttacaagcaacaaattctaatacaaaccccaatcagaaaattttctcttctcatcaaaaagggtttaaaatacttgtgtcatctcagcaagacagaaaatactggtgtaagcagagcacagaagttcaagtttccagcagagctgcagcatgaccttaatggagagaagtcatactctgttgtaagaaacagggtgaatggtctgcagccttctttagaaggtagcaaaacctccagtgcagcaaagctgataaagatgcacctgccttggatccaggtcataagcagaaaaaagaaacacaggccatcacagaagaaaatgatgtctcagagcacacagcacatgcaagcctttcggaagtgcagacagaggttaacagggtgagagaaaacatggaacctgggccagatgatgatgatgagttactagaaagagaactggctctggagtgagatacatccatcctagctctaacccatgggccaggtcttgcctgctctgaacactggtgaactcatttgtaaaggatttacatacggcctactcatagaattgatgtgggggttaaataagaaagaatgtaaagcagtttctttagttgaagaggacctggacattcatatcagaagaattacaaagcccatggtagacacgtgcataataaatgtatttgactttcattacagagtcgtttattcaagaaaaattattgcatttcttctgtgctccagacacggagctagaaatgcagtatgtacagagagatgaagatcttccctccacagaccttgttgtcaggtggggagagatcaacaattacacagataatcaaatatctgtgatagctattgttatacttctgaatgctgaagtcaacattctggtgcccagagtgggcaaaatttgggcagcagcttccagcgccaggcttctttctgagcgcatttcaagttagacttggacaaagtagcattcaatgaatgcctgattaattgaatctccaatactgagtacccactataaacagatgttccttttttaagaccttgttccacttaagcacagttgcttgcagtcattcaacgggagatactgaaagagcaattatagagggagagcctgaagacagcctgtcactgatgaggccaggccccagaagagggagggagggagccaacaggagtgcgcggggcggcagggggcggggggtggggtttggccctggaaagtgttgtaaaagaacagaggggaggctgtgctttcattgctaatttgaaaaacgctgacatttacaagaaacaaggaaatagaattatataaggaacaagttttactgctgtgaagaacatctgcatatgttaattggtacaaatcgtttcttgataagagcagagacttaggataatggattgctgccaactatgatcatacaaaaattcaatttttctgttcataagggaagaggaatttatttattatgtatctaagtatttattatttattatgtgtctaaatcctgggaaaataaaattcttttcccatcttctttataaaatttttttgacattcctcgactgctttacaaaggaagaagacagtgcttttaagtcttaagggtctaaagtcttcctacagattttcgtaggtgatttatgttgccatggaaacatgttaagtctccgttcaaaaatcttgtctacatttgttattgtaaaatgtttctgaagaagggaaaccatctccttcgtgcactctgatggaggcagtcactgaatgctgtcggttgccaagctattgtcaggaggtggttaatggaagtaggatctatagattaaaaagaaagaacaacctggggcctagagggttgcaagtggcatagagagcttctgtctccttttagaaggtagtggaagattgctttctcctggccagaaatgactgggccgagagaggagcttgaagatctatgtatgtgtacatgcttgtgcgcagctctcagtttcttttgtgtgagagggagaaaaaagtattgcatagagaatgccagtattctaattatttaggatcatttttctcctccgttaatatccagtaagtacatgtataccacggatgatgattttataaaatgaggaaagcacatacttggacgaaaaatggtcaagtatataaagaaaagtttgaagctaatgtgagtagataattaatagaaaagaatgctccctctctcttacatagaaagatttgtatgggtaacatctggcaatgataggtgtcaaggtttgggcccctgtactaggtaaatggctcattctgcatatagctgctatctaagtctagttatgggtggcctacagcttagaggcccttgtgcatctgggaaacaatgtctcattcaaagaaagtccacaggcacaatgtgtataaaaccatgaggatggatagttaaaaatgaaaactgctcaaactaggctgggcaccgtggctcaagcctatgatcccagcaccctgggaggccaaggccggcagatctcttgaggccaggagttcgagaccagcctggccaacatggtaaaaccccctctctaccaaaatacaaaaattagccaggtgtggtggcgggtgcttgtaatcccagctactcaggaggctgaggcaggagaatggcttgaacctgggaggcggaggttacagtgagccaagatcatgcctctgtgctgcagtctgggcaacagagcaagactgtctccaaaaaaaaaaaaaaaaaaaaaaaaaaccccaaaaactcaaactaggagtcagtttgattctacacaaattaatttcaattgcagtatttattagaaactgtaggaagaaaaatggtgcaaaataagaaaacttacggttggccgaggtggaggataagagtgggggagtgtgagagttaagacaagtacacttacaaatatacctcaagtagaaagaaataagagatagatgagaagtgataggttgtaagaaaacttccccataaccatttccccgtcactgtcagggtttaccagtcctaggaatgctggggtggttgtgccacaaggccatagagttctcagttgagattgaggagagaaggctacgctcttttggttagctgggtccccaacgatctgtgtctgtccttgcagaaagatggttccctagactggaaatggaaatgttgaaggcagaaaagccctgaaaggtgggagggagtgttgctccttcgggggtaacctagagttctgacagtatactctgtaaaaactgcgaaggacacagtacggtacatctagtgaagtactccataaacctaagtttctgcttttttttttttttttttgaaaaaagtgcttaatgtgttttaaacaaagctggcactaaaaataacatcattttatgacttcttgagaaccatgctaatttactctttaaaatattttataagggaatactgggaacaactcgatgtcaataaatttgacaatatgcatgaagtaggcaaattcttagaaagatgaaaattataaaattgactcttggctgggcgtggtggctcacgcctgtaatcccagcactttgggaggctgaggtgggaggatcacttgagatcaggagtttgagaccagcctgaccaacatggtgaaaccccatctctactaaaaatacaaaaattagccaggcatggtggtgggcgcctgtaatcccaggtacttgggaggctgaggcaggagagttgcttgaagctgggaagtagagttgcagtgagccaagatcatgccattgcactccagcctgggcaacaaagtgagacttaaaaaaaaaaaaattgactcttatccctgagtgcagggggagtccctctcacctgcttcctcagatgactctggaagcttccccacaccaccgggtactgagagaaagctccctgacagtcgagaccggcagacctccatctggtccctgccctggccagaggcccccctaaattgacctcctgtcgatgccctggtagagccgacaggtgctctgggagtcctgtgcttcctgatccaatagtgccaaaccctttgtctcccccagaagcacagcatatccctgggacccctcggccactgcccgattcgtgagccttctctgtttctggggcctcccccaccacagctctgactcctgccccacaaaggactaggccggctgagggggagtgggtgggagggaagatacagacatggggaggggaggctgctctggaaaagtctttaaggcttttggaggtccaggcctggggccaagcaggaaagtgtgtgtgagtgtgtgcatgaggcgtgtgtgcaaggagtatgtgtgagtgtgtgagtgaggcatgcatgttagtgtgtgtctttcctaggacacaccataccctgtgtatgtatggatgtttttgtaaaaaagagaaaaatctgaaaaaatgttttatttgctttaaaaaaaattgactcaagaagaaatagaaaacctgaataaacctatatcaggtacagaaattgaattcacaattttaaatctttttttaaaatctgtacatatcttttttatttgttatttatttattttttaacttttaagttcaagggtacatgtacagtttgtcacaggggtttgttgtacagattatttcatcacccacgtattaagtctagtactcactggttatttttcctgatcctctccctcttcccaccttccaccttctgataggccccagtgtgtgctgtacccctctatgtgttcatgtgttctcattatttagcttccacttataagtgagaacatgcagtatttggttttctgtttgtgagttagtttgctaaggataatggcctccagctccatccatgtccctgcaaaggacataaaaaaagaaatatgtatcacattttctttatccagtcaatcattgatgggcatttaggttggttccatgtctttgctattgtgaatagtgctgcggtgaacatatacaggcatgcgtctttataacagaatgatttatattcctttgggtatatatccagtaatgggattgctgggttgaatggtatttctgtctttaggtctctaaggaattgtcttccacaatggttgagctaattcacattcccaccaacagtgtatgggcattcctttttctcctctacctcaccagcatctgttattttttgaccttttaataactgccattctgactgccatgagatggtatctcattttggtattgatgtgcatttctcttagtaatttaaaatctttacacaaagaaagtctgatgcttgatggcttcactggtgaattctatcaaacattaaggaaaaaatgaacatcaatcctaacaacttcttttagaaaatagagaaaaagaggctgggcatggtggctcaagcttgtaatcccagtactttgggaggccgaggtaggtggatcgcttgagcccaggagtttgagaccagcccggccaacatggtgaaatcccatctctatgaaaatatatataaattagctgggtgttgtggctcatgcctgtagtcacagctacttgggaggctaaagtgggaggatggcttaagcccaggaggtggagtttgcagtgagcagagatggtgccactgcactccagcctgtgtgacagagcaagattctgactgactcaaaagagagaaaaaaaaaaaaaaagaaagaaagaaaaaagaaaatagaagaaaagagaatgcttctcaactcattttaagaggacagcatttccctgatgccctgataccaagccagtcaaagacactgcaagaaaagaaaactacaggctaatattcctcatgaatacagatgtggaaactcttaaaaaaatatttgcaaatcaaatccagcaacataaaaagatttaaacaccaggacaaagtaaagtttatcccaggagtacaagctcagtttaacattccaaatcaattaggataatacatcatacagtaacagaataaagaacaaaaaccatatgatcatctcaatattcttagaaaaagcatgtgacagaccgggcacggtggctcacgcctgtaatcccggcactctgggaggctgaggcgggtggatcatgaggtcaggagatagagaccatcctggctaacacggtgaaaccccgtctctactaaaaaatacaaaaaattagccgggcgtggtggtgggtgcctgtagtcccagctacttgggaggctgaggcaggagaatggcgtgaacccaggaggcggagcttgcagtgagccaaggttgtgccactgcactccagcctgggtgacagagtgagactccatctcaaaaaaaaaaaaagaaaaagcatgtgacaaaatctaacaccctttcatgataaaaagaaatattgctgggagtggtggctcactcttgtaattccagcatgttggaaggccaaggcaggcagatcagttgaggccaggagttcaagaccaaccttgccaacataatgaaaccctatctttacttaaaaaaaaagaaagaaagaaagaaaaagaaacatcatcaatctagcaatagaggggaactccctcaacttactagaggatatctacaaaaaccctacaacaaacataatactcaatggtaaaagaccaaatgctttccccctaagatcaggaacaaagtaaggatgcccactttcaacacttctattcaacattctgtgacagtcatagtcagtataataaaacaagaaaagaagttaaaggcatacagattagaaaagaagacacaaagctgtcattatttgcatataacataaccttgcatttagaaaatactcaggaattggccgggtaatccataataaaacaagaaaagaagttaaaggcatacagattagaaaagaagacacaaaactgtcattatttgcatataacataatcttgcatttagaaaatactcaggaattgaccgagtaatccctgcactttggaaggccaaggtgggtggatcacttgaggtcaggagttcgagaccagcctggccaacacggggaaacctcgtctctactaaaaatacaaaaattagccaggtgttgtggtgggtgcctgtaatcccagctactcaggaggctgaggcaggagaatcgcttgaacccgggaagtggaggttgtagtgatctgagatcatgccactgcactccagcatgggccacagagcaagactccatctcaaaaaaaccaaaaaaacaaaacaacaacaacaaaaaaacccaataaaggctactagaaaaaatgagtgagtttagcaagattgctggatgctagatcaatacataaaaattaattgtacatctacatactagtaacagacaatgggaatataaaattttaaaagttcattcacaataatatcaagcagaatacaataggaataagttttttttgatttttaatttattttttaatttaaagagacaaggtctcactctgtcagccaggctggagtgcaggggtgtgatcatggctcattgcagcctcaaactcctgggctcaagcaatcctcccaccttggcctcccaaagttctgagattacatgtatgagccactgcactcagccagtaataaatgtaaaaaaagaagtgcaatggctgtacactgaaaactacataatgctgctgagagagattgaagaaatattataaataaagagatacaccatattcatatactgcaagagtcaacattgttaagatggcaactctctagaaattgatctataaattcgaagcaactaatatcaaaatcccagcaggactctttgtagaaaatgacaagctgatcttaaaatttatagggaaatgcaaaagatctagaattgccaaaacaattttgaataggagaaacaaagtatgaggatttacactacctgatttcaaaacttatgaagctactgtaatcagtcagtgtgttactcacataaggatag

SEQ ID NO: 12354 - DNA, 15116 bp, Human
gggctttcagccaccagcatttcctgaatatataaaaaaagacattcttctcactctggagatacttttttttttgagatggagtctcactctgttgcccaggctgaagtgcagtggtgcgatctcgcacctccgcctccagggttcaagcgattttcctgcctcagcctctcgagtagctgcgattacaggcacacgtcaacatgtccggctaatttttgtgtttttagtagcggggtttcactatgttggtcaggcttgtctcaaactcctgacctcatgatacacccacctcgacctcccaaagtgctgggattacaagcgtgagccaccgtgcctggtctttttttcttttttttcttgtttttttttttttagacagagtcttgctctgtcacccaggctggagtgcagtggtgcgttcttggctcactgcagcctctgcctcctgggttcaagcaattcccctgcctcagactcccaagtagctgggattacaagtgtgtgccaccatgcctggctaatttttaaattttttgtagagacagggtttcaccatgttggccaggcaagtctcgaactcctgacctcaactgatcctcccgcctcagcctcccaaagtgctggaattacaggtctgagccaccacacccaggcttactctggagactctttggttcttagtggtccttgtgtcaggaaccagggacagagaccagagacgtttttcactatgtcacagcacaggagccttgccaacacagtcccatcctcccaggcaccctttcccaggctgtcctcttccctcccagcacaggcccccattctcctggatctgaaccacacaaggaggcagaggggtagagtggttaaaaatgcaggcgctactactttctggaggtgtgatcctggacaagagcccctgtgtccctatctgtaaatggagatgataaaacactcctcaaagggcctccgtaaagatcacaggaaacaaagcatggacaacgtgcctggcacgaaggagagcttggtaagtggaggcaagtctgagtgccagagccttaaaaccatggactcttaggtttgaaggaaatcaaaatattcctctctaaaaacctgcggattttagttaaaggtaaaaggttaaaacccaggggcaccctctgccccttctctctgtcttgatcagctcagaagcagagctcagaggatcctggatcagacttgactgttcccatacattcaccttcccacatttccagccctttggaaccctgaagatatcctcttctctgtcctgtcactctatgggacttacggctctttgttaaaatactatttaagcaaggcccctaagccactgccttgagagagaaatacttctcaactgaggcctctactgcataatgggtacagcatgtgttaatcaactttggctgatttttcttttgttaagttgacttttgtttccaggggagcgtgtcaactaagaacctaaacagggaaagaaaagaaatgttttcacccctgcacgtcgtccaaacttcctcctgcgtgtttgagacgacataacggaggccagagaagaggacttgtctgagctcaccaagggtgcacagcccctttctgcacccactcatctgtggatgagaaggggagacaaacaaaggtgtcttctgtttcaaagtgctttcctgtctagggagtggacatttgcctttttcttgaaacattcaaagagccttatgaatccaaaggcctgcccagaaacaagtgatgagggccctgggcagccaatgggatcgtgctggcctttctacctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagaggtatgtgtgagcaccaggaaagggcacaccgatcctggactgcagagccgtgcgcatgtgctgggaagaagcaccggccaggagtcacaggaaagagggattcaggctctgactctaacattgactttttgggtgattttgagcaagtctttggcctgctctgggctccggctccctctcttgtcaaatgagggggttcctttaagagcaggagtttgtaactttccttgcatcacaccgcctccttctgaaaagcagaagagagcatgggttctctccctagagtttcacatgctatgcaggggctttgagatcccactaaagctgggctgtgaatgctaggttaaaggccttggaacaggctgtgcctggtggctcccgcctgtaatcccagcactttgggaggctgaggcgggcagatcagctgaggccaggagttcgagaccagcctggccaacatgttgaaaccccatctctactaaaaatacaaaaattagccagatgtggtggtgtacacctgtaatcccacctacttgggaggttgagacatgagaatcacttcaacctgggaggcagaggttgcagtgagccaagattgtgcaactgtaccccaccctgggtgacacagtgacactctgtctcaaaaaaaataaataaataaataaagaccttgcaccagattttgaaaatgttcaagatcccagtggagaaagagtttctaaaagaggatggtagaagcagttcttcacagaggagttccctcctaattaccacggatcaagggaatgatagttgcaggtgtctgtagagtagatggagacatctgccatcacaggagggattgtgagatgttgggggcaggcaagaaaggagggacaggctctggttaaatttctggagggggctcagggttgacgggggtcatgtccttgcctgtgcccctctcccttgcagccagaggccagcacagccatccaggggacaccaggcccccacttcccagccccaaaatagcctcacccatgtgtttccctcaaaaagggctagaaggctattaccccaatgcccctgctacccccagtctccaaaaagtaatttgcgatctacagggacttacagctaggtgtgatgtcagctgttgccaggcagaaaggggtttgggagaaccctgcagagatgttatgacaagctatgttctggggaacaaggtaacctgctgcagaccattagagctgtggcctgtgaaaaccccagggaatcccatggcaaggagggagactgttttgtgaggaatggattcaggtctaggccacgcgtgaccttggataaatcactgcctctccctgagtctcagtaataatataatagccataatagttctcatccactgtgtacctgtcaccaggcctcagccactgttagttagtactgtgattatttacatacgtaaaggctaaactcaattttaattcttacagtcaccctatgaatcaggtacttttgttgtccctttttacagaagaggaaattgaggtcatattggtaagtgacttacccaagtaatcatagctagtgagtggttggaggcagaatttgaaccaggactagtctgacatcaaagtgttagctcactccaccatttggccccctttcagaggtgcattttgtgggaaggggaggtgagacccctctgagctcagaccactcagtgatttacagacccaggtgggctcagtgttcagagtgcatgtccccttgtctaatccttgtctagttttccctttattcagttactgcttctaaagctggctatgtgtgcttaggccattccagactggagcctgttttggaggcttttgtgaatgcttctgcctggcaacatctgtgtcacgattcctgctagctctggttggctcctgactttggcttttttttttttttttttaattgcagaagaaggtagtgtaaatgaggaaataaagaggggggtgacaagagttggcactctaccagaaccaggggacaggcgttcaagatgcataaagaggaagaaaagcagatgctaaacttaactacgaactcccctgagaattgcactgagtgtaatttatttatagagtgctaacaatgtgctaggtgtggagccaagagctttaccctcatcatcttatttaatgtaacagcccttggagcagatgttttacccgattttactcacacagagggttaatcaacttagatggtcccagaactaaccgactccagagccaggattccaatccaggttatgtggtctcgtcttcagggtgaatctctaggttcttaggcctcctgaggaactgtggtgcagagaggggaaggtactgtcccatgtcgtgtgtgggaggtagagctggggctagaattgggtgtggggttgcagaagcactgaacaggtggaggatgaggctggagagcctgaacacaggctaggccacccgtgttccttgagaaggccaagaagtagaatttgttttcccttcctgtctggtctccccacttcccccccgccccccgcccaccgtcgggtttttgctgtttccttcccgaataactctcccttgggctgggccttatcccagaaagcacagactggcacgcagcaagccaatgagaatgagccagtctgtgatgtcatgagttaccaggcacaagggactcctggagcgtcctaaaccatccttgctggttgctggagtaggcagggtgcagcctcatccttgcagttcccaatgggtctgttttagtccgttttgtgccgctttaacagaataccacagactgcgtaatatacaaacaaacaaacaaacaaacaaaaaacacccagaaatttatttctcacagttctggaggggctttcttgttttttttttttttttttgttatgttttttgagacagagtctcactctatcccccaggatggaatgcagtggtgtgatcttggctcacagcaacctctgcctcccaggttcaagtgattctcctgcctcagcctcctgagtagctgggactacaggtgcccaccactacgcccggctaattttttcttttttttttgagatggagcctcactctgttgcccaggctggagtgcaatggcatgatctcagctcactgcaacctccaccttccaggttcaagggattctcctgcctcagcctcccgagtagctgggattacaggtgctcgccaccacgtccggctaatttttgcatttttagtagagacagggtttcaccacgttggccaggctggtctcgaactcctgacctcaggtgatctacctgtcttggcttcctaaagtgctgggattacaggtgtgagccaccgcgcccggcctagcttgctttcttttttttttctgagacagtctccttctgtcacccaggctggagtgcagtgacgtgatctcggctcactgcaacctccgcctcccgggttcaagtgattctcccacctcagcctcccaagtagctgggactagaggtgcacgccaccatgcctggctaagttttttgtatttttttgtagagacggggtttcgccatgttggccagactggtctcgaactcctggcctcaagtgatccacctgccttggcctcccaaagtgctgggattacaggcgtgagtcaccacacccagcctggtgaggggcttccttgatgtgtcctcatatggtggaaggcagaagggcaagagagaaccaactccttccatcaagccgtcttacagggcacctaatcccattcgtgagggagaaggccttgtggcccgatcacctcccaacaccttcacattggcaacacctggactagggtcttagtagtcccacccctggggtcgtcaaagaacagatcagaaactcctggggtgtaggggcaggatccttacatcccctgtactgtaacatatgcatgcaccccccagtcgcatccaagtcccacagatacaagggcttgctgaggtccgagggtctggatggtgagtccagggagcatgagaaattcatccaggccacacaggctcaggcacctatactcctgcccaccccctgcaggatggatattaccatttgaaatactttggcgcttgcagtgagatcttgcttaaaagaagaaacccaccaaattctagaatcgcagaggtgggggcacctatgtgacaaatgagggaacagaggcacagagattggcagggacatgctcaaagacatggagagcctgggcagaggatggccccagagtgggtggtgcctggccctgcttcagcctgacattgtccaagcctcccccagcccactcctaaaatggccaggccccacttcttcccaggtgggctacattttctgctgtcccggtcccacttccttaccttttctccttaaatctgatttcactgtgagggtgggaggttgggcagaggggtgaaaaccctcttccccttacttggtaagcacatacaattttttttggttttgtcaattaaaaaaaataacatacctggttgatcctgccagcagaaaaaaaaaacaaaacaaaaggctgggcgcggtgactcacgcttgtaatcccagcactttgggaggctgaggtgggtggatcacgagatcaggagatcgagaccacggtgaaaccccgtctctatcaaaaatacaaaataattagccaggcgtggtggcgggtgcctgtagtcccagctactcggagaggctgaggaaggagaatggcataaacccaggaggtggaggttgcagtgagccgagatcgcgccactgcactccagcctgggcgacagagcaagactccgtctcaaaaaacaaaacaaaacaaaacaaaacaaaaaccaaacctgttccccttgagggcagccctgatcatcaggagatccgcacggcaaagggagcctgggaagacccccccacctcaacccctcatcgcacaggcaggaccctaaggtccagagaggacaaagagcatgcctctttgctcttctctgttcaactcaggcccgtggcagctgcagggtctctgccagggaagacttcaggcacatcgatggttggaaggaggggtggggtgaggtcttcaagctgtgtttccatagccagcttactgtttgtgcttcaaatgcattgtttattaggggtggcttaggggtctaatggagatgggggtatacatttccccattcctagccagcccttggggcagccaccactgtggatcctcctctgacctatcctccccacctcccacagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcgtgcgtgcacccctacatcctgataccccccacctcccaccatccctcaactcagagacccgcatccctgcacccagctgggcccactgtcctctccctccggtttggaattccagcccttcctcatctgggtctgataccctcctccctgggcaccggggccacacttaccctcgttcctgtccccacagctcccaagcctgtgagcaagatgcgcatggccaccccgctgctgatgcaggcgctgcccatgggagccctgccccagggggtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtgaagagtctcttggtgccatccctgggaggaaggctcagccctctacagtttacaaagtgcttctcatttcctatagcatctcactgtcctctcccattctcaaagaccttgctatcatgcattgacaatatttatattcacaatactgtgctgtggacaaaaccctgggcaggaaagcttatgccagtttgaccaatgaggacattgaggcaggaagctaaagtgacttgctcgagctctcatgtttggaggtggcagagatggaaccattgaccaagtgcctgcgattccagtctcttacctagatcccagcaaccggctcctgctccataccccctgctccagggaccagctctggtaaccttctgttacttcctcccacagcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtcagcaggtttccctgcatgggaactctctctttcctctggtgtctagggcagggctaggagaggtggggtgagggtgggctggggaagccattctcaggaagctgaaggggtttaccagcacttccaaaacctggatgctgcagagtatgtggggttcagccccaggggtctttaagagggaaccaggctgcagctggacccgggtgttggggccctatttggccctgcatgtttctgtccccaggggcaaagccaggcagtgtaggggcttggtggtggccatcgaacctgacctccacctctatccgtattaggtctttgagagctggatgcaccattggctcctgtttgaaatgagcaggcactccttggagcaaaagcccactgacgctccaccgaaaggtacagggagtgggagctttagcgtgccagggcttctggaccctcggggctctcctgaagctgctgaggccggggcctccagcactccctggtcccagcaccgcggaatctcccatcctctcagctctcacttctttctcacttctctctctctcctgtctgttccttcttggtttggctgtccccctcccctgacccacccccatcttgtctaagggttcctaagggcccacagaggcctgtcaccacagggtacaggtgacctctctcatagaggatggtacagcacagggtgcctggggtagaacctgcccgaaacactgcagaaaggaatccttgtaatgaccttgccccagtgctgcccgcaatccagtgagggcgccaaggtcacagctgctgccaagagagccttgggcgtttcccacctcatggacaatgcagactaggatgtttttagacccaaagacagagtgctgtttctatcccggtgctgtctctaatttgctatgtaactttggacaagtccccttccctctaggattcagggtcctgaagtagaaggtcaaagggccaccctgcctggggcctcagtttctgcatcagattcatagaaggcaccttacatgctatctccaactcctagctgatgcttaaacccctctaagacatctccaacaaacggtaaaccccatttctacttgagaactcccagtaacaggaagcttagacttaccaaggtgcccattgcttttctctagaatcagaatcgcaagtgcaattccaaactgtaatggtgtttttttgtttgattgtttgtttttgagatagagtctggctctgtcgcccaggctggagtgcagtggtgcgatctcagctcactgcaacctcagcctcccgggttcaagcaattctcctgcctcggcctcccgagtagctgggattataggcatgtgccaccacgcccagctaatttttgtatttttagtagagacagggtttcaccatgttggccaggctggtcttgaactcctgacctcaagtgatccgcccacctcggcctcccaaagtgctaagattacaggcatgagccactgtgcctggcccaaaactgtaatgggctttgagtgtcagaagaaaccatcaacttctgaggtgaattggacacatggccattcacttcctttttgatctcagaccttgttggtctaggcctcagttttcccatccgtgtgatggctggagtgagtaaagccacttgggaagaaggcattaagcccacagcagtggtgtgtgggtctttagctctgctcagaccctggttcagagctcactcactcactgtgtcctcatcatgcctgtcgcttcagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtggtaagcagtggcactgtgccagtgtcagaggaccaggaaggactaggaaggttgaggggcaagaggtcccctctgaagcacatgggaccaggacacccaggatggcagctcctgggggcagtgacgtagtcatgcgtccagccctttatccatccacccacctgtgcattcctatttgtccatttatcatctctcctcttacatgcactcatatttgttcacttatccgtcagtcctttcatctgtgaatttcatccatccacgcgccatcctctagcatccaggagtcctacagacccacccatctcatttcatcacccccttctcactcgagcccccattacacctctttgttgctgcttgcagctgtccttccctgggtacctgctttcccaggcactaagcctgtggctaggtgggaagcactgccctcaggcatcttgggtcaggtaggctgcacttcaagtgacaaacggacttgctgctcctttgcagagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacactctggctcctggctcttctgttgagatccagttcatttatcctaaagaggtaactaaagacgctaaatccagtcactgaggtgggagaacgcagcccaagtaacccacagagatgcctgcggggccaggcaggcctgggggggggcttgtagtctttggacacagacatacttgattacatgtttaacacacacgaacactctacttccaaaaagaaataggctcttgcctagtttaagcacaagctcttcttggtacagctttcattttcctatgtccccaatttcatttctatactaagaacagtgtgaatgtgatgacagatggcaaccgacatagggcctccgtgtcaggatggacaggaagtaggggactgtggagaactgggtgcccatgccttacctaaggggctgactgctactcagctctatctggttgctgccaggaggaagcacagcccccgttgccagatgttatctttttaagaggagccagaaatcaagaactgcagtgaaatcaccccatttttaagtttaaagtcttgctgtgggtcaacaaggcccaatgaggacactactctgtagttctgttctagagcaacatgcttgagaggagagaggccagatggtggagggtctggccccgggccccgagtcaagggtgcagctggatgccaacctgggtctccgacacctccagccatgcattccttttctgcactgcctctggctgtttccagcatgaggctaaaagctctggagaccatctccaggacccctggtgttccacatggctctgggcccagggaagtgggcttctgcatttccaggctggagcagcagaccacctcctttgctatccctcccctccctcagtccacacccaagacatcatcctgtctttcatgttcatccacttcttgccctcaccaccacagaaccatggtgagctcgatttgaggggcaactcacttccgattttcctagacctgctgtgcctgccacagctgttcaccaggcacctccagggagcctgcccctagctcgaggcctaactcgaggattctcagccccttccatttcttgtctttgggtatttacatgacttactctggcaacaggaaatcaaccatgaccatcctttagttccatcctttagtttagatgccacctcatccaggaagccttccccaccaattcggcactcaggcacttcactgctcactgcctgtcccactaaccacggtcacccatagcctcaacatgcaggcaagagggaatcccgagtgtcggcgagacagtcccttccaagaaacatgtgccccagatgcactgggagcttgcacccttcctccaagtcttttattttttttttgagttattaaaaaaaaaacaaaaaacacaaccaaaagaactgacgagaggaagacaaagcctcgggatcagccagagaccgagcggcacgggatgaggcacaggtcaggcctagctggatctgtggagcaaggtggtgggaagtcccgaggcctttgggcatgtggggtctgtggaaggagaggaggtcacttaaaaaaatacatatactgtacacatctatatgaagcgtcctgtgttgggggagtggggtgaggtcatgggagctggtccactttctccttggaccagcctccccgcaggctcactggcttggccagcacagggacccctgaagctggctgtcttcttctgtggagcgagggaaggtaacagtttagttccaacccatggtgggcagaggtcggtggaggtcagaggcatggggatggccactgctcggctaggaaatccctaggggaaggaaacacatgcagatgtcaaatttcctgacccttttcccctgcaaggaaaatgaaatctggcatctccaatgcaggggggaggcattaaccacagtggacattttttagcacttggaatgttctgagaactgggctgagtcctttagtgtttagtttag

SEQ ID NO: 12355 - DNA, 25321 bp, Human
aaaaggtgacaaaaatctgcatttggggacatctgattgtgaaagagggaggacagtacacttgtagccacagagactggggctcaccgagctgaaacctggtagcactttggcataacatgtgcatgacccgtgttcaatgtctagagatcagtgttgagtaaaacagcctggtctggggccgctgctgtccccacttccctcctgtccaccagagggcggcagagttcctcccaccctggagcctccccaggggctgctgacctccctcagccgggcccacagcccagcagggtccaccctcacccgggtcacctcggcccacgtcctcctcgccctccgagctcctcacacggactctgtcagctcctccctgcagcctatcggccgcccacctgaggcttgtcggccgcccacttgaggcctgtcggctgccctctgcaggcagctcctgtcccctacaccccctccttccccgggctcagctgaaagggcgtctcccagggcagctccctgtgatctccaggacagctcagtctctcacaggctccgacgccccctatgctgtcacctcacagccctgtcattaccattaactcctcagtcccatgaagttcactgagcgcctgtctcccggttacaggaaaactctgtgacagggaccacgtctgtcctgctctctgtggaatcccagggcccagcccagtgcctgacacggaacagatgctccataaatactggttaaatgtgtgggagatctctaaaaagaagcatatcacctccgtgtggcccccagcagtcagagtctgttccatgtggacacaggggcactggcaccagcatgggaggaggccagcaagtgcccgcggctgccccaggaatgaggcctcaacccccagagcttcagaagggaggacagaggcctgcagggaatagatcctccggcctgaccctgcagcctaatccagagttcagggtcagctcacaccacgtcgaccctggtcagcatccctagggcagttccagacaaggccggaggtctcctcttgccctccagggggtgacattgcacacagacatcactcaggaaacggattcccctggacaggaacctggctttgctaaggaagtggaggtggagcctggtttccatcccttgctccaacagacccttctgatctctcccacatacctgctctgttcctttctgggtcctatgaggaccctgttctgccaggggtccctgtgcaactccagactccctcctggtaccaccatggggaaggtggggtgatcacaggacagtcagcctcgcagaggacagagaccacccaggactgtcagggagaacatggacaggccctgagccgcagctcagccaacagacacggagagggagggtccccctggagccttccccaaggacagcagagcccagagtcacccacctccctccaccacagtcctctctttccaggacacacaagacacctccccctccacatgcaggatctggggactcctgagacctctgggcctgggtctccatccctgggtcagtggcggggttggtggtactggagacagagggctggtccctccccagccaccacccagtgagcctttttctagcccccagagccacctctgtcaccttcctgttgggcatcatcccaccttcccagagccctggagagcatggggagacccgggaccctgctgggtttctctgtcacaaaggaaaataatccccctggtgtgacagacccaaggacagaacacagcagaggtcagcactggggaagacaggttgtcctcccaggggatgggggtccatccaccttgccgaaaagatttgtctgaggaactgaaaatagaagggaaaaaagaggagggacaaaagaggcagaaatgagaggggaggggacagaggacacctgaataaagaccacacccatgacccacgtgatgctgagaagtactcctgccctaggaagagactcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacaggtgaagggaggacaacctgggagagggtgggaggagggagcacagagactggctggggtctcctgggtaggacagggctgtgagacggacagagggctcctgttggagcctgaatagggaagaggacatcagagagggacaggagtcacaccagaaaaatcaaattgaactggaattggaaaggggcaggaaaacctcaagagttctattttcctagttaattgtcactggccactacgtttttaaaaatcataataactgcatcagatgacactttaaataaaaacataaccagggcatgaaacactgtcctcatccgcctaccgcggacattggaaaataagccccaggctgtggagggccctgggaaccctcatgaactcatccacaggaatctgcagcctgtcccaggcactggggtgcaaccaagatcacacaaatccctgccctcatgaagctcatgctctcatggggaggaagacagacatacaaagagatctagaatgtgaggtcaggtgttgacaagagccctggagggaatagagcagggaaaggtcagaaaaggaagacccagggtctctagaggaggtgtcagggaagggatctcccaagaatgccctgatgtgagcaggacctgaaggcaatggggagggagccgtgaagacccctggaaaagcagattccacacagggaaatgccaaggtcggaggtgctaaggaaataggagacacactgctgaccttgacctagtaggacacacacacacacacacacacacacactcactcactccagggctgggggatgaagagacctgctcaggacccaggaccccatttttccaccctaatgcataggtcccaatattgaccgatgctctctgctctctcctagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtataccgtgagtgattcccccatgacctctgggtgttgggggtcagttctacttcccacacacaggattatcaggcctgggctgtgcctgtggccccctctgcattacgcaccatgttagggtttgggcatttagtgcaggatacacacagaagagacaaacttcaacagatcagaattcctttccggcatccagaccctgcagacactcactgcagaggaaggacagtctgatgtgggggacttagcagggggaggtcagtctcagccaagcaccccgtgccctccccgtaaacctgaccctgagaaagaccctggagaactgcatcagagcctggcctgagggacccctgggatattcacagagaagctcagccccagggctcctggttccaggtgactcaggggagcctgtgccagggctgtgttgtggcctcctgggcaaggctaactggaagcaaggacttagcagctgtccaagggctgtggctcctggagctggattctggatgcagaatcggactttctggccacacttgttccctgtccccagagtctcatttggacaaggacagagccttgtcctttacttgagactcaatgtggggaggatagatagacaaggttattagggtgtcagtccattgccctggggacataggtgactccatgggaagctcagtgtccccaggaagaggaacagaggagagaagatgctcccggcagctccttgtccaccagggatcaggcccagggccttctctcttggaggcaaataaacataaatgatgttcatttgagcagctcctctgtgcagagctgagatcaagtaattgtaaatattttgaggttaattcacaaacaacctcacagccaaatagcacttatcctacttattgaaaggaaattgaggcacagggagacagtcactaacaagggtcacacaggccataggtgtcagattgaagtcacatgaggtctgtctgtagccacagccccctcctctcctcaactgggggtgggtggggctgtttgttgttaggcatctgcatctgagaccagtcatgggcttgcgttcttttgtcttgggcatccacagctcagaagcggagattctggtctggagagtgataagtaaatggagaaataatcagttttactctagaactagatcacctcaacagtcagggtcagtgccgggattgtccaggcctctccctgagatccacagccccctcacatgacctcaaatcctgtgtttcccgatgtgtcagtgtcactcccacggaaggataaaggaaaggacttcgctttctctccccactcacaccctgtgccaacagaggcccaaagtgagacacacgcttgctcagtagctctctcatgaaggggggaatgagtgaaggaatgatccataacctctatagagactggatcctggatgcagaatcctgggaggttctgaccacacctgttccgtgtccatcaggggctgagatccatgtaccattcctctgaccccctgtcccgaaagccaccctatctcatgtgactctggggttccttggccatgggagggttttcaaggctccctggtcctggtcgggacagccaagggactcctagtcctggggtctccgaggtcactataccccgcatggctcattgccatgggcatttctgactttcttctattcctccatgttcttcgtcttcctccctcttcattccagctgagatgcccatccctgaacatcttcctccactcttaggccttccccagacactcccttgaacaaggctggctgtcctgttttcttgccgctcacactgtgtcctggcccacttcccaggcaatagggaaggcacagaaatcacaggcaatagggaaggcacagatggagcccctgccaggctccatcacaagccaatgtcaacaggtcaccaggagaatgagcttccgctgtgttcctgcccagggctctttacttccatgaggccaacacacggaacaggcagcaggacgggaatgagcgactcctccatccactccctacactgactcaccagggggtcagaggcagaaggacaggtctgcagtccccaaagcccgcatgcttatttcactcacttcactacccactccatcttcatcctggtgtggggctcacatcctccagtggatcctgggacctcccccaggtggagctggccaggcaggtgctgtctgataggtttgctgcccattccacatacacctgtgtcctcatgatgatgccattgtcataaggtggagtcccttggactgagaagtgaaccagccactggcgtctcacttagactctacccagttacaaaaacttaaactctagttgtgttttctgaggttgataggagaggaagaaaacctttcacatgcctgttttgaggcttctcctctttttgcctaactctgcacaggaactaggggcagggagcgctttctaaatttactaacatcacacacattgcttctcctaacttggcatcatttctccctttatgtaattgacacacctaagagttcctctctgaccggttctgtcctcttaacaggtctcacatccctctctctgttcagggagtcactgatttcaaaccactttcagcatcttcctttgagcataatgtgatcactttggaattcagagcagacctaaaccttagcataatattaaaagaagtactacttccagcaattgatcttagatctttaggccattgataagaatttccacttatggaaaaaatttaatgtttcccccaaatgtctttcacttttttaactatagtcagaaaataacatgagatctaaactcctgacaaatttttaagggcaaattatagtactacagattgagtatcccaaatccgaaaatccaaaatctgaaatgctccaaaatccaacattttttgaccactgacatgattctcaaaagaaatgctcactgaaggccgggcacggtggctcatgcctgtaatcccagcacttcgggaggccaaggcgggaagatcacaaagtcaagagatcaagaccatcctggccaacatggtgaaaccccgtctctactaaaaatacaaaaattagctgggcgtggtggcatgcacctacagtctcagctactttggaggctgaggcaggagaatcgcttgaacccgggaggtggaggttgcagtgagctgagatcgtgccactgcactccagcctggcaacagagcgagactccatctcaaaaaaaagaaaaagaaagaaaagaaaagaaaaaagaaaggctcactggagcactttggattccgtattttcagatttggggtgctaaactggtaagtatattgcaaatattcaaaactcaaaaacagtcagaaatccaaaacacttttagtcctaagccttacacataagacatactcaatctgtatgaactataggcaccaagctgaacagcagatccctagaacctcctcatcctgcataactgaaactgcagacccatgaacaactctccattcccccagttcccaggctttgacaaccaccattctactctctgattccacaagtgtgactactctagggacctcatataagtggaatcctacagtatctgccctgtgagtggcttatttcatttagcataatgtccaatgggagaaaataattgcaaaacttcttctcaaagttctgtctcataactgtcaaacacacatggtccttgagggccagatttccagcagttcatgctcccccttttccaccagtcagttctgcatttgcaaatgtccacatgtatttatggagagatccacagcatcctcgcctgccctctgcaaggggagaagggacattaaagaccaaagacaggccgggtgcagtggctcatgcttgtaatcccagcactttgggaggccaaggtgggcagaacacctgaggtcagaagttcaagaccagcctgaccaatatggtgaaaccccatctctactaaaaatacaaaatttagctgggtgtggtggtgggcgcctgtagtcccagctactcgggaggctgagacaggagaatcgcttgaacccgggaggcagaggttgccatgagccgagatcgtgcctggccaacacagcaagactccatctcaaaaaacaaacaaacaaacaaagaccaaagacaaagaacatacatatggttctgctgttaaatccgggcagctcctgcctgtcacctgaagttctagatcattccctggactccactctatctttaggggtctctggctcaagtcagtcatcatcaaacacctgggaaaaactgccccaccttgtgcctccactgcctaacgactgagctgacctccaggcttgcctctggtgtcccctgtgttatttctactgaaacatccagtcccaggccaggctgcacaatatgtacagggtttaaggacaatgggaagacccatcactatccatttctaggatgtccttgcaaagggaaaccacagaaaaaatatacctagggaaacaaagtaggactgaaggtggaagggacccagcacttgaatgttccaggtgaggaccctacagtgggccaagtagtcaactggtcagggagggaccaggagaggcaccaggagctgtgacctcccccccagtcctgtgtctgttcacagcccaatgctgctgcttaattcacacttgagaaagtctgtgcttcccccacaccgagcaggcagcctcgcagtctctgagatctcagatcatcgtgcatctgtcttgtgacacatgcacccaccgtgggtttttaagggctcaggtgggctgagaggtggaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctgtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatggtaagtggatccacgaagcactgacatcatgttttgaggtggagtctgtctggttttcaaacaagagccaggaagacattttctatcccagcctgtgtccagtgggcacaagcaaatcccagattctcccactgaacctccccaatatgtctctacagactcttttcttcttgttctgatttctcatggcgggccccaggtccagcttggaatgtggggaggaggctccctcagccccacagccctgtgtagtggaggaagcttcacagagcgggaaggagcaagggttctcaaggtcaagttgcttctctctgtcaccaatgtgtccctttctgtcacctctttgtgttcttttgcctactccatgagctacaagcaacattcaaggctttgaaacaagctcatacttttttcccaaatgagagaaggaagccccttgggtgagggagacacagctcagactgctccctgctctgctctgggctcccctgggtgactggccttgcctgactccacctaggtgggaacgaggtgtgtggagaaggagcccgggtggtctgtcctgaattcggctaaatcaagctgccaatcaacaccaaagcttcccttcgtcccagtcaggctgcaggaaaatggaaagagagggagcctcagggcagactcctgagctgcgtcctggctctgatgtcaccagctatatgaggctgtgggcacagcacatgggacacagcacaggggacagcaagtgacccacacttggagaaatcaggagattcaccacaggggctctgcacggcagggaatggcagtgtcaaaaatcgtgtgtttatacagatggtaacagtacatatctaacacaaacttaccatcttaacttttctacacatgcagttcagtggtattaaatatattccccttgttctgcttccatcaccaccatctacccacaggactcttttcttcctcccaaaatgaaactctgttcccatcaaactcctgggcagagctgccccatctatggcccacagtctgatccctgacttgtcacctctagacatgctcctagtctcctgcactatttctgctcaaacatccatctccatcatcacctatctctaggatgtccttaaatagcaaagcctcagagcaaacacaacttggctgggtggtgtgggaccgtgcagctggaagaaacgcagctccttcaaattccaggtgaggaccccaatgggccaggcagccagccagtcaggaaaggaccagaagtgctgggggctgtgacccccagccctgtgtctgtccacaacccaatgctactgcccaattcacacttgagaaagtctgtgcttctcccacacaaaacagccagcctcatggtctctgagccctcagatcattgtgcatctgtcttgtgacgcacacacacctgccatgagcttttaaggactcagttgggctgagaggtgggagatgccaactctgattgatagatgcccgtggaggaatcacaggtgccacacagggcaatcttctctctgttatctgcacagcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctgtgagtatcttctgttcctctgtggctcaggctgccagcccaaatccacatagccaaagtccaggcctctcagtccctctcaggcccaaggacagagacttttacccctggacatccaggctggccctacccccagcaaatccatgcaggcccagtcctgaccaagaataggaggggagggtctgctcctgtcctgtaacactcgggatccacagctagtgatgggagaaacagatgaatgtctcagactctggctaattggatacagtaggggtttggttaggacttcaggattgtgacttggctcagggggacactgttgccctttcacagaccaggagcttcccctttgctctgatgacattcacctgtggccctattctctttgctccagatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctggtaagtggatccctggaccgttagcaatatgttctggagcggaatctgtctggttttcagaaaagagccaggaagaaattttctttcctagtatgcatccaatgggcacaagcaatcccaaattcaatcctgagcactcccaatttgtctctacaaacactcttccccttgtttttctgatttctcatggctgaccttgtgtccaccctgagaaatgtggggaggggtcttcatcagccctgagccctatgtagtggaaggggcttcacagagggggaagcaagaagggtcctcaaggtcaagttgctcctctctgtcaccaatatgtccctttctgacaccactttgtgttcttttacctaatccatgagctacaaggaacaactgaggctttgaaacaagctcacactttttccccaaatgagaggaggatgccccttggatgagggaggagcagctcagactctgctcccggctccgctccgggctcccccagtgactggccctgccctgatttcacctggggtgggatccgggcatgtggagaaggtgctcaggtggcctgtcctgaatctggctaagtcaagatgccagatgaagccaagccttcccagggtcaggctacagggaaataagaagagagggagcctcggggcagactcctgagctgtgtcctggagtctgaagtcaccggctgtatgagattgtgggcacagcacatgggacacagcacagaagacagtcagtggcacacacttggagacacacagagattcacccatggggactcaacatggcagggaaggggcagtgccaaaaagtgtgtgtttatagacagggtaagaataccagccactatatatatctaacataagacaccattttaacctttctatgtatgcagtttagtagcattaaatattttcccattattctgctaccatcatcaccatccacccacagaactcttttcttcttcctaaaatgaaactctgttcccatcaaactcttgggtagagctgcccacctgtggcccacagcctgacccctgaactcacctctagacttgctcctggtctcctgagctatttctgcttaaacacccatccccgtcatcacccatctccaggatagccttgaaacaaaaggctcagagaaaacaccccacggttgggtggtgtgggaccgtgcagctgaacggaattcagcacccacaagtccccaggttggccaggccgtcagccatcagggaagaaccaaaggaggtgctgggggctgtgactcccagtcctgggtctgtccacaacccaacgctgctgcccaattcacacttgagaaagtctgtgcttcccccacacaaagcagccggccttacagtctctgagccctcagatcatcgtacatctgtcttgtgatacacacacctgccatgggcttttaaggactcgggtgggctgaagggtgggagttgccaactctgattgaaagatgcctgtgaggaatcaaaagtgccacacagggcaatcttctctctgttatctgcacagcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctgtgagtatcttctgttcctctgtggccctggtttccaacccaaatccacacagccagaggccaggactctcagttctcctcaggtccaaagaggcagactcccacccctggacacccaggctggccataacttcctgtcccaggaaaatttgggcaacctcagcctggaccaagaataggaggggagaggctgctcctgtcctaggaggctcagagtccacagcctatgatgggagaaacagatgaacgtctcagacccagactcagtggacatgagggttatggtttggacttttttttttttttttttttttttgagacggagtctcgctctttcgcccaggctggactgcagtggtgtgatctcggctcactgcaagctccgcctcctaggttcacaccattctcctgcctcagcctcccgagtaactgggattacacacacgtgccgccatgcccagctaatgttttttgtatttttagtagagacggggtttcaccatgttggtcaggctggtctcgaactcctgatctgcccgcctcggcctcccaaagtgctgggattacaggcgtgagccaccgcacccggccgatttggactttttaacacaggattgggacaggattcagagggacactgtggcccttctacaatcaggagcttcccctttcctctgatgacatcacctgtggctttgttctctttgttccagatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacactttttccccaaatgagaggaggaagccccttggatgaggcaggagcagctcagactctgctccctgctctgcgcccggctcacccggtgactggctctgccctggctccacttggggtgggaccggggcatgtggagaaggtgtccaggtggcctgttttgaatctgggtaaatcaagctgccaatccacagcagagcctcccttgggtcaggttgcagggaaatgggaaaagagggagcctcgggacagactcctgagctgtgtcctggctctgaagtcactggctgtatgaggctgtggacacagcacataggacacagcagaggaaagtgagtgacacacacttggagaaatagggagattcagccataggggctctgcatgggagggaacaggcagtgccaaaaagtgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggtgtagtttgcagtgagccgagattgagccactgcactccagcctgggtgacagagtgagactacatcacaaaaaaaaaaaaaaaaaggaaaaaataaatcaagtctttttatactcatgtctaaccatcacatcacactatccatttccagaactttttcatcttaccatactaaacctctgtacccaataaacagtaactccttctctcccctaaactctggtaatctccattctactttctgtctctaggtaatcaactattctaacgatcttacaaaaatggaattatataatagttgtccttttgtgtctgccctatttcacttagcataatgtcttcaaggttcatccattttgcaccatgtatcacaatttcttccttgttaaggttgaagaacattccattgtatggatacacctcatttttctatccacttatctttcaatggacttttcagttgtttccaccttttggctattgtgagtaatgctgctgtgaacatcagtgtacaaatatctgttcaaatcactgccttcaattctttttggtgtatgtccagaaatggaattggtagatcaaatgttaattcttttttttgtttgtttgtttgtttgtttgtttgttttttgagatggagtctcgctctgtcgaccaggctggagtgcactggcgcgatctcggctcactgcaagctccgcctcccgtgttcacgccattctcctgcctcagcctcccgagtagctgggactacaggtgcccgccaacaagcttggctaatttttttttttttatttttagtagagactgagtttcacagtgttagccaggatggtctcgatctcctgacctcgtgatccgcctgccttggcctcccaaagtgctgggattacaggcatgagccaccgtgtccggccccaaatgttaattatttatttaattttttgaggaaccaccataccattttccacagtagctaatatttcacatttctatcagcaatgcactagagttccaatttttccacctccttgaaaacacttattgttttgtggccatcctgatgtgtgtgaggtggagtatcattgtggctttgacttgcatatctctaagtgttagtgatgttgagcatatttgcatgtgcttgttggccatttgtatatcttcctaggagaaatctctactttagtcctttgtccatttattaattgggattttggatttttgtggttgttgatttgtaagagttcttcatatattctggaaattaatcccttatcagatatatgatttgcaaatatatttcccatttcataggttgccttttcactttctcgataatgttctttaatatataaaagtttttaattttcgaggccctgcacggtggttcctgtaatcccagcactttgggaggccgaggcaggtagattacaaggtcaggagatcaagaccatcctggctaacacagtgaaaccccgtctctactaaaaatacaaaaaaaattatccaggcgtggtggtgggcgcctgtagtcccagctactcaagaggctgaggcaggagaatggcatgaacccaggaggcatagcttgcagtgagctgagatcgcaccactgcactccagccagggtgacagagcgagactctgtcaaaaaaaaaaaaaaaaagtttttaattttcatgaagtccagtttatctatttttttcttttgttgcctatttgttgttataaccaagacatgactgtgaaattaaatgtcattaagcttttttccctatgttttcttctcagagttttatacttttcactcttacatttaggtctttgatccattttaggttaatttgcatatatggtatcaggcaaagattcaacttgttcttgtgcatggatattcagctttccctatatcatttgttgaaaagactgtcctttccccattaaatggtcttggcaccgttatcaaaaatcatttggccatatatgcaagcatttctttctgggctctatattctattgctttggtttcaatatcttcctttatgccaataccacactgtattgattactgtggctttatagcaaatgctgaaatcaggaagtgtgagtcctccagcttcattctttattttccaggttgtttggctatttagagtcctgagattccatatgaatttcaggatatgtttttctatttctgcaaaaaatgtcactgggactctggtacgaattgcgttgaacctgcagctcactttgagtggtattgtcctcctagcaatattgagacttcccatccatgaaaaaaaaatgtctttccatctattgatgttgtctttaatttccttcagcagtgttttatagttttcagggtacaatcctttcacctccttggttaagcttatttctaactattttatactattttatgttaatgtgaattggaaattttttcttaatttccttttagattgttcattgttagtgtgtagaagtacaactgatgtttgcgtgttgattttgtatcctgcaacatcactgaatttatttattaactctaacaagttttttaatcttcagggttttctacagagaagtccaagttatctgaaaacacagatcattttacttctttccaatttggatgtctttttttttcttgcctaatttctctggctaggacttctaatactgtgtcgaatagacgtggcaaaagcaggcattcttgtcttgttcctggtcttacagggaaagctttcagtctttctccattgagtatcatgttagcattgggcttttcacacattgcctttattatgctgaggtggtttccttccattcataattagagtgtttttgttgtgaaagaatggtgaattttgtcaaatgcttttattggttctatctaattataggcctattaaatttttttgtgtttccaggaatttgtccatttcatctaggttattcaacagtttgttggcatacaattattcatagcattcttgtagtccttaatatttctgtagaatttgtagcattggtagcaatatctccattttctttttttttttcttttttttttttaagagacagggtctcactctgtagcccagcacaagctagagtgcagtggtgccatcatagcttactgcagcctcaacctccaaggctcaagtgatcttctgccccagcctcttgagaagctgggactacagacatgtgacaccaagcctggatagttttttaaagaaattttgtagacactgtgtctgcctatgttgcccaggctggtcttgacctcctgacctcaagtaatcctcttgcttgagtctcccaatgtgctgggattaaatgtgtgagccgctatacctccattttcatttctgattttagtaatttgaatcttctctcttttttcttagtcaatctaataaatgattgtcaattttgttgatcttttttgaagaaccaacttttggtttcattgattccttctattgtttttcaattttccattttatttatttaaactctaatccttattatttccttcatgtactatctgtggtttgaggtggttctttttctgtatcctgaagttgtaaagttaggttgttgatttgagatctctctttatatttaatgtatttaccattaaatttctcacacaagattcttaacttctctgagccttcaattcttcaactgaaaattgtaataattctcatcaccaggaaatggaggaaaaatgaaaattgcaataagaatgactgtttaacagtattgttttaaagatttaatgtaatattcgattaagctttcagcaaaatgctacacacagagggaaacttcataaatattagctgctattatcactactgttattattagcttgaagttaggcagttctagagccaaatcctagatccacttctcactaattatatgactttggataagttttttcaccactccaagtctctgtcatttcatctgtaagatggaaatcatgcctacccaacagggttattgtatggatcaaatgagatgccagaaaagcatttacagtagctaacatagcattaatcatcagcctgagttgactagtgagagccaagccccaaatgaaaacccactaggacatggttactggctaaaaatgggggagagaaaaaaaagttaagtgcaaagaatcaagcctggtatgttagttttcatccactgagattcagccaagatggaattagaggtgcaagataatttaccggggggaaccaccatgaggaaaagtggagtagaagtgggaggagcctgagagagccctcagaccacgatgcagatctgattcctgagaaggagaaagaggagagagttttagatagtgatgcagttctcagagtttccacaaggctggtggggcgtcctcaagcccctcacccatgagagagaagcagagtcccccagaactgggcttttcattcccctggtgggagcccatgagaagcgagttctctgtgcaacggacttagtaaatacagaatgcactagcctgggccttctgccaatcaagtccctgccacagagacccaacagacttatttatgcctaccacaactgagacactgagaaaaagatgcaaccatgaaaagatagaaagttctaatgacacgcaaaaatagcaatcagactttctcaaatttcaaagccttcagaaatagctgagtgcagacaggccagggtggaattgacagaagactgatcaccaactagcaacacagtgagagagaaaaaattgcaactttcccacaaaactaatgcattccttgaagcaacaagtagagactgcttcatgctgagagctggaacctggggcaccccactgtaaaataacatcacattcattccttctcttttctttccatgacggacgattcagcatctggaacttctcctggtctctcagctggggccactgtcggcatcatgattggagtgctggttggggttgctctgatatagcagccctggtgtagtttcttcatttcaggaagactggtaggtataatggcctttcctcttgttctgtttcctgcagtgctgactgccatgcttgggagagggaagggatttcttcacctgtatctgggactggatctcttcctcctacccccaagctcctgcttctcagcactaattcctgcaggtctcttcttccctggtcttcatgctccctgtacgccactgtctcttagatataattatccccaccctctgctcatttgtttcccagattcaatacattgtcaaagcctcttggtccttttttaacatctcacacttgtgtcattctctccattcccataaacctcaacaactgctcaaagtcctgcttgaccccttgttgccagtctttgaaatctttcttgcatatgactgcctcattaccttcctaaaatctagttcactcgcctactcaagaagacacaggggcctactgtggtgtattagataagttcacatttcttctctttactaatcttttttacttcctttaccaccactcccttatataattccatcatcctaatagatctgtttccctacacatccctgcctctccaccccacatgtacacagaattcttagttccggtgttacacctaaaaacatgtcaaacagggtgacctccttccactgtctgcactgtggagttacccacacccttaatcacaagcaacttctgacctcatgaagaacaaagactgtagcattaacctgtgagtcttaagctcaggacacaactgtgcctgtgactgagaaccttttcctgataaccaattcatatgttcataacagatacagaaatgaagaaggcaaggtccttaattctataacaggagacaaaacctgaaaaataatcataatgccaaaatagaaaggagtgaacatcacaagaaattagagaaatctgacggaaaatatagctacacattggaatcactcagaaacattttataaaatggatacttaagtcccaccgataaattccgatttactggtctggagtgggacccaggcattcgtaatttttaagcctccccagatgctactaatgtgtagccaggatggagaaaccctgttctaaataggtaggacttggggctaaacccatgactttcagctaggaggattagaattgcccatggagtttttctggctgggcacggtggctcacgcctataatcccagcactttgggaggccaaggcggacggatcaggagttcaagaccagcctgaccaacatggtgaaaccccctctctactaaaaatacaaaaaaatcagctgggcatggtggcacgtgcctgtaattccagctactcagaaggctgaggcaggagaatcgcttgaacccgggaggtggagattgcagtgagccgagatcgtgccactgcactccagcctgggcgacagagcaagactccgtctcaaaaaaaaaaaaaaaaaaagaattgcctgtggagtttttcaacatacgtaagcctatactttgttggccctgttcattaatgggctccaccaggaaattaggaatctagttgagaaacagaagctgaatggaaaggccaccttatttgatatgttaaattatatgggaagcactgtcaaatcattagtgatgttaaaccttctctaagttatatttatgagtatgttattgatgtattccaaaagttatataagaaattctagaaatctaattggttatcagccataatgtcatatgccacagaagtaactaaatttctatgtgagttgtgttcttattataataaattatcatcagatttttaactgtactcattttaaatctttgtcattcacagacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaaaaaaaaaaaaaagtctatgtggtcagtcactactcttgctgcagttatgaaaagaatgaggccaagtctgatgaaaataaacttattttgaaaacaaatttgtcttattgggattatctttggtagaaatagagatgcctatgaagagaaattatgttgaaaaaaaactatagtacacctgttatgagactgtcactttgtacattgttgagtttttattatccacctgtagactagagtggaccatgaattcttccactttcttcaatcccattttctaccatggaatcactaagagcaaagtctgctctgttcctgaagctctataagctacagatggataactcaatgtaaatttcatgggaaaacactcatgcctaaggtgtgggccactcagagctcaccagtatgttcaacactataactagagacactgaaactgcaaaccaggacaagaaattgacaacttcacgctgtagacagctttccccaagatgtcagaacaagacttcctaccatgatgaggctcctacccctcttaatttgtcctagctcatgcctgcctctttcacttggcaggataatgttgtaattagaatttcacaggaagtatcttctgagggtagcttaacagagtatcagatctatgatatcactaccaaatttttacataagagatcctttagtccactcaacggctgacattagcagcatctttaatacaactgtttgttcaaaggcaaggtggtcccttttaaagttacacttctagactcacctgttctcactccctgttttaatgtaacccagccatgagatgccagataatagaattgctacctactagctgaacaggaaagaacctgtgctgattctgacacttcttgttgcacatagataaatacaatgggtattatagagactcagttgcagaaattaacaaacatgctgcttggttaaaatgggtagactcatctggctcattctttattccattttagttggtttgcatcttgcctaaggtgcatactccaaactcttggtattattctcctgatagtcacactagtagtctccctggtgtgctataatctctaaaagctttaaatgtttgcatgcagctatccatcgaatgtcaaatggtctctctttggctggaatgacaaaactcaaaggaatgtgtgatcaggaggacatcataacctatgaatgatggaagcccaaaatgatggtagctgagagtaatgtcagtgctttcagttttggtcacactctcacctaagtgagagcatagagactccaaatagggccactgatgctaaatgttacatactccaactgaaattttaagaaagcagatagatcccaaaacagaccaatttaaaaaaataaaataaattaaaaaataaaaaggccaggcatggtggctaacgcctataatcccagcactttaggagggtgaggcaggcggatcacgaggtcaggcgtttgagaccagcctgaccaa

SEQ ID NO: 12356 - DNA, 15273 bp, Human
ttgggaggctgaggcgggcagatcacgaggtcaggagatcgagaccatcctggataacacagtgaaaccccgtctctactaaaaatacaaaaattagctgggtgtggaggtgtgcctgtagtcccagctgctggggaggctgaggcaggagaatggcgtgaacccaggaggtggagcttgcagtgagccaacattgcgccactgcactccagcctgggtgacagagcgagactccgtctcaaaaaataataataaaataaaataaaaagaacatgaagtatttgcttccctgatggcaccagccacacttccagtgctcagtagccccatggccagtggctacagtagtagatagtgccacattgaaaatttccttcatctcagaataacagaaatggtcagcactggtctaaaatgacatgggtcggccaggtgcagtggttcaagcctgtaatcacagtactttgggaggctgaggcgggtggatcacctgaggtcaggggttcgagaccagcctggccaacatggtgaaaccccatctctactaaaaataaaataaaataaaataaaataaaataaaataaaataaaataaaataaaatgtgtcaaactcctattgatgcttcaaaaccccatctcccttgcctcctcttacatgcagctttccttgattcctccgacagagccccaactctccctccagttcctccagccccaagcctctcattctgtcctgtacttgctcatatagggaaacagggtgggcggggtgggggggttccgcctgtgctggctcatacagggaatccgggttgggggttggtctgtgccagctctgtcttcctgggcatgggctgggccagagctaaggtctcctgagagccagcactgcctggcaggagactgtcccggagactttttaataatttattattattagggtttttttgtgttttttttttttgtttttttttttaagacggagtcttgctctgtcgcccaggctggagtgcagtggcgcgatctcgacttactacaacctccgcctcctggcttcaagtgatcctcccacctcagcctcctcagtagctggaattacaggcatgtgcccccatgcccggctaatttttgtatttttagtagagacggagtttcgccatgttagccaagctggtctggaactcctgacctcaagtgatccgcccgcctcggccttccaaagtgctgggattgcaggcgtgagccactcggatttttatttttatttatttatttatttttagagagaggctcttgctctgctgcccaggctggagcgtcatgttgtgatgataactcactgcagcttcgacctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccacgagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgagggggctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccgggtgagtgaggggcgccccttgtccccccgacagcgcggccgtcgcacgctccgaccggtgcaggagcccccaggcgcccccggcacctcccgggcagggagcttggagacccggggcggacgggcccttgttctccctgacgcctggtggggggatgtctgcgggcaccccctgaggctcccgcgaatcttggggagcacccaagtctgagatctgggggacgagtgacccattcccccccccaacatctaggggtagttgggtctgacttcgtcccctcgccatggccccaggacccccacgtgtgaagcccctggcgcccactcaaccttcgagaaggtccgttcaaggtccgacaacgctctgggggtctgggggggaccccagcaaccccgtcatctcctggccacacttctgcttttggggcctcttagctttgggaggggaaggggcatggccgagtggtttttgagaagtgttacccccccacaaacaggaatttcctggcctctgggacaccttgggggtgtcttggggggaggggcggtagccgctttgcacggtctttgtctcccatctgactaatttaaacggataacaaagaggttctctgaaggtggccctgagatatgtggggttttgcagcctcgaaagaagagctggggcccggcagggcgcgggggctcacgcccgtaatcccagcactttggggggcggagctgggtggatggcttgagcccagcgagttcgagaccagtctgggcaacatggcgaaaccccatctctataattaaaaacaagccagggctaggggagacactttttaagagagcacttgtggttctagctcagagaggaccagacacttctgcagggtcacacagcagggtcctggacaggattcccagggaaagtggggggcgggggttgtgatgcgagacccacggacaggaccgggacctgaccctccaggaccttccagctggaggggggtgtcgtccccgcccaccccctcccccgacgcccactgggcacctgggaaggtgtccttacagctgacttctgcaggggaaactgcctctgcacgctctgagggcaccggccctgccagccccaacagccacctgcccggcggcactccagggccggcagactggagggagaattcctgcttccccgctgtgagcccctgcaagccttcagaccagctcttggccaaaaagggaggctgaggcttggggtggtcaaggcctgagccagggtccccagcccggggctcacgactcctccttcaaggggccatctgcaccctgcattcatagagccccccgtgcagtggggtgggcaccctgccgcaccctgcatacagccggctaagggcaccggtgtccacagggacccagagacgtcgttccagctgcccagggccacacagcccacaagtgacagggccaagaccggaacccagtacctgctgggcctgcggaagtgggagcgggcacaggagggtggggcggcttccggagacggggtggggtggggtgggggcaggttgatacctgccctggcgggggtgaggacagaggctggaagagccgcttagcaggctccccgcgcaaccctcagtctgtccgtttggagggtgggcgaggcgtcggccagcttgccagggtcacggaagggtcgcctcccaattagaaaccagcttccccctggcttcccgctcacacccgctttaccggctgcttgaaacagccagagacccgccccccgccccgcttccccgtggctcagttgactcccggctggacggcacggaggcagctcggatccacagtgtctgcggccttgcatcccggcttgggggtccggacccgctgggaacagctggttcagatttagccggggaggcagcgcgcattcctggcagtttgtggtgaacaggaatgtgctggaaggccggcggccgggcagcgggggggcgggggtgggggaggacggcagcggctgggggtggggccaggggacctgggcccctgagccggcagagacgcggcgcagctgggcaaggcagggctgtgtacccagcagccaccgttctcattcctcgggatcaaagttgccggcggggcggggctgcccccgggcgtggaaagccaagctgggtgggctgtgagctggtactggggggcctccccgcctttgcctcctctgggctacgagctgtttccaggcaggtgccaggtcaggggaccctaacccaaataatcccaggcaggtccaggtcaggggaccctatcccaaataatcccaggcaggtccagctcaggggaccctaacccaaatcatcccaggcaggtccagctcaggggaccctaacccaaatcatcccaggcaggtccagctcaggggaccctaacccaaatcatcccaggcaggtccagctcaggggaccctacccaaatcattccaggcagatctagctcaggggaccctaacccaaatcatcccaggcaggtccagctcaggggaccctaacccaaatcatcccaggcaggtccagctcaggggaccctaacccaaatcatcccaggcaggtccaggtcaggggaccctacccaaatcatcccaggcaggtctagctcaggggaccctaacccaaatcatcccaggcaggtccagctcaggggaccctaacccaaatcatcccaggcaggtccagctcaggggaccctaacccaaatcatcctaggcaggtccagctcaggggaccctaacccaaatcatcccaggcaggtccagctcaggggaccctaacccaaatcatcccaggcaggtccaggtcaggggaccctaacccaaataatcccaggaagagatgaggaagcggaggctgagtggggagctgtccgcgggaacctggggagatgggtgcagagcagggagagggatttgattttttttttccttctctcttttctttctttttttttttaagacagaggctcactctgttccaggctggagtgaagtggcccgatcttggctcactgcctcctctgcctcctgggttcaagcgattctcctgcctcagcctcccaagtagctgggactacaggtgcccaccaccacgcccagctcatttttgtattttagtacagacgggatttcaccatgtgggctaggccagtctcgaactcctgacctcagatgatccgcccgccttggcctcccaaagtgctgggattgtaggtgtgagccaccgcacccagcccaaaccctactttattctccctccagcgtttatctcccgctcccgctacacgacctgcccccatgcttatggccccctatacactttgccgtctgcctcagtgctgtctccgcggtcactagtggctggatagggacactcgaggtccccactggtgcacacccactgcccaggagcacacagcccattccccacggcggtgtctcagagcaccgaaggccaagaaagctggaatggccgggtgcagaaaggtggcagggaatcggtggcaaggagccaggtgcgtgactagaggcggtcagcctcgggggcagctccttcgggagttgctaagaagcaggatgggggccgggcgcggtggctcacacctgtaatcccagcactttggagggctgagacgggcagatcacgaggtcaggagatggagaccatcttggctaacacggtgaaaccccgtctctattaaaaatacaaaaaatgagctgggcctggtggcgggcgcctgcagtcccagctactcgggaggctgaggcaggagaatggcctgaaccggggaggcggagcttgcagtgagccgagatcgcaccactgcactccagcctgggcgacagagtgagactctgtctcaaaaaaaataaaaaagaaaaaagagctgatggttgcacaacattgcagacgtacgaaatgctgtgaaatggtgcggtttcaggtggttgaagtggtaaacgtcaggtgtgatatagcggggaggtgagaaggcagggcggggaggcagatccggccaggtttgtcctgcaccgggagtggattagagctgatgtttatcagtgagttctaagccggttgtcggcctgcttggagggcggtttatctgtgcccgcctgcagtggctggggcgcccccaatgatgggaaaagggagcatctgcgtgggtgtggtgaggggggacctccaggccgctctatctgctgttgccctggagtccccggccccaccctctgcagagcttctgtggggttcctgctgggggtgcccccagcccagctcagtctcgtgccctttgctccaccagctcctgtccaaatatgacccccagaaggaggcagagctccgcacctggatcgagggactcaccggcctctccatcggccccgacttccagaagggcctgaaggatggaactatcttatgcacgtgagtacacgcagggacacaggctgtctcacacttaacaaatcttggtttttctcactttttttcttaattaagaaatttttggggggccgggcatggcctggctcatgcctgtaatcccagcacttttggaggccgagggtggtgggggggggcggtggatctcgaggtcaggagttcgagaccagcctggccaacatggtgaaaccccgtctgtactaataatacaaaaaaattagccaggcacctgtaatcccagctactcaggaggctgaggaaggagaattgcttgaacccgggaggcggaggttgcagtgagccgagatcacaccattgcactccagccggggtgacacagcgagactccatctcaaaaaaaaaaaaaaaaaaaaaaaaaagttagctgggcgtggtggctaaataaataattttttttttttgaggtggagtctcactctgttgcccaagctggagtgcagtggcatgatctcggctcactgcaacctccacctcctgggttcaagtgattcccctgcctcagcctcccgagtagctgggattacaggcgactgccaccatgcccggctaattttttttgtatatttagtagagatggggttgctccatgttggccaggctggtcttgagcccttgacgtcacgtgatctgcctgcctcggccttccaaagtgctgggcttacaggcctgagccaccaaacccagccaaagattactttataagagtggaaacttgaggcctgggatggtggctcacgcttgtaatcccagcactttgggaggttgaggtggacggatcacgaggtcaggagatcgagaccagcctggacaacatggtgaaactccatctctactaaaaatgcaaaaattagccgggtgtggtggcaggcacctgtaatcccagctactcgggaggctcagggctgaggcaggagaatcacttgaacccgggaggtggaggtggcagtgagtctagatagtgccattgcactctagtctgggtgacagagctagacgccgtctcaaaaaaaaaaaaaaaaagagtggaaactgaggcccagagagaggccgtgagtttgcccaggaaggcgtgagcttggctgagatcagcatcgggtcttcacggttcctcgctgctcacagaggtttctgtttcccccgccccatgttgtgccctccagactcatgaacaagctacagccgggctccgtccccaagatcaaccgctccatgcagaactggcaccaggtgaggggctggtggagcggagcagggatggtgctgggggcccatctaacaggtggggagactgaggcccactcactgtccctctcctgcctcttcccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggtgaggcccagagaggggcagccacctgcccagagtcacacagcgaggtggatgtagctgctgcattcactcgtttgcaaatttctgtttgtttatttttgagtcggagtctcactctgtcactcaggctggagtgcaatggcgtgatctcagctcactgcaacctccaactcccaggttcaagcgattcttctgcctcagtctcccgagtagctgggattacaggcacctgccaccacgcctggctaatttttgtatttttagtggagactgggtttcaccatgctggccaggctggtcttgaactcttgacttcaggtgatccgcccgcctcggcctccccaagtgctgggattacaggcatgagcccctgtgcccggcctcgtttacaaatatttctgagcatccgtgaggtgccaggtacttcagattccttggtgaacaggaaggacatggtctaccccttatgcagttcagtctgatggcggaggcatgcaaaagtgaacacagcattgtattatgcattatatgtaagctctggccgggcgcagtggctcacacctgtaatcccagcactttgggaggccgaggttggagaattgcttgacaccaggagttcgagaccagcctggccaacatggtgaaaccccatctctactaagaaaacaaaaattacctgggcgtggtggtgcatgcctgtaatcccagctactcgggaggctgagcccaggagttaagaggttgcagtgagctatgaccacaccactgctctccagcctgggcaacagagcaagactctctcaaaaaataatcataacaaaagtaataaataagctctgaactgggagaaatgccttgaaggagaagaatcagacgaatgttgagtgtctagtgatcttcaaacccagaccgggagcgtgggtgggacagtggtgtagaccgggagcgtgggtgggacagtgtctggtgtagaccgggagcgtgggtgggacacggtgtctggtgtagaccgggagcgtgggtgggacacggtgtctggtgtagacggggagcgtgggtgggacggtgtctggtgtagaccgggagcgtgggtgggacacggtgtctggtgtagacggggagcgtgggtgggacggtgtctggtgtagaccgggagcgtgggtgggacacggtgtctggtgtagaccgggagcgtgggtgggacggtgtctggtgtagaccgggagcgtgggtgggacacggtgtctggtgtagacggggagcgtgggtgggacacggtgtctggtgtagacggggagcgtgggtgggacggtgtctggtgtagacggggagcgtgggtgggacacggtgtctggtgtagaccgggagcgtgggtgggacacggtgtctggtgtagaatggaatgggagtgtgtgtttgtgacatggtgtctcacgtagaaggaacagcaaggtcttgacattggaattggctgggctgttagaggaagcgggagctggttttctcctggggtaactgctccaaatggtgttttcagatgccccctgtggctcccagtaacctcacgtggggaatggtggtcagggaggagccgggcgcagacatcccagtgaggggcagagccaatggcctggccatggtgcccggggattgggtcagaggaggtggtggaaggtgagagagaggaagcgaaaaccacgtccccatccccagaattcttggcctgagccctggaaagctgagctgttgcctaagacaaggcacgctgggatgaagcagccccatgggctgggcgcggtggctcacgcctgtaatcccagcacttttggaggttgaggcgggtggataacttgaggccaggagttcaagaccagcctggcaacatggtgaaaccccgtctctactaaaaatacaaaaattagcctggcgtggtggcacacgcctgtaatcctagctacttgggaggctgaggcaggagaattgcttgaacctgggaggagggggttgcagtgagcggagatcacaccactgcactccagcctgggtgacagagccagactccatctcaaaaataaaaataaaaaactgaaacagctgtatgatgggtgtgtggagtgtgtggagtcccagacacccgagagatgtgcctgtgggggctctgcgcggcaggcagaggtgacaggccgcggcctggtctctgtcccgcccccagggcctagatctagggtccctggctgccctctgctggtactcccggcccctttccctcacccaggccaagactaaggggctgcagagcggggtggacattggcgtcaagtactcggagaagcaggagcggaatttcgacgatgccaccatgaaggctggccagtgcgtcatcgggctgcaggtgggcgacagctcccccagccccagggaccacggcattgggggaccacggtgttgggggacagcagcattgggggacagcggcatggagccctgtggtccctcaatttcagggagggaccggaagcttgttgggtgcagtctgacctctcccacgaacctccctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtggggctcgcccgggtgcccccgactcctctccctgcccctctacaccctgtggtctcggcccctccctggggccacctccagcttctctccccactctcagtctcagccccttccctagaccacctccggcttccctccccgctctctgtctccgccttggatttcagcctctgtcatttccacctggctgtgggtctctagggaagttactacctcaccctgtgtcattttcccttaaggactgcccaaaggtccacccaattctttttttttaatctttatttattttatttatgtatttattttgagataggatctcactctgttgtccaggctggagtgcagtggcacgatctcggctcactgcaacctctgcctcccgggttcaagagattctccttcctgcctcagcctcccgagtagctgggactacaggtgcatgctgccacacccggccaatttttgtatttttagtagacatggggtttcaccatgttgcccaggctggtctcgaactcctgagctcaggcaatccacccgcctcgacctcccaaactgctagggttacaggtgtgagccaccgcacccggccacacccagctaatttttgtatttttagtagagacggggtttcactgtgttggtcaggctagtcttgaactcctgacctcaggtgatcctcccacctcagcctcccgagtagctgagactacaggcgcccgccaccacgcccggctaatttttgtatttttagtagatatggggtttcaccgtgttggccaggctggtcttgaacttctgacctcaggtgatcctcccacctcagcctcccgagtagctgggattacaggcatgtgccaccacgcccagctaattttgtatttttgggagagacagggtttcaccgtgttggccaggctggactggaactcctgacctcaggtgatcctcccaccttggcctcccaaagtgctgggattacaggcgtgagccagtgcacccagtgaaggtcccctcttctctccaccatgacctgctccacccctccttcctctccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagcccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaagagaaggtggccaagagagttggcgtcgatgagggcgtgctttgctttgatgcttttgtggggagagaggaggtcttgggggatggggggatcaaggggaaaatgtccacctcaccattgggaggaggagcaaaagctgaagccacaggtgagtctgggtggaatgaatgatttgaagggccgggacttggggtagagggagaggctgggcttcctggccatttggagaagaggcagttccctcaaatgccccccatgcgctttggctgcactctaccttacagcgcaagtctcgtggcctcagcctggatgtctccccgttggcgaactcctatttatcctcaaagccccaacggcaatgccacctcctgccgcgggagccgtccccacgcctctcactctccccagcgccttcaaagctgtggacccacacgctcccatttcagcttcacctccagcctgaagagtttatttcaactcttcttccagagtgggaaacgggttttcctcaaaatcagggtagccactataatcggagactctagaatgttggccccctccccctcctgccatcctctgcagaagccgaggagcgttcgtggaatgaatgaatgaacgaatgatctagtggaacccctactttacagacggacgagtgtagtcccagagtctggactaaactagagggagcctggccagccccggggacagcggggacagagggaactcctgcaattcggagctgcggtattgcagccggttatacaacgtggggaggcagcctggctccccaaagacagcgcagcctcgttcccggagggcggcctgcctgggacctgccgggcactccgccaccctacggtgatgcagcaagagccgcgcggtccctttaagaaacccggctaggcgaggcccttctgtgatcccgcctcctcccttggcccgcgcagctccgacggagcaggccagtgagtgacgggcagatcgcccaatagcagcgtgcagaggcaggggcgtgccccggcgctgctacctgcgcgggcaagctcagcgcacttggcttaaggggcggcgcgctccctgcctgctgctgggcggagggaaggcggcaagagctgcggagcccctggaaggtgagaaggactcggagagggaagaaggcccgagactcgagaatgcggggttggggccgggagggatgcaagttccctgggaattagggggtccagcctctgacctccttccggtgaatgttgacgacggctgaattgatcactgattctcaaggggggcatcggacatctgggacccttaagagggcctttgccgatcacacacctgcagccccctgcccgttagaactcctgcactcccccttgccccgtcttacaaatggagaaactgagcccactcccccagatcctaagtcccgcttgatgtaaaggaaagaaccctggcgtaagggtctgggtctgaggtcccagttccggcctggtcacctttagcaacttcctgcccctctgtcagcgtcagattctccatctgtgtcagaggtggaccggcccaaggaaaatagatcaggaatcgctgactccaggagtctctatcccagccccttcgcctgactctttctctggctcccgcggtccctctgagcgattaatgctacataaggtgtgggcagagctggggtcgtgcctccagctgggcaactgcctgtctctctgggtgcctgggtttgctttcttgggcctcggtttccacttctgtagagtggggtgatagtccagcacttcccctgggcgtgtgaaatgtccagcactgccaatattcgttgctgttatcttcggagaacagtgaggggaaaggaatccttgcctgggctgggccaggcaggaggctgggggtcaggacctggaagaggcttccaggtgaggcttggggtggagcctggtgacgaaagcgttaagcccaaactcggtccctggaggattagaggat

SEQ ID NO: 12357 - DNA, 6611 bp, Human
gatgtgagcccagccttctcacactagagtccctgtttgttctcctacccggacttttttgttgctgttgttgttttgagaccagagtctcgctgtgtcgcccaggctggagtgcagtggcatgatctcagttcactgcaaactccacctcctaggttcaagagattctcttgcttcagcctcccatgtagctgggactacaggcttgcgccacgacgccgaataatttttgtatttttagtggagacggcgtttcaccatgttggccaggctggtctcgaactcctgacctcaagtgacccacctgtctccgcctcccaaagtgctgggattacaggcgtgagccacagtgccggccttttttttgttttgttttgagatgggagttcaactcttgttgcccagattggagtgcaatggtgcaatctcagctcactgcaacctctgcctcctgggttcaagcgattctcctgcctcagcctcccaagtagctgggattacaggcatgtaccaccatgcccggctcattttgtatttttagtagagatggggtttcactatgttggtcaggctggtctcgaactcctgaactcaggtgatccactcacctcggactcccaaagtgctaggattacaggcatgagccactacatgcagcccccaggagctcttgatctgaggcataaagatgcttagagggtttccaaatatattttatggtcacctattctcccaacaatgtgtgctatactgtgtgtttacacataggtgtgtctttagaggaaagggttcaaagctttcattagattctttttttttctaataaagaaaaaagctttgttgcccaggctggtctcaaactctcaagctcaagcaatctgtccgcctcggcctctcaaagtgttgggattacagccatgagccaccacgctggtcctcattacattctcaaaggggcctattgaaaaaaaaaaaaaaaaaaaaaaaaaaggccgggcacagtggctcacgcctgtaatcccagcactttgggaggccgaggaaggcggatcacaaggtcaggagatggagaccatcctggccaatatggtgaaaccctgtctctaccaaagtacaaaaaaaaaaattagccaggcatggtggtgccgtgcctgtaatcccagctattcaggaggctgaggcagtagaactgcttgaacctgggatgcagaggttgcagtgagccaagattgcaccgctgcactccagcctaagcaacaagagtcaaactccgtctcaaaaaaaaaaaaaaaaaaaaaaaaaaaaaagatgagactgttgagtcaggattaggatccaggtctgctggcaccaatttcagtgctctttatactttctgttgctattcattcattcatccattcattcagcaaatttatatcaagtatctggtatgtgccaggtatgattccaaattacaccattcccagattattctgagaatgctgcagtgccaaactcttggtatcacagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcctgggcaacagagtgagactctgtctcaaaaaacaaaagattggtccttgacgggcctgagatatcaaagacattgaatggctagcagaatgcctgcaatttacacctgaaagaggtatctgtatttctcaagaggaagtgcttgatctgggtctcatctttttcctgtcccattccactagcatttactgcagaatcttccctgtagtcataattttcttgaacatgtcaagttcttttttttctttttttttgagacggagtctctctctgttgcccaggctagagtgcagtggcacgatctccactcactgcaagctctgcctcccaggttcaagccattctcctgcctcagcctcccgagtagctgggactataggcacccgccaccacacccagctaattttttgtattttcagtagacacagggtttcaccatgttagccaggatggtctcgatctcctgacctcgtgatccacccgcctcagcctcccaaagtgctgggattacaggcgtgagccaccgtgcctggcctcgaatgtgtcaagttcttactttgaggtaatctccttcagggctggtagggtcagaaatcttaagagaaacaaagggagcgtgacacatttctgcttattggcttttctgtggaattaaaactatcctgctttaatggatagtaaatggtagtagtagtagttacaaaaccactctgagagggcaattattattattattattattattatttttttttttttttttttttttttgagatggagtctcgctctgtcgcccaggctggagtgcagtggcgggacctcggctcactgcaagctccacctcccgggttcacgccattctcctgcctcagcctcccaagtagctgggactacaggcgcccgccactacgcccggctacttttttgtgtttttagtagagacaaggtttcacatgttggccaggctggtcttgaactcctaacctcaggtgatctgcccacctcagcctcccaaagtgctaggattacaggtctgagccactgtgcctggccagagctggtttattttattttattttattttttgagacagagtttcgcttttgttgcccaggctggagtgcaatggcatgatcttggctcaccacaacctccacctcccaggttcaagcaattctcctgcctcaccctcctgagtagctgtgattacaggcatgtgccaccacacctggctaattttttgtattttaagtagagatggggtttctccatgttggtcaggctagtctcaaactcccaacctcaggtgatctgcccacctcagtctcccaaagtgctgggattactggcgtgagccaccgcgcccagccagctggtttattcttaaggctcaaaggaacactttcgtggtaaggttcaagaggcaacaaggtatttcatattatattacattaaactggtaacgcaaaagtaaggcatatacagtacggaatagag

SEQ ID NO: 12358 - DNA, 73788 bp, Human
  misc_feature (1)...(73788): n = A,T,C or G
ggtcaggaaattgctcctagccagagagcttggatgaaggtgcgactcaccttttgtgttttttctaagggatcacagtctgtgctgccttttatttgatgcttaaaaacaggtgcttcatatgttttgtccagctttctacttgtttacaacaggcagagatgttcagtatagttactctgtcatggctagaagcagagtaaacaggaactcagtttcatctgcaaataagaatatggcaaataaaacaagaaacttcataaatagattgggtgttaggactaatggtggaatcctaattagggaaaaggagtcaggctggtgggagcaggggagcataaaaagaaaaaacagataaactgtaagtctgcctttcttcacagtccaggacacatagccctcctgtgcaaaaatctcacagtcctcctgtgcaaaaaactcacagtcttcctatacgcaacttatcaccagaccctctgctaatagaaaagtgcaggttagctcactgcaaccttggcgttaccagtactgcacatagccctctccagcacaagaacgatcctataaaatccccaccaagccttagtctcttttcagtcagctcctctcttgctcatctgcccattgctttcttgcaaagtgttttcctactttttctaataagcctgcctttctttaccaactgtcttggtaaattcccttattgcctacaccaccggccccagttagtcactacttgtaacagtaattgtatatttgggggttgctgaaaattaatcagaaaatactgtccgtttcaaccctttttatggttgcattatataattagaaaatttttgtaataggaataagtatttgatatcaatccttgtttcttcattagtgactatattttgaatttataacttctttaatagcaacgaatgatagcccactcaatttgttcaaacaaaagtagggaaatcctgtaaaggtgcagaattaccacagaattaaggtacatttgatcactgcaattcccagagactatgaatggggcagactcttccaaaagccttgaaaaatattttgagctttaatgtttttatctgcatgttagaaatttaatacctaatttctgcatctgataaggttgatgcctgtcaacatttcacagtcttgtgaaattacatttatgtttttaaggcccacgttaaatgttatataagaattaattgttttctttgaggggtgggaagaatgttcttgatattgtcagttctatgctccaatcccatgtgtaattataaggtaatacttgaataaatgaaaatcatatgataatatatatttaaaaaagactttgaaaattattaagtatatgaacatggggaatatatttttattaaggtattttatttttataattcattctctttctacttttaaattgaaaatcttatgttgacttactggaattttttgagtactttttgtctaattgaggtaattttaagttgggaggtttatattagtgaatgtatgttgatttatgaaacagtataattttgttcctttaatttttaagaagtaattgaatccctgatatctttgtttcgtatctttgttattaaggtatataaataaagggtagtggttaatttaaaagtatactgtggtttgatttcaatgggcatcaatagatagcagtaattcttgcctaagcttttgttatgttatctaatttcccagacatatattttaaaattcttagttgactaatttccttttcttaatattctagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattaggtaagactattttgtttattccattatgttagaaacattttaaaaattggaagatactttttaatgaaaatgatttagttatttaattgtttagttgtttaatggttgtggtaattttaaagaataaagatgttggaaatttcttttgtagttgtattttcatgtgtaaggaattccctagtataggagtgtctactttagccatccagagattgactatccagattatgagaaaacaaacaattaaattaaaatagcccagtaggctgaaatagctgccagtaaagcctttgcaatgttctttaggaatgatatttaggccactttttcagattcaaaaatgtttagtaattgataacttttggggcataggtatggcttaaagtcaagttaatatactgaaactgcatacaattaatgaaatttacatcattgtaatttaattttttccttttacccttccttctgccccaagtatgtttggggtggggctcaggagtctatattcttaacaaggggctcagagtattgattcaggttattataattaggcaagtttgggaaacactggtctaattaagcttcctaactctatattcaaggcaattggaactcagtgagggaaaatgaattgtcagatgttcacaacaattgaataacaagctcaggatcaaaatctaggtattttaacttccagtacagtagtgatgtagcttttccattgcaaaaaactaagaaggagggtgttatggttataatggttgtatagaagtcagtattcaggtaccaggagggctctggtcagtggaccaccaagagtgaactttagatgtaaaaagaaaatctgacttctcaatttattttagattcaatcctgctgctagaaataaatccaattttatgtttatgtattcaactacttcttcttttcatcttgtgaagtaccctaatttgtagtgactcattcatcttactagttttggaaagttgatacacattaaatatttgaatgaagcaagccaataaaaggcaatgatatagtttatacatacttgttacatgatgtgactggcagactcaaatttagtagggactcaaatatttgaaagggtgaatgttttatgttttattatttgaagggtattgaattagatactatgaaattcttaaattgtttcagactttggagttagagaaaacattatttacgtgtttataatctgttattattgtgtataattctcaccaacatccatccagtacttattacatatttatcatgtaccaggcatgattagacattgataatatgctggtaaaatataaaaatagtgccttatggaacagataagtcatttaaccactcagggcttcacgtttttctttatatcaggattattaccacttcctaggttattgtgaggattaaatttagatgatactgtaaaaagaccaacactatacttgcatatactttggccatttttattcagaatctgattcatataatttatttcaaaataactacacacacacacagatacatatgtatttgtgtgaatacacacacatatatacacacacggcacatgtatataggtatgtgtctgtgtgtgtgtgtgtgtattcacacaaagctagttgaccattttaacaagggcaatacgagaaatatgagaaactgtatgtaccatatactgaagctatatatgtcatatactgaaaaagaggtaaagcacccctttcttttgtagtctgtgaataagcaggaataggagtatcgtggcttcttagtacatctgtctgtctattctatctatctaatttgtgtatgggtctttgatgtgtgtatatatatatctgtgtatgtttatttaaatttatttaaatgtattatctctatatatctgtgttttatgtatacttataatatgtacgcatagagctaatttaatcatttattcttcctttttcatagacttctaaaagggtattttactgctttttcaaaaagcctcagatggtttctttgttaagaaaatgttattatgagcattaatctttctatacctggataaacactaatgttaaaagctggtttatattcttaaagtactttctttaaaacctcattaatagatacatcttgaacatttgattactggtactgaaattttatatggttagtattggctaagaaagactataaggtatacatgttataggtaagtgattttcaataaaggtactgttggtatttggggctgggcagttcttttttggggtagaatactgtcccagacattgcagggcatttaaaacttgagacttgtggtgcttggcatggtggctcacatctatcatctcagaactttgggagaccaaggcaggagggtggcttgaggccagaagttcaagaccagcctctgcaacatagtgagagcctatctctacagaaaatttaaaaattagccaggtgtgatggtgtatgcctatagtcctagttattcaggagcctgaggcagaaggatcacttgagctgaggagtttaaggttgcagtgacctgtgattgtgccactgcatttctagcctgggtgacagagtaagactctgtctcaaaaaaaaaaaaaaaaaaaggccatgagatgaaaaaaaatgggtaaacatttgaaataataattttaaattatatttatttatttgctttcaaatttaaatacgtgtgtttatcatttttatctggattctgtttttcgtttagaatgaacagtcaggtgtggtggggcatgcctgtagttccagttactggagtggagtggctgagttaggaagacaggaggatagcttgattctaagaggttgagtctagcctggacaatatagtgagatcctgtctgtaaaaaaaaaaaaatgataataaggaaggtgaattgatgtgcaaatactccttaagatgggtttacatcctgataagcccatcttaagttgaaatatcataagttgaaaatgggcattttatagacataatgacattggaaaccccaaaacacaatatccagaaaatgctggcaacacagtacgctgtacaatattggttgtttactctcatgattgtgtggctgactgagagcggcagctcactgcacctgcccagcatagagagatagtatcatacttcatattgctagtccaggaaaattcaaagtatgatttctattgaatgcatgttgtttttgcatcattatataaagttgaaatatctcaaattgaaccatcatagttgagaacttctgtgtttgtagttttattttatgtgttggtagtaaggtttgcattctgccattggtagatgtatttctagtttaggcagtcaaactcctaggaatgtttttgacaggcactgaataagaccaaacatagctagctaaaatatagggttgtattatatatgtatttttatttttctgtatattatgatgttttgacatcttaaaaaacctttctggctgggaagagattacccctccagaggttagccaattcttagaattagccaaaaactcagctgggagcatgcctatgatatgtgctctaaccaatccacactccttttctatctggcccatacacccaagaggcaatattcctctaccttatcttccccagggccaggtacctggaagctagagacccattcttatagcccaaaagtcactggaattattcaaactaagtaatcctttaccatttaccttgccctgcattgcctttcgctgggaaaccccagtaaatgctttggcctaggcactccgcttgctcttgtttttctgccacctaaccaaaacctagtgtttcccctgtgaccctgtgtggcatgcgatgtgacttcctgtttagaatttgttaagtatagtaacctttgttttcatgagggactttcctttgtgctctgtggccacatctgtctatcataaaagagcacagaagagaatattatgtattgtttaatgaataaccatacctgaaataagatattgtaacttttgacataattaagtatgccacaggagcttccataacatctcttatttttgttttttcttttcttattcctacatagctaataactccttattttattgtttatgtttgatagttgctttgttgaaaattctgcaggccttatatgtatcaaatgaatatgtagatttggatgggttcatcattttcatgtttattgatttttctgctgtttctaactgaagctattataaaacttacctgaaaaatgtaataactaaggaatagactgtaagacggtaacgaaaaattccaatatatagtggtttcaagcaaatggtttattttcatttcacacgacacagaccagagggagaaacccgaaggctgtcagggtacctctgcatccttaatatgtgacttccgtctctgtgcacaaggtaattgctttagctgtttccatctcccagccaggaagaataaagaaaaaaaggggcaggagcatatacattcctttctggaagtgaggaggaacatacttaatgtctactgacattcagaacttaagtcacatggccacactaagctgaaagagaggcaggcaatgtagtctttagctgggcagccattttcaagcttgggcattctgtagggggagaatggctattggtgggtaaatagttgtttctgctgtaaacatatatgtgtagtttttgaagaacatagtttttgataattaccaccccaaagccacaaaattggtaaaactatattttcaagtttaatatggcacaatgctttactggaaatgtcttttaaaattggattaaaacatcacttaaccggcaccagtttacttggatttttcttttaatgggattctcactacatgcacattccctccctttcaatcacaccatacataaacacatactttgtgcatcatttgtttgtttatgtttataacaaatactgattaaaagtgaggctgtggctatgctaggtgacaaaaatgcacttgtgttattgtttaatctttgttcataattgtgacttcaagtttcagcaacatctctagtattcaaaaaaagatgatccttttaggatttagtgctttctgctgtgacctcaaaggtatgaaagccaacaaaaatagtacttttagaggcatttgttatattttgattctttgagatctgtagttaacctaacttcttgtcctgtgaaattttttccttgtgtacttgtgaataaacatcatatacaaaatagttatgaaaagatgataatatgtttgggaaataaaaattctgtcttggaactcaaaaccagaattgtcttttgttaatgttctttgacatcaagttcttcattgtgaatatcattaaattatttactgccaagtttactagaggaaacctaacttttcattcataatgcatttttgaaaatgtatatgaaggcacatctaaacattgaactaattgactaaaaatatgaaatattccgtaatttttaaaaatatgtatataggttcaatgagtatatgaatagagcttaaagttgaccacttttggaacttctgttgagttccatcctttttgccaactgtattgagtttatgacacctatgttacttagcgttaatatgaatacttcttttttgccctttattttctctcaattttgtacaataaggacaaaattcagaaaagtattataatatttgtataaataaacactactgtacaaaggtggcaacacaactgaagctgaaattttgcctagaagttttgctactgttcatcagctgctgtatggaaggaggttcaggccattatgctggaaaatcacatgtgtcatagttgttgattgcttcttctgtgttcagtagccaatgtgaccagggccagttactctcactattaaaaaaaaccccaaaaaactatcattgttttgttttcctcactataaaagtaatacatgctaattgaaaaaatactggaaattcagaaatcatattgtacagttttttcattctttttagtgtacttatacattaatcaaattatcttcatatacttagtgcttccaaaattctctttagtactctactttgactacagatgctgaccaattggaattttctagattatttttgatttgcagtgctaaagattactgtaattcacttgaattctttacaagttagtgatattaaatctctagtgatattagatattttaaatattttatgtaatcaaatctgtataaaacgttatgatcctaattttttttttttgatggagtctcactctgttgcccaggctggagtggagtggtgtgatctcggctcactgcaacctctgcctcctgggttcaagcgaattctcctgcctcagcctcctgagtagctgggattacaggcgtgcgccaccatgcctgtctaatttttgtatttttagtagagacaggatttcaccatgctggtcagtctggtcttgaactcctgacttcatgatccacctgcctcagcctcccaaagtgttgggattacaggcatgagccaccacgcccggccatgatcttcttctgctcagaatatccttaatatgtggatgtgataaatattctttcttgtttttagcttatatttaactcaagatatttggaattaattttgttgtaaggtgaggcaccagtaactatttttctcctcaaagtggttagtttatcacagccaattattgaatgtttttaaatattatttcagatattttatgtttatttaatatacttactggattaaatatgagccctagtaagattacatctcataataatgatgaatttaaaatgaaatgatagttggaagaggaatttggtattcttattcttatataggagttctcgttttgaaattttttgaccatgcatttgactattgattacttttaaattgtatacaatattccaagaaagtcagaatctttccatttttataagtgggctactagtatctgtagtgtctgtatcactttctactctgaatctaggtgaaatactaaatacatcgagttgataataagtttgaatatttccttgttaagtttttttgccaaatagaagcaaaaacctatgctttagttaaatgtattatgtgctttttttcagagtacagttttatataatgtatctttaaaatcaattactggcagaatctgatttttttttctttttcaagggaaaaatttatacacaaatgaatatgtggcaattaagttggtaagttcctgtttcttaatttttcttaatgatttctttgttactttttaagtaacttatatattttaattattttttgttttcatgtcatttataatttggatgtttatttgacagttatatgcatagctaatctttgttgctaagctcctaacatcatcctgctcttaaagtatatggtaatgtgtaggacattcatgtttgtctgtgccacaaaaactcaatccctttactttggcagcattgtagaactggatcttggccctatttttaatttagggaaggatttttaattagataaaaattaacaagattttgccttctgattcaaacattttggtaaaacaaaagtgttcttagtattcaggattatattctttgaaaacatacttccaggtagcttctgaaatttctttttaaattgttacttcatatatatggcaaagctggctattgcttgactttgagggatgcagaaatgcttgatgtggtaggtgatagataacagggaaagcaaactcccgtggaattattctgaagttttcaatgtgcccagtatgacagctgcagagcagagcgatctctttggaaaaattgggatctaggaattatttttgtaagacatacttttcctggtacaacttttctgtctggtttgcagccaggtttccctgtttcattcattaagtggtgatccttaggtcctattgtttatagatttggaactttttcataccattgatgccttactaaacatttatcatgtcatctttcagccttcttatatacatacacatatatgtatgtgtatgaggtttagcatggcttggttttctctgcctttttcaaccttgtctctgtcaatataacctctgttattagggtaatatgaaatgaatatataaaagagagactattaggagaagaggcaaatgggaggaaatagaaaaactccactatttaattttaagtatcttttgaatatagaccaagttttagtgtaacaaatgtttattttcacttgaaataaagatgtggagtagggttgcagtgccatgaagagagattggttggctgacatgtggctttagactggattttacctagatgagtccgtcttggtattaagatctggtccttggcttatgaaacaaaacgtgattaggttatctcaccagttgtcagcgtttcttagaggtggattcacagtaatcagttcacactatcaagctctcagattcaggaaagagtgaatttctaactaataatgaggtattttacaggtctagaaagcccaagtttctttctatgggccgatgtacatagaaagccaagttaaaatttcaaggtcccctcatgagcatgaaatcagaaagaggttggtgaatattaatcacagcggggaggcctactgtgggatccgcctgcctcggcctcccaaagtgctgggattacaggcgtgagccactgtgcccagcctggacgttgtttgaacaggcattgctgactttcatttctttgaaattcttccttttctcatgttgtaggccagtggtcctgaacctacaacaatctttgtggtgtgcaaggataaaagtgtggcagtgtttacagtctgtgctattgatacaacagcctgtagtgggcagctctactcatgggagcatgctttgtatgtgaatgatagttatctgatatattaaggcagataaaccatcgtgtcaaagcagaaacccctgctctaggctgagctttccttgtctgtttcattcattaagtggtgatccttaggtcctgttatttatagatttggaacttgttcataccattgatgccttactaaacgtttattatgtcatctttcagccttcttatatacatacacatatatcacttttttaagtttatttttgtgctgtatctctgtcctcttaactagttttctcccctttttagggggaaacattcttcctcctctctgttttgtctttctttaaagcacaatgatcagcattacatgtaataattatggttatacattgttctttgggggaactaggaatatttttggatctatgtctctagtattttgaggttgtagagtggtatctagtcacgttcacctcaagttcatccaaaatatcggaaggacagaaaacttttcacatacattgttgaatgatagttcatgatttccttatatgttttttcatttgtgtctgttatatctgtttgtgccagataacatgattttgtttagacctgccataaaagtaatcacttgaacatcttatgtctgcatacctcagtgttatctggcttttatactttgctcggtacaaataaaggcattatttgataacctgagttcagagagcagatttctgtgactgctttcactccattatctcttacaaagattttttacatttatctaatattaccctagttcagatcaacagtttgtttcaggataatttgttaatattacctcagctaccatccttatatcttgttgtacatgaataatgaaaatgtcatcctggggaaggtgacttttattatatagtgttaaaattttactgcttaagtactggaatctagttgaaatgactcaactaagtcagatttgggtcagtatttttatcctaagggggagtagtgattgaataagttatatatttaatttcatttgtgattgtgtacatggacatctttttattgcatcttaaggttatgtacttctaggtagttaactgaagaattataggtaatatagtgctatatgtatagaaggcactgttttaagtactttatatataagaaaggttaagttttaacccaattttacagatgagggaactggaaagtacagaaaagttaagtaacttgctgaaagtcacacagctagaaatagaggatttaggattcaaacctagtacaatttagtttcagtgtctgtgctcttaactactgtactatcctgcctctcaagaactaagctgattgttttctcctgtaataaaacttataagttttgcagtgggattttaatattgcttatgtgaattcttttgttgttggtcacagtttcattatgatgtgttggtgtaaaattctttttagttatcctgtttgggattcacattcctcttgaattggtgggttgttaacctcatcaattctggaatattcatagcaataatttatccagttattgcatctgctcacttttctgtctcctttcctcctgatactgttatcaaatccatactaaatcttctcactggattgtccaggtgtctgatccttttcttctgttttccagtttttcttccttcatgatgcattctatatagtttttctgtctgccttacagtttccaaattctctcttctgttaatctgctggcaaaatgagttttaaatttagttattgtattctcttatttttcaaagttctattgattctttttgaaattttctattaccttgttatacttttctgttggttctttttaaaatttcctgttaccctgttacagttttctacttcttgtattttcatatttaatattatttctaacgtctaaaacccatgtttcctctgtacatgtttgtgtgtgtgtgtgtgtgtgtgtgtgtggtgtgtgtatatgaatctcaaaaacatttatgtcgaatgataaaagctggacacaacagaaagcatatactgtataatatcatttaggtgaaatccagcaacaggcaaaactaatccaaaggtgatagaagtaaaaaaggtatgatggaaatgttctatagattggtgtggtggttatagggatatatggagttaatatgtatttaacgcttatgaactgtgtgttttattgcatataagttatactttagtgaaaaaaaattaagacattgttgctactatcaaaattttcaaattaccatctttgttcttactatcctatgacttaactttaatctagaacctttatgtaagaaatacacagttcagaggtgaatttggagaacaggagaaatagcataagagccatcatttctctagtgatgaatgttcagaacatatttttctcagggtcaaagagtcaaacttaagggatttttctcctgcctgatctaatggctacttagtttatgtacatttgtagtatcattttattttacattgaacagaaagttgatttttatatgaatctaatcttagacaaagatgcctggtagactattacataatataggcattgacaccaaaatttataacatttgtgttgggacctagtgctcttttaataacttaaatgtctttttttgtttgtttttcaattaggagcccatgaaatcaagagcaccacagctacatttggaatacagattctataagcagttaggatctggaggtaaagtcttatattaatttttaaatttgaaataaagtggattgtcatgactttttagtttcaaggaatggtattttaagtttggttaaggaaatcactttgcaaggctatgtttactatacgttttcttactatggtcttaggatcccttttttattttatgacaaatttggagctttttatgtttatgctgatatgagtagagaacattgtgaaaaaatttaatttgcaaatataaaatgcatacttcttccatattcttagtctttttggaggcactattatagctgttgaagtgacttacaatatagtggtaggctgaaaaatggccacatagaagttatctgtatcataatccctagaacctctacatgttactgtatgacaaagactttgcaagtatgataaattaaggattttgagatggagagattattctggattatctggtgggggcagagggacatttacacacacagaaaaggagtaggcattgtgactgtggagcagagtggagagaacctggaagaggcttctagtactttcgcctagagtctctagagggagtgtggccttgcgaagacattgattcagaccaatgaaactgatttcagactcttacctccataactgtaaaaaaataaatttctgttgttgtaagccaccaaatttgtagtaatttgttacagcagccgtaggcaactaatatgggtatgtttttagataaactctaaattcaagtgagattatttcatgccactagagaaaattcatggaaaaaatttctattgtttgttacatttcctttatgttaaaaggttctcacagcacttttctgtatacttctattcaattaattgtaagaattttacttgtatagcttcttgtataatacaggtagaggaattttgtttctccagatttaataaaatggaatttcttcatgtatctttttgtaagcatgtttacattctagtgggtagagctgtccatttcatactgatatcagttttacattctgttttttctaagagcacactttgcaaatgagtagtcattgtaggggcaataagttttaaatgttgtagtaatgtgttcatcactacagacttcttataatacatatttaagtctgatacagacaggcctcagggagttatcaaaattatcactgacaactgggatttaaaggctattgggataaaacgaattatatgtgaaactatacatattagttattatactagcaaataagaagttaagtgggtataaaacgaatttattgactcatgtacttggaaattcaaggaaatgacttgatagattagacattgctctatccagtgcttcaaatactgtcatcaacatgtcaagtctctatgatatgccttatgagtatgtgtaagcttcactctctagttggcccttcttaagagattctggaggttgccaccaataacctaggcttagcaattatgaaagcatctctttcctaaaaatttcagcaaaagttgtaggactaaatcttactgccttatgtcatgcttatccctgatttaattactatgaatttgattgcctcaagttagatcaaatgcttatccgaactttagagactgagaatgggggaggtgattgcctactgggaaatcgaggtgttatataagggggattggatgccacggtgatgaaaaaaaaaaccagatctatctagtacagtaataaaactgtcatttggaagaataggattgagtggtttagttagaaatgagttagtcagtttagagtttagcaagtcattgaattgagtaacaaagatgtacttttattattttaacttttttctgttttatatttaaaaactatgtcagagatagtaagaataaaaatgaaacatcttttaggacttgtatgccataggactgcagtgttgcacaactgcagggaccaccatttacagggtagtctctgtttactaagggtgctatgctcctctctgctctatgggtgtcatttacatagattgaaatacaaatggtcttactgaaggtttgcatcatggtggctctgagctgtgacacatgtggatattttttagtattttgtacgagtcatgaatttgggcatattttttgtggttttttttttttttttggtcatttgtgagttttgtgaaagcatttttaagtacctttgtgagctttgtagaaaaacaagagtgcttaattgttttggaagaactgatgacttttaaacagtttgattttggaattcatatctgaaaagattatattttcagactgctcttaattataaacgggctatttagagtaactcaacctataattttcctatggtatgctgaatttcatttatatagcaatttgcttgttaatattctctttaaaaatagatatatttaagtaatatccagcatatataaagaacttctaaaactcaccaacaaaaatagacaacccaattgaaaaatggacaaaggacttgaatagacaaatctccaaagatatacaaatggctgatgaaaaacataaaaaaatgctcaacaccactaatcattagggaaatgcagctggaaaccatgagataccacttcatacccctcaatatggctgtaacaaaacaaaacaatacacagaaagcaagtgttagtatggatatggagaaattggaatccttgtgcattggtgtaaaaatttaaaaaagccaccgtggaaaatgtatgttgattcttcagaaaaattaaacatagaactaccattgatctagcaattccacttctggatatatacataaaataattgagagcatgacttcaacaggtaattgtacattcatgttcatagaagtattgtttacactagccaaaaggtagaagcaacccaagtgtacattgacagaaaaatggataaaatgtggtatatacataagatggaatattatccagctttaaaaaggaaggctaggtgtggtggctcacgcctataatcccagcactgagacttgtggtctcagctacttgggaggctgaggtgggagcatcgcttgagcccaggaggtcaaggctgcaatgagctttgatcatgccattgtactaaaaaaaggaaaattctgcaaagtgaaataaggcggtcacaaaaggacaaataaatttcacttaacatgaggttggaatagtcaaattcatagaggcagaaggtagaatggtgttttctgggggcttggggagagggcagaaatggggaattattgttcattgggtaagagtttcagtatgggatgatgaacaaattttggagatggatggatggtggggatggttatacagtaatgtaaatgtacttaatgccactgaactgtacacttaaagatggtttaaatgacaaattctatgtgtattttaccacaaataaattggaaaatagatttatttagaattatttagtggggtatctgtgaaaaaatatacaatttggttttgcccgtttgggttttgatcctcctgtaaatccatgtttctttcctttatgtagcttctctgacaatatccctctttacattacattatttagctttgcataggattagactattgttttataccattatcactctctgggatagcaaaaatttaatgtattgaatagtcttgttttgtcacatctactcagtattcgttgagtcaaatgaagacctgggtttgggagtcatcagcacatagatggtttttaaagctaaagaaatggatgagatctccctgaggagagtatagaggttgacaagaaaagaatagcaagaacaaagctgtgtggactactccattggatataaatagatttgactcttaataacaaaagttgtgaaagcagtagcttaaacaagtaaagggatgtaatgtgagacaagtgagttcagaggtgggcaattgtagggttggtacagctgctcaaaagtaaggaaccaggctcctaaccttggtgtgtggcttcatcctgcaatcctggactttttgtaacaggagggaaggaggaagaaatgaaattactatttgtgtaaagacaacttccagttctttatctcctgcttctattcttaaagtctagctgtatatgaatatccctactgaaatcagaaattcatatagctggaattgagttccctaccttcttttccccttattttctcgacagtttctctctctcttaaaagaccttcctgcttgatcttctggattacctagttccattagttccacatctgttcaagctgaaatgttagcctcctctgattttggcgtattggtatagtaaaaaagttctgtcaattttgtctcttaaaatctctcttgacttaattctcttccagtccccattgttacttttcttcgaattgggcttccttttgaatatctcaaccagctttttacctctacctgcacagaggggcacatcatttagtataaagtccaaattcgtttctctttctactgacctactttttagttgcactacacttactattccttgagtagatcttactattttcacgtctgtattctttctcgaatatctttcttttctaatgaattctatttttctttaagccctagctaaatgtcacctgcttagcaatgcattttctgacatcttttcctctccagaaaatcttcttatttgatctgatattttgaatatgtaaacctttgaaacctttatttttcttttatcgtatggtaattattatttgtctatgtctgtcttctccactgaattttgaactctttgagggcagtgataatgatatgttcatctttttcttcttggtagcagaatgattggcacttgtaggttcttggtaaatggttgaaagaataaattcttaactaacaataatagactgttttctttcattagatgtgaagttgggatgtataatcttcaaatttcctatattttctaacttctgtgaccctgtgattaaagtttgatattttaatattacacaaaattgtcgtattattaattttgagtttattctatttctggacaaataatacaatttcaaatttttaaattctaaaaattaatttcatttgtattatcctatgattaggtaaatttattttctcattttggacaactagagatcaaaggaaaaaattattggtgagaattttttaattaatggaagtggtaaccaaggagatatgcagaaagttttatattaaaacttgctgaactatacaactcagccatctaaaattagtcactttcttgagaagggtgggctttaattattagaattaactcagtttcttcatttacttgaaagtaagtatatctgaattgttgatatttcatgaaaatgcatagaacatatttgaaatttatgggaaaattgtttttggaggtctgtgattctcagtaacacttcttaattttttttgacatgagtttaaataggctacattaggagaaactgcaattaatgcattccttggaacatcttaattagctgatatttttaatcataggaaaaaataacctttttttctgtcataaattactacttatcagaggaagtaaatgatctttttctctgtcataaattattcttggcaaatctctgactatagagatgatattaaaaatactgtttgacaccattcatatgttaaatcatcatttctcgagtggcttgactttttgagattccttggactatgtagttctaagcaataatttgatggtagccacaggtgctgttactgaaattataactctttataatgctgtcttttaaaaggtgtttgaaaagccccctctttcttctttatgctgatccttctgccttcttgatttgtgccttgttaaaaagtctggatttatgtgctccctgcagttttttacactggtttatcgatgcctacgttttcactttatttttaagatgatttagttccgtctgctggttaaatgaacgttggtgattttgtaatatacggaaattttattgtactgttcacttctgagaagtattatgggtaatagtataaactttgttaaaagttgtgggtataaaccattcagtagtatctaaaactgatttaattcacagttaccagatcaagtttctcagaccatgttttaggtaagacattcaaaaaattctgctctatgtatattataagctgttgtttgaaaaaattgaaaggaagtactgtaaaaagcatgaaagttaagtgaataaatacttagactattgcttactgtattttgatattaacaaaaataatgaaaatatgatatgagtgggttagtcagtagtgtaaacttaatctcagcccaggtaaccaacagtttatgtagcagattcttagaattcctttttctgtcatagctaaattgcttttagaagaagtttttaaaaatatgtaatacttctaattctttaaagttagagatctctctgtatggaaatttctacaagttttacactgctaaacatttacttatttatatgtgaatatatacttacattgttactactatcatagtagatggaagtatacaatttttttctgttaaagttgtagtttatggagaatgggtacatttaaagaatgttatgcattatcagaaagaggtgttaactgatagtggttttagtttggtttatatggtgcaggcattagtgttgtgtgtggtgtggttattatagtattttcaatgattaattaagcacataggaatcttaagcaaaaagcaaaccatacttttgaataggatattactaaatatacataatttttgtaattccttgtgtaatagtaaaaagatagaaagtataaaaccatgaaaaattatgaaaatttcatatttagttttgctttaagtgttatataatgcattgtaagaagaaaagatttgtaagcttgtagcttagggactagggggaagaatcatagagtccattttttccttaaattttataggcccaaattggataacaacttaagttccattcagtttttgcaacagttaaatttttacttgtttgtaggtgatgttatttttttaatgttgtttgaatgttagaataatttctaaatgtgtaaattaaatcatcacagaaaggactgttgctcttttttacagtagaataacttgattccttttatttggggttaattgatagaattttactgctaaatgcagatattgtggtcttttaatggaaggactgttaccaagtccataattcagttcacctgttggttcatagcagcgcttactattcagctaggacagcacttcttaaactttcgggtctcaggattcttttatgctcttaccctttttgagtatctcagagcacttttgttgttgtgggttgtagctattgatatttaccatattagaaattaacacagaaatataaaaatgttgctatatttgtttaaaataaaaataataattgagacattttaaaatcaaggcaattttgttgatatactttccaaaacagaaaaaatgagaaaagtaacattgttctacatattttgcaaatgtctttaatgtctggcttaacagtaaacagctagattcccatatcttctgcatttaatatattgtgataacacaagtcccatagtctctggaatgagagtgaaaaaaacatatttatgttattacaaaataattttgatattactgacttcctgcaagggtctcacggaccacctctgtcctcaagagcttcaggccacatgttgaaaactgttgatctaggagtataagcatttgtgctaaaggttaagaatgccttaatgcaaaattaccctaaaaaaaagatagggtgatactgtgtgataattctgtacttagcatttctagccacaatttaggttttcttaatcagagctgtttaaattaaatcaggaagtttaaatttcctaataagtttgttagtacttttgttctaattcttcttatttgtgttaggctgttcttgtgttgctataaagaaatgctggagtctgggtaatttataagaaaagaggtttagttggctcacggttctgtaggctgtataggaagcatggtgccaggcatctgttcagcttctggtaaggcctcaggaagtgtacaatcatggcagaaggcaaggggaagccagttatcacgtggagagagtgggagcaagagagagagaaagtgaaggggaggtgcaacacacttttaaaccaaatctcataagaactcaaaatcatgagaacagcacaaacccatgagggatctgccccattgacccagttaactcccatcaggccccaccttcaacactgaggattataactcaacgtaagatttagaggggacaacacccaaactatatcactgttttacattttacatgaagaattctagacctgaaaatggatcatgatattactgtgaaatggatcatgatattatttccttaatggtctacttaactaatacttacctgtaaggaactgaagtatttaaaaacttgacacaaagtaccaagcagtctttaatagtttctgtgtattactgttgtgtgacctaattttgttttgtcacttaaagggaataccaacatataaaatgagatatttaatgaagtgaattttgggggagtgagggtgagattgtattttcaaatatgtgaattttgtattcatactccttgagcttttcttgggaaaaaataaacttctcttgaaaagtaaagatattggaaattatcagatgtaactttcatgaattcacagtggatagctttttatattagtatcaaataaaaataattttagaaccactggaatgggtggagtaagattttataattgaaaattcaccaggtgtaagaacaaacctttctgagcctgtcgtgccctctttttccttacctctcccatttctaaagaatctctaccttgtgacctaacctaccatttacgttgctctggtggttttggtttgtttttgcttaggatataccctgcctcaacctctgtttgttaattgcaattcttcttaactcttaaaaatttaagttgtttgctcagtgattaaaaaaactgtccagacttgttctgggaaataaaattatagtttggtgtaaatatcattttaagtttttctttgtggtcctagaatctttaaagtaagcactttttttcctgattgcaaaaatagcatatgttcgtaataaaaattaggaaaagtttaaaaaaaaaagtgaaggtagaaatcaccagtgcttccagtaatgttagctttctgcttttttcttatgttatcttttctattcgtatgtatgtttaatgattgtattcgtccgttttcttgctgctgataaattgccctgaggcggggcaatttacaaaagaaagaggtttattagacttaacagttccatgtggctggggaggcctcacaatcatggcggaaggtgaaaggcacatctcactggcagacaagagcttgtgcaggcaaactcccatttttaaagccatcagatcttttgagactcattcactattatgagaacagtacaggaaagacccagtcccataattcagtcacctcccactgggttcctcccacaacatgtggaattgtgggagttacgattcaagatgagatttgggtggggtcacagccaaaccatatcagtgactcattagaaatattttattttaaggccaggcgtggtggctcacgcctgtaatcccagcactttgggaggctgaggtgggtggatcacttgaggtctggagtttgagaccatcctggccaacatagggaaaccctgtctctactaaaaatacaataaaaagattagctgggcgtggtggcaggtgcctataatcccagctattttgggagcctgaggcaggagaatcacttgaaccgtgaagtggaggttgtggcaagctgagatcgcacaactgtattccagcctgggcaatagagtgagactccattttaaaaaaaaatattttaaaagtaatacatggtttaaaacaacaaaaattttaatcagcagtattataagaagtaagtaataaaagtttgtctttcacagttatcgccaaagatagtcaaaggctgtattatattccgtaatatgggtatgacatattaggttggtgcaaacataattgcagttgtgggctgtgaattttaaatcattatgactggtctcaagcacatctttattaatcaaaataggaaccattacggtcaacacatttttgccaataagaaataagtgtttattcttgtagcataaaaattagtgcttcgggatttgatgaactcttggaaagcatttttactgcatcttgctggttgtggaaacgttttccctgcaaaaggttgtcaagatgcttgaagaagtagtagttggttggcaagaggtcaggtgaatatggcagatgaggcaaaacttcatagcccaatttgttcaacttttgaagcgttggctgtgcaatgtgcggtcggtgttgtggtggagatgaattggatcctttctgttgatcaatgccagctgcaggcattgcagttttcggtgcatctcattgatttgctgaggatacttctcagatgtaatggtttcgctgggattcagaaagctgcagtggatcagaccagcagccgaacaccagacgtgactatgacctttttttggtgcaagtttggctctgggaagtgctttggagcttcttctcggtccaaccactgggctggttgtcaccggttgtcatgtaaaatccactctttgtctcacatcacaatccgattgagaaatggttcattgttgttgtgtaaaataagagaagatgacacttcaaaatgatgtttttttaaaaaatgtttgctcagctcatgaggcacccactaatcgagctttttcacctttccaatttgcttcaaatgctgaacgaccatagaaaggtcgacgttgagttctttggcaacttcttgtgtagttttaagaggatcagctttgatgattgccctcagttggtcattgtcagcctctgatggccaaccactatgctcctcatcttcaaggctcttgtctcctttgtaaaacttcttgaactgccactgcactctatgtttgttagcagttcctgggccaaatgcattgctgatgttgcatgttgtttccactgctatatacgacccatttttgaactcgaataagaaaatcactcaaatttgctttttgtctaacatcatttccatagtctaaagtaaatttaaaataaacagcaagtaataagtcattagcaaaaatacataaaaagagaaacatgcattaaaatgatgtataacatgacgacatttaagaatgtattccagtatcaaacagcaatttgcaacaatgcaaaaactgcaattacatttgcaccaagctaataatttgtttaattagcttagagttggtggatttttaggtagctgccaactctttttgtaactgtaacaaacaatgaagcttgaacatgattatatgcatacttatgcttgctttgaaaatgatagggtaattttcctccaaaagcaaaggatagagtaattttccttcaaaaacaaaggatagggtaattttcctccaaaaatgtgctgctttctattctcatcaatgttttaacccacaactttgtcagtcttgactaattaatttttaaattatgaatatgcctttgaaactacaccaaaatttgacaagtggtcatttcttaaaggtcagttacaatgtagagtatagaaatcataccaaaaaactttttctattctcatacattaaaatccattgtagtttgaatgaaccatttctgactacatgcattgtcttttggaggacactggttcattgagttatgcatgtatttcaaatactaacacatttcactacccaacattaaatcataatagctaatatcaccacaatttcatcagaacaagcttttaagtattggaaaactgtcaaggtcatcatagcatataaaaatttttacaaaattcaaattgcttgaaagctttaattttattattggtaataaatgtcagtttttcttgaagtaagagtctcttcattcattcttgagaatgctttttatttatttatttgttttgcttcgttgtactcttgaatagaaaagttaaaagttctcttgctctcagtcattaatggaaagcattcaatctttcaccattaaatgtgatgttagttggtaacttttcctagattccctttatcagatttagaaaccttctattccaaatttttgagtgttaaatcagatgctttcttagcaccctttaagataatcttaaggtttttgccatttcttctattattatggtgaattatattggtggatttttgaatattaacccaactttgtattcctggattaaaacattcttagcatggtttctcattcacttatgtatccgtaatgcccaacccagtcccataaagatatagtatatgtccagtaagtatttgttcaattaattaagacagtgaaattccttaaatggttttcctgttttggaaactgttgaaaacttttgaaaaaaccagtcattttataaaccaaaacatactgctatctatcttattcagaagtcatttctcaacaacgttaactattgggaatatagatggtgattcagaaggaagtagagaacgttttgacagtcctttctttttttttttttttttttctttttgaaacagagtcttgctgtgtcagccaggctggagtgcagtggcgcgatcttggctcactgcaacctccacctcctgggttcaagcagttctcctgcctcagcctcccaagtagctggcattacaggcacacgccaccatgcctggctaactgttttgtatttttattagagatggggtttcaccatgtgggccaggctggtttcgaactcctgacctcaagtgacccaccggcctcagcctcccaaagtcctgggattacaggcatgagctaccgcgcccagccgacagtcctttcattgaagaagttcaaaacctttttatttttacattttttatatagttctaacaagctttgatctggtttccatgcaccctgcatatcagaagtaacaaactgtagtggaataagttattagagattgttaaattgagaggatgtaaattaacaactttcagtggcagagagggggaaaaagcattatggaaagaattttcaaagcttagtagctgagagctgtcgatgttgtggtagctgagagctgtctgtaaatcttaattgcatctccagcttcttaatgtatatagcattgtaaaagcaggattttagagttggaataaacttaacaagcctctcattccctgtttctgaaccttttctccacctttacacatgtgaggggtagatatgacaaatacatctaagagtggctgtggtaggagtgtctttgattcccagtagcaagaggagatgggacaagcgtgtgtgatgtgtgtgtgtttgcagggggtggtgatacatacacattggggtgtatcagaatctctgtttctggggagggcaccatgtatgcagtttgaatttgtatccattcctgctatgattacactatctttttttgtttgtttgttttgttttgttttgtttttttgagaaggagtcttgctctgtcgcccaggctggagtgcagtggcgcagtcccggctcactgcaatctccgcctcctgggttcaagtgattctcctacctcagcctcccgagtagctgggactacagtgattacactagcttacattcccacctgcagatgttctgctgcctcactcatattcatatctgagaaatacttgtctcatccaaatcactaatattataatagataagtaaactgaggcccacttgagaggttgaatgacaagctagccacacagctgatgaatattaggttagactaagaatgtagttttcttggtttttagttcagtgttttctattctgtcctgcaatgatttatattcaaaataatagggtaaataataataatgttatatttaaaaaacgttttattaaaaagaatgagaagttttcattagatttgttttctctttcaatatactgaaaaaaaatcacttggaagtaaaactgagacatttgtggtggaagaagttcattttttcatgctaatagataaatgcagtgttaagtgtcaaactaaataatagggagacttgtctaaaagaaaatgatagttatttacgagtgggcattacaatgggaatatatgtgagtatattcagggaggtaaaggaagacaagagtttttaaaggaaaaatgaggagggtcacataagttgttttgagagagttacccttggctacaaggatcattaacaagaatggcctcagtctgaagttggacaggcagttcctgggcagatgtcctcacagagtaattttttgtaaagttgtggtggcttttgttccaggttgtggtttttgcagtcttttgtggtagttcttcttatcaggcatatatatatatatgtgtgagaaccctcccttcatctccttccctagctctgtttgtcagggttttaatacaagtgactctgttttgattctgacaacttccatataaagtaaattgatcacttacatttcagtttattgggagtctgttagttctgaaaataaaatacagatgacttcatatttggagtttgtattattcagacttcatatttggagtttgtattattctatatagcttcataatgaattattactatctcttactggcttaagatgaaagactttattatctcacaatttctatgggtcaggaatacgggcatggctttgctgggtcttctgtttagagtcttaccatgtggaaattaaggtgtaagcctggactgcaatcttacatgagcctcagtgctctcttccaagttcactgattcttgtcagaattcaattcctcatggcaatagaactgtgtggcccttacttcctcaaggattcctatctggcatgtggctccctccactgcatggtggtttgctactttaaggccagcaggagagtttctctgctgtttccaatatctctgacttctagactatctttttaaagtctcacctgaataggtcaggtccaccaggattctcttccttctgatcaacttacagtcaactgataggagccttaattacatttgccgtataagttagcctggtcacaatagtgagatcccaggaatcatgctcacgttcaaagggaggggtttatacaaggtgtataagccagaggatgggaatcttgacagtggtgatcttagcagtatgcctatcacatggttattaaagccagtagtgactctcttttcagtagaactggaatctctcctatgtgctaagcctttctccaggccatggaaatataaagctaaaaagcccagcttttgtccagtaataaggtggtagagagaaacaatgaagtactgtttataatgtaattcagtcatgcagctgcaatagaggtgtatccaggctacaatgtgaacatcaaagagaaggtattgggaggttgggaggtttggtcaggaaaagtatgtatctggaaaaagtgatagtactgctttagttcttgaaactataaaattttaaatatcgtttttaagaggaaaaccttagtatttaagatgatgaaattattaaatgagtatttcttttcccccgatggtatacctcagtttactatttcggcccttgtggtaaatacatgctatggtgctggaactgctgggacctagtttggaagacttgtttgacttgtgtgacagaacattttctcttaaaacagttctcatgatagctatacaactggtaagtaaaataaggtatttgaagttgtttgaacaattacatggttgttggtcacaaattcatattaaaagtttaaagttctgtgatattgtcttacagagcgtttgacgtaatacaaatgtttctacttttcatgttgtctttctgggatccatgtaacttaaaataactgagtcaagtatattttatttgtataaaaactaataattgctttaagatcaaaatgctcagtttgcaaattaagttgttgctagccatttcttcatataaaagatgattacttcaaaagagaaccctcagaaacatagatttttttttttttttttgagacggagtcttgctttgttgtccagggcggagagcggtggcgagatcttggctcactgcaacctctgcctcccgggttcaagcaattctcctgcctcagcctcccgagtagctgggacaacaggtgcatgccactacgcccgaccaattttttgtattttttgtagagacagggtttcaccatgttagtcaggatggtctcgatctcctgaccttgtgatccgcccgccttggccttccaaagttctgggattacaggcgtgagccaccgtgccgggccagaaacatggattcttaattttggtaatagactttatgacctggaaaaacaagaggcagactaatgagagagtcttgataaactacttagacttcagggaatccgttggataacaattagagagtgattttaaggcagtttcgaaataaatgccaatagaagtgtgctgcagaagtcttaaaattgtttttattcattgactcattaattctacaaatttatcctatggatgttttcataggtacttaaagctttatatgaaaggatgtttataataaaaaaaggagaagcaacccaaatatgcagaaataacagggttagttgaataaattaatatccagaggaaaatatgcagctgttaaaaagtgcatattaaagattgttttataggctaggtgtggtggcttgtgcctgtaatcccagcactttggggagtctgaggctagaggatcacttgagcccaggagttcaagatcaatctgggcaacatagtgtgactctgtctctacaaaaataaaaataaaaaaaaaaataagccaggtgtggtggtgtgcttgtgtagtcccaactgctgaggaggttgaggcaagaggattgcttgagcccggaggttaaaggttgaagctgcaatgagctatgcgttccatcctgggtggcagagtgagaccctgtccctgcccccacacacaaaacatcaaaaaaccaaccaactgcccccaaacaaaacaaagaatatttcatgactttgcaaatgctcatatcattaattaagaatatatagacatagaatattgtacattatatgctgcaaagtttgttaaacaaactagaatggcctgtgtagccatatgtttacattgcattgttaaccatgattatcactaaatgaagcagttttattttcttatttgtaatactctattttatgacagtttgtacaatgaacattgagaatctgtaaaataattaacaaaaatgagctatattattaatattagagttggatttcagacttttctagctttatgatctttctagcttcaagattaatcatttttaaatgtttaatacctaggaaaaagtaaaggaaacatgttatgaaaaagaaaaagatactgaatagtgctgttgtttttacttaatagtttagactcttaagtttctttaatatacttgtaaaagttgcttggttattgaactgataaggaagattatattgcaatgttttgcatatgtctgcttatacttttgggttcaaggtcttatatcaatgtggctttttgattttatgaagtagcatcctctgaaagtgttcattgaatcaggcttgctgatatgaaaggaattcataaaattcaaatactctcgtttagcagtgaccataacagtaaaggcaaagattttaaattgcaatttgctatgtgaagaatgataggctgacatcattttacttttaaagggttgaaacaatttctgatttatttcttttgtatgttttcattctgtcttgcctttatcatacttgcttaggctagtcaaagcccaaaataaaacttctcttctttttttcttaaaccaagatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaaggtatgtgtacctttcgtaagtatggaagtttgaacttagcagctgtgctaacactgtgagtttttatttgttatggttcagtttttgcagattataatagcttttattataattttcatttatcacatctacctagagtttactttcacttatattttaataaaactctttgaaagtaagttactatagagtaaatgagtgacagctatctttacattcactgtattttttgtatttatataacttgaagtgttcaactttgatacagttatggggatgcatttaatcatttctcttacaaaatatgagagaataccaaattttaactgaattcagtacatgtggaaattttggattgagaccatagctctccaatatggctagccacagaaatagcaactagcctaataagtataatgctaacagcatataccttagaggtgggcagagctggcttacctgtatgctaactatgacttcggacaagtttaacctttttaaggggtttcttattggtaaaaagagtaaaacaatatcaacttcacaggattttttatagcattcttccttcacccagattcatatttatcatatcccttaaatcattttcatctggaacagttcctcagtcgttcgttatggctcatgaccttaatattttttaggagcacaggctattttataggatatctccaatttgggtctgttatttctttttgactagatttgggtaggcattttgagcacaaatatcacagaagtgatgtgttcttagtgcatcatgttgggatcacttgcttggacgatatctgccaaatttctctactgaaaagtttcttgtagttagattttgggattatgtaaacatgttgttcctcatcagatttttgccctctagatttagcatccattgatgattttctaactccattatttctaatatttacatttccttatttgtcagttgatattctaatgtcagcagaagctttaccttctcccccagttattgacttatgtctatatgaacttattaattcttatcttatttaatgtaatgtattgaatgcattatcattatttattctgatagccaaagggttccagatttggccacccgttgctccttcaagctggcttctctgtccttttgacatgttctcatgaatctttgagtactttctttcttttggtgcagcaagttcttataaacaaactcatcttgtagtttctcttctgcagccccataatcagtccttttctccaagaagttctgaatccttttattggataatggtatttagaaaccaagatttggccactggatatgctcattactgtggtatgttgttactgccaggccctttctgcagcagaactaggaaatgtttgtgcatatatgtatatacatacacacatagaaatatgcctacatatatacgtatgtatacacacacacagagacatacgttaatatctgttaaaaattttgagtttatactgatacacttttaatttcagtctgtcagtacaaaatagtatttcccttttctatatttgtaattccatcccttttccatatttgtatctttttttttaacagtgagaaatctggctatcactacttacaatatatttacttgtttttaaaagctgaggatactcagaaagtagtttcagattgccaaatgataccactttatatagcaagtctaatagaattataacatttgtaattcttattttattgaagagttttttttttattgaagtaaaatttacattgggtaaaatatacaacatttgattatataatttgtgagtattgatgaatgtgcatactatgtaacccacacactatcaagatttagaacactatcattatcctatagacttccattttacccatcttagtcattcccctccttttctagaagcaatcactgatctgatttctatcacaacagatgagttttgctgattctattacttaatataaatagaaccatccaacttcttttggtgggtataatgtctttaagattcatttatgttgttgcaagtatcagtagtttattcttttttaatgctaagtaatattccattgcataaacatatcacaaactgcttatccatttgaatgttgatggatatttggattaagtttttgacttatgaataaaacttgtataatattcttacaaatctttttgtgggcatatttttcagtttggtcctatggcaggtattatttaactttataagaaactgcctgtctgttctcaggagtgttcatacctttttttatttccatcagtaatgaatgagaattttgtttgtttcataatcttgacaacatttagagttgtcagtctttttcattgtagctattctagtggccaaggggtagtcttttaattccttgtgattattgtttctgagatctgtttcatgtatttattggctatttgtatatcttcttttgaaaagtgtgtgtcatttcattgttaatttacagagttctttatatattctgggtataattattttgtcatatatatgcattatgagtaatttctttcagtctttgcttgcctattcattttcttaatggtatcttttgatgagcagaactgttaaatatttttgaagtctagtttatcagtttttttgtttatggttattgccttttgaattctaacaaatctttaccttcatgtaataaggtaaacaaatctttaccttcattacattttatgctttcttctagaagctttatagttttagccttttatatctgtgctccatcagaattgattttttatatggtgtgagataggggttgaggttctttctatgatatcgtattctttcttattgaattaccttagtgtgtttcttaaaaagtcaattctagattacatttgccacattcagtattcatatcagggaaagtacaaacttaattatctgcttttagatattattctgctttcagatactatctaggacatcttacaacagatagacagaaatgtgaaccaatcagtgtatatccatcactgctgctcaaaagnnnnnnnnnnnnnnnnnnnnnnnnnnnnnnnnnnnnnnnnnnnnnnnnnnnnnnnnnnnnnnnnnnnnnnnnnnnnnnnnnnctttagctactctatagagcatgtccctgctctgcctctcaatcataactcagtaggatgtggcatcttttcctaacagctgacctgacggtaggcttatggtatttttttcttttcagacatctgaaatgcctgaaaaatgtaaatttgctgtttttttttttttttaagaaaagtaagtttcaaatatttaaaattatgaaacacaagttttattcagttaatatgttcagggagtagctttcaatagctgactttcctggtagacttaaaaatatgattgggtagctatacaacttttggggttgtgacttcaattaaaaccaggcacacctatatttatttacatgttcagagtctgtgagaaattttcattttacgggagttgttaacagactattttataacaactaacaaaggttcaccactattttattgtgagacatgaagtcacaacttccttagggcctaatgttccttatctgaacaatggtaaatgtaacagcattctatttgtagaaatggcgaagtgagtgtgatatgtttgtcattgttaggaaaagtcatcagtacctaggaagtgagattgaactattataataatctctctttactcctctttcaggaataaaataaaaatgtatttatttggcaggtatagcaaacaacgaatgcttaatgtttacttttccccatttataaacactctgcttctcagttttcatgtaaaactcaggagtaggtgggtaatattaacagataaaaaattttgtttctaagattacatgaattcctatttaaaaagttaagagtaaggtaatatgagtttggatgctgaggaattaaagcatttggcaaattgcgatgcctttggatatggaatacatagcggtgttttaagtttagagtacttggttttgtgaggagtcaggaagagataaagaaggaaaaggagcagagaaaacatgaccttttaatgtgattttaatttgtgcgtatcttatttctgccctccctgctttgcctggatcttggtgattacttttaaagccttattcattcacccatctttccatccattcattcattcttaggcactcaaggacttcttgctcacatgaacttttcaaaatagagagtttggtcaaaggaacattatatgggtttgtaagtatttttcctttttggagactgacactatcttagacttaaaaaggaaaaagatgttcctaatataataatatagaagaatagtgtaaaatcacataataagaattaacattttattcttgtagtatctgttgatcttaactaggttatttatgttcagaaggcagatgttgcagttcacatttatacctttcttatagctgcttaagtctctgtccaagatgcaatcttgataaagctttatgttacagatgtggatttccatgtgtccttgcatgaaaactttctttagtgttgacatattgaattgttacttttgtgtcacatctgatcaagtgtctgctttttaatatctttttaaagacttttgttagctgccctgaacctcataatcttcctttggatgactatttttcccttttatgtcttctcttgttgaagtcatttgatattaagtaaataatgtctatttctctttggtgaatagccttgaaataaaaatcagatcttttatttttaaatttttattgattattcaagaataaaaaaactaggatttgagggataagttgggagttgctttgtaagtgttaatagaagaatgatgtttcaagcttctaagtggtaagttctctgaataggagagaaggaaccacagaattatggtgttccaaaaatgccttctttctgtgctatcattctgtggtgtgattcatataatttaatttctaggttaattgttccagtttctgaggcctgctctttaagctgctcacacagcttttttgcagtttaaaaacatgtatttacattttataattatattttaacagtttaaaatgtattatataattttttgttagagtataatgaacataattggtattttcttgatgtttcagggtatagttttttttatatgattactattatatagcaatattctcaagatcagttggagaaggttaggatggatatctttatctaaataaatttggagacaattttatttatactttgtaatagattctctttttgttttttgggtttgttttttttttttttttttttggccttcacctgtgttgtcccttactttttgatagtgtgtgtagtatagctactgctggcaacactttgcttttctctacctttgatttacttcttttgaccttgtcaccaaacttacaagaattatgtctaaattaagagaactagatttcaagagaactttaggaattaagtgaatgcatgtactgggttcagttgcacagaaaactttttctaagttttgtttatattactagattaggtgtttagattagtgaactgttcctgtgtattgtcttgcataattgtgttttgttcttttcctttttaggtttgttttctctttttttaaaaaaaaaatccttgttatataattttgaaaactgagctcaatgaatcttgaggaagaggtatttttgttttttttagggtagtgccaactaaagtaacttttaatatttaagaaggaaatatagtgaaccttttcttccttgtagtagataatttttatcttttttttacttataagaaatgatttaaactttattcagggagaatttttgttgtttgagctgtcttggctttgtcttctcatgtctgtgctttgcttagccaacatgtcttttggcctcattgtttttcattatggtagaaaatgcagtagtaagtttatttttgcaaatatatgcatgtatcatagaaaacttcctgcttctgtgtgaggcatcgataaatttgagttaacgaaaaagggaattttttttgttgaaaattgaattgaaatttcaattgaaatggaaacagtgttaggcaagtgaggaatgaaatctgatttaaagaaaaataaataatgttgagatataagagtagaatttttaaatagaaaagcattgcagaaggtttccaatcaacattgattaagtgatgaaatgctttccaaaatgaaaaaaatgcagacaagtgggctgaaatcttgccctccacttattaggtacctagttttgaagtagtcgcttaatctttctgagctttactttccttatttgggattacaaataactgttttcagtgtagctgtaattttgaaagatagtatatatgaaacatggacacagactcttaatacgtgttgattattttttatggtacatatattcctgaagaggaaaattttaatggactatgtacctttttaattggtttcaagacctatttaaaataatctttaatgatacctattttaaagaaaaataatcactttctggtttccttaggtgctcatagcaagagttcttataatgattcttggccttgtggaaaaacattcgctttcaaacaggcctttgtagttaagtgctttaaaaaatgtgaacaggctttaataggggccagattactgttgggagacttttttcatgtaaaagaactgttaaagaccctagggggtgttctttagttactgtgtttcaaagagaaagccttcctgtgatttctgtaacttactacatggtaaaatttatttccagatatgtcagttggtgaaagaacacaaaaaaagaaattatgagggtaaagagcatttcagactgagtttcagtaatagatttgttttactagctaatatttatggcttgaattttgaaatgctttgtgggttatgagactaatactgttctctgatagaaccatgtaggcgagatcaccttatgaccgtggcttattggcactatgtgactaaagcttccccttggatagaattcaaagaggaagtgccttttatattgagttcctctccataacagagcgtcttactgtagggctcagcatacttttacatgtatagtattttaagttttttaaactatatgcatattatatataggtcttgcatatacattgataaatgtatccttacatatttcctgttttttaatgctgttgtaaaggtattggttttaaaattcaattttcacttgttcgttgtgagtatagaaatccagttttttttttttttttttgagactgagtttcgctcttgttgcgcaggctggagtgcaatggcgcgatcttggctcaccacaacctccgcctcccagattcaagcgattctcctgcctcagcctcccgagtagctgagattacaggcatgtgccaccatgcccagctaattttttttgtatttttagtagagacagggtttctgcatgttggtcaggctgctctcgaactcccaacctcaggtgatcagcccgcctcagcctcccaaagtgctgggattacaggcgtgagccaccgcgcccggcccagaaatccagttgatttttatttttattttgtagagacagggtcttgctctgtcacccaggctggaatgcagtggtgcaaccatggctccctgcattgtcatcctcctaggctcaaggaatcctcccacctcagcctccctagtaactgggactacaggtgcatgccaacacacccagccaccagctaattaaaaaaaatttttttttgtaaagttagggtttctctatgttgcccaagctagtcttgaactcctggtctcaggctatccacctggctcgacctcccaaaagtgctgagattacaggtgtgagccaccgagcctggccccagttgatttttatgtattaaccttatatcttgtaaccttgctaaaacttacctactagttgtaatagaccttttgtaggttatttggatttttctacatatacaatcctgttgtctgcaaagagcaatagttttatttcttcatttccaatctgaatatctgttaattttgtttctttgcttctttgtactggcaagaacttccagtacaatactgaatagaaagggtaagagtggacatctttgttcgttcttgatcttaggagtgtcttttatcatttaagaattatgttagttgacatttttcgtagttgttgtcaggatgaagttggcttgtaattcctagtttgctgagatttttttaaaaatcattaatacgtgttggattttgtcaagtactttttctgtatctgagatgacaatatgatttatattttattctattaatttggcgaattacattgattgatttttaaaagttaaaccaaacctacattcctagaatgaaccttacttagtcatgaggtattatctttttaaggatttcatgtttgtgtttatgaggaatatttcttatagtttcctttaattgtaatgtctttatctgttgttggtaacagggtaatgcagtgagttgggaactcttccaatcctgggtttatgtagaattggtattattctttaactgtttaataggattcagtagcgatgctatctggattgtattttgggaagtttttaaataataaatttaatttctttaattgatgcagagctattcacattttcttcttgaggcagttttagttattagtagctttcaagatatttgtccatttcatgtaagttgtttaatttacatgtaagttgtttcgtagtattcttttatcattcttttaatatctgtgggatctgttctgatgcctcttctgtttcttctgttattggtaatttgtgtttctttcttttagcctgctgagaggattaatgattttattgaactttccaatccagcttttgttttcattggttttcattactgattgtccattggtcattgatttcctcatttgtcattattttgtccttctgtttattttgggtggtattgatatgaaggcagatacagataagttggtcagaatacagagtctgaaatagacttatacatagatggccgattgatttttgagaatggtgcaaaagcaactcgaggggaaaggatagttttgccaagaaactatatgagagtagctagatattagtattgaaaaaaatatatctaaatccttactccacaccaaaagcaaaaaaaaaaattacttcaaaatgagtaataggtttaaatgtaggaaccataactataaaatttctagaagaaaaaacaggataaaatctttgtgatcttgtgggtagagatttcctagattggacatcaaaaagtatagaaaataagaggaaaaaacccctgataaattggacttcatcaaaatgtaaaatttcttttaaacatactcttaagaaaacaaaaaaatagcaagctgttttcttgaagggaaaaggtattggcaaaacatatctgaaaataacttgtgtccagaatatacaaggaactattacaactttttagtaagacaatccaattttttaaacaggcaaacacatgaaataaagttcagtgttagtcaccagtgaaatacaaattaagtcagttaatccatactttgaagtttgcttttctgaaaggatttattactgcttatacttcatagccactagcatggctaaaatttaaaagaccatacagaggttggacaggtgcaactgaaactcccatacattgctggtagaaatgtgaaatgacataacccctttggaaaatcatatagaagttttttataaagttaaacctatacttacaacatcatgtagcaatcccccttctagatattaacccaacataaatgaaaatgtatgtcaacatagactagtacaagaagaatgttcataacagctttattcacaatagccccaaactggaacctattcaaatgtctgtcaacagatgaataaacacattgtaatatactactcagcattaaaaagtaatgagctatggttgcacgtaacaacatggataaatcctgaaaacatagtaagtgaaagaatttggacacgaatctatactgtatgattccattcatgtgcacctgtctaatctgtagtgatgaaggcagataagtggttgcctgaggctgatggtattgtgggggttgggggagagtaataggcaagagacattttggagcattagaaatgcctcttgattgtggtggtagttatgcaggtgtgtttgttgttaaaacttaccaaactataccctcaggactacgagaatctaatgaagtaaaattttcgttataaaagttataactagtttttttcatattctcatccccactttcattagtggatgtagatggactttaaggccactacttatttggaaaattgctatttttaatagcatatacttacattttataataaaaagtacaagaaataaaaaaacctctccgttatatcacatttttagcatgcgaaatgggaagttgaaatctcttctctagtcttccaatcttgtagccttaatgactgtcaattttgatgtatacttctgcaacttgcagtctggtggaagcatatatattgattaaataaaaacacaaacatagtatctttaaatcataacaagtgttattgaaaacaagtgtattagtctgttttcatgctgctgctgctgataaagttatacctgagactgggcaatttacaaaagaaagaggtttaatggacttacagttccacatggctggggaggcctcacagtcacggcagaaggcaaggaggagcaagtcacatctcatgtggatggtggcaggcaaagagagcttgtgcagggaaactccttataaaaccatcaggtctcataagacttattcactatcaggagaaaagcatgggaaagacctgcccccatgattcaattacctcccactgagtccctctcacaacgcatgagaattcaagatgagatttgggtgtgaacacaaccaaaccatatcaacaagtatagaatgtttacacagtaaaaatcaaaaccttttctgacccttcatcctagttcagagccatactttgaaaagtttgcttttctgaaagcattaagtactgcctagatagtatgattgttcatgtggataaaacatcttgcacataaacagacatcctcttattaaagtattttctcattggtagttagcattttggtattattttgaaacatcaagaaatcttaagtatttaacttcagtgacagaaaaattgaaatatcattcagtcagcaagtatttataagcatctccctgagccttagtctgtaatctttattcacttatgtgctaaatgacattttgttacaacaacaacttgaaaatgacagtttgttcaagtagtattttttgtgatagtgaaggggttattaatgttggtatgtgtcaaacacaagtttttcttaaaatatattacacacaatactccataatcgtgtttaatttaatggagagtatttatcatgggagttttgtgctcatataactttaggaaatgcagggttgaaaaagttaaacattttaaattctagatttctcagaagttttaatacgttaccttctgaatctttaagacagagctgtagtatacagtgactctgaccatggaactcttttccccgtggcctgtacttccatgaatagacatctaagcagataaataaatctctaacagcatctaaaaattataatggaatattttaaagatgctcaataatcttaatgtaaaaacattatttatatagatataattttatcacttatagttactagatctgtattttgtatttatatgttgaacttttggaaattaatttatacataatgaaagaacaaactctccattcttccattcttaactgttagagaaaagtgaaatttatatttcttttgtatttcagaacaaagtagaagagacgatttagaagctttaggtcatatgttcatgtattttctgagaggcagtcttccttggcaaggcttaaaggtaattgtttttgtgtttctttattgaatttcataaaatattaagatattaaggtcctgtcttccaactaaacagttttcatattttaaaattttattttgtaagtaggcatcagggctccctgtgttgcccaggctggtctcaaactcctgggctcaagcattccttctgccttggccttccaaagctctgtgattacaggctaccgtgtgcagtcccagctaaataatttttaaattaccacattctcaagattttttttttctgttttaggctgacacattaaaggagaggtatcagaaaattggagatacaaaacgggctacaccaatagaagtgttatgtgaaaattttccaggtaatgaataatgtgaggttgatacattatatacagaaaactagaaatgctaatttttattgcttaagtttatacatatttttttctatgcttaaaaaaaaaagagctaaaaatatgatttaaaggttgtcagcatttgatgccgaacccacagggacactttgtgtatttgctttgcaaatggtattaatagaagaaaatcctgtctgttaatagtgttgatcattaccagctgaagtaatattttctttagtgatatacttttaatgagttaaaatttttgctaagaaatgccagttacaaagttttggtatacagtgttagtcatttgggtctcaatgtcaagttcaaaggaggtatgtgaagtatgatttggtttagttttcaaattaaacttaaattaagtaaggccagtaaaaccttactgacctcactagtttggggctaattttatattggggagctgtatgcatttatgaaaataattttgctttcaagtagatttatggcaactcaaattaagccaaaaaaaatttacttaagatttctacatcaattaaggaataagaataacttgttagtatattaagataatgactgtgatttatttgtgcagccacattaagtgaaaagagagctaaatttgaagataaaatacggaattcctatctcactttagtattccgtagttctcctgtataatgctggcgttattaatgtaataataatattatcaacataacaaaagtagctctttctcaagcttgtttatattattcattgacagcaaactttaattatatattttcctttcttgctataatatctagaagtagattttttaaaatgtcggttaatagtactagcagtttagtgtaggcagatagggtagttgtcattaaggaagcctatataaaggtgggaaaaatggggttgccaaatcaaattagccaggtatttagctagaaagtggaatagtgggagagtcaccacctaaagaaggtcactgcacaccacttttgttgcctcattgtgctgggtgtgatctttttcctgttggctggggctgcctgtgaatgctaggtgtaacttaccatctcttactgtagtgattttctgtgccctgatggtgaaatgccctgctttactaattgctcaccattttgcccattgttttatatttatatatttgtttgtctgtttgtttgtttttgcatgtattagatacatgtatctaatacattttggaattataatagcatgcagagatttgtatatcgccaaataattgttaaatatatgaccagaaattaagagaagacttacactgtcctcttgtgttatgtttttgagatttgttttagctttcctttgttagcttaattggttagaatactgctcaaagccaaggttaggaatttgaattctctattagttagttggtttatgtcactgattctaaaggaaatccagcaagccaatacagatgctttcatataaatcagttctcaccggtattttaaataaaattttaaatttataaactgaatatgatgctttgtgattaatcatgcattattaaactgcttattcaacttctcatactaccaaatattaaaaataatcttataaaaatgaaaattttagcttttcctaatgaaatgaagcaaaaatagtggttgttaaactaaacctcccatttttcttgtgtctctattcccttccttcttttcctcttttttattttgttgtaattaaactcagaaaaatttaaattgcaatgtaattttgttacttttcaagtgtttttatataatacaatgtgcttttagatacttaattttattactgagtattaaagaaaagtatagtccaaataatttttatattatttctagaagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttggtgagtattctatataataatatattacttacagtatctgttgcctttttaatagtacaatatcttcaattgaaaagagttgagaacaaatagttgttttaaaggattcattttattgttttttaagggacatttctgcaggtagtgccgtactagtgttctttgagtttttcagaagccctacatctggattctttgccttttagcatgaagagttacttttaacttttcatcctgatttagttcttaatgtcaaatatactcttttttgtgtaatattctcatgattaatttaatacttcaatcccttgatgaaaattaaaatttgtatgagtctcttcaagtcaaaatattggaaataagtaattttattagtttttttattcttttaattttcttaaaagtttattctatgtatacatttgctttggaaatgagaggcataaacatatacatttttatcatgttgatatgaaaatgtagcctaaaagtaatggcagcattaagtgttctgtagatgtaaaaataagtactttataaagaatttgaatattttaaaaacactttaaaaagtaggtatattctttttgctttaccttcttagctttaacaacatattttgataatgatgcctttacttaaagccttagtttatttaacagtcttttgtttttttccttaattcttttaagcagctaaatgattttaaataagaattttaaaatggaatgtattgataccaattgttattgtattgtagcctactccagtgggtgcagttcagcaagatcctgctctgtcatcaaacagagaagcacatcaacacagagataagatgcaacaatccaaaaaccaggtttgctgccctttagatatgaaataccttcctttcatgattgaaacatacacttttttcttcaatagataaaacagactgaaggattgaaaatacatatttttaatagataatctattttctcttaatttcactgtttattagtttaataatagcattaaaatgtttaatcataaatccttaattaatggtacaaattagtgtaaacttttaggaatatgtgatattctgttagaatggaagtatttggataccctattagaatgaattgtaataacacttggactttctaactgtagtttagttcaataaattatttattgaatttctgctattgtaaagctactgttctacacattatagaaattcagaagtaaagaagactgtataacctttaagaatgattttgtcaccagtgtctaaaagcagtgttgtagctaagagttcactcaattctttagaatcaggcatacatggatatggcttgaccctgggcaaataagttaatctgtcaaagcctcagtttcctcatctataaaatggaaataatgcatgttaatttagagcatacagtaagctttgaatcaaaacttcttgtgtctgctgttactgttattattattacaataaatacagaaatagctatatttaaaaagagaataagctatattacatgaaacactaataaagtagcatggagatcatatgtggggctctatgaagattttatggaaaaggtagcttttgacatgaacctaaagaatgaatggagtttttaaagggaaatgaagataagggcattttggggagagtgaataatataaaatatgaagcagaagtttaaaaatagagaatttgaggaatagcaagcggttcaaatttgtttggagcaggaggtaggtagagatggattagagagggagtagagagtcagtctgagataaggcatagaagttgatcaagtagcgagttcatgtttcctggccaggtaaaggaatagaaagctgttgaaatttttgggcaatgttttaatttttctctctctctttctcttttttttggtaaaaaagttttattgaagacatctttgacttaaaaatttcactatcacactgagttaaggagtgtctagaaattttctcttacaatccattttggagaaggatagtatgccgtcctttttgacttttatattgtttatcccatcaaagtttaagtgaagattaaagattaaaacaggatgacaatcaaaagaaagaacaccacttgttaaaaatcatagcaaaataaaatgctacattttagggagtgtttaacaatattatgctatatatatatatatagcatggccagttttaaaagattaatattaaatttttgacttagaaaaattggtactataaagcatctcatacataaattacttcatatataaattaaaattagttgatagctggagtgctgtgaaaagattctgtataaagaaagaaatggctcagaagttgagacttagtttgtgttttataaaccagagttaattccttggaatgtacttggaagaagattaatacggtattctttgaaattctccacttgagctgttaggtattataataagtgaaattcctctattgttgaattaaattataaatctaatgttttagacttttagttttctacatctttcagacatgtcttgctaactagagtataagctcactgagggtaggaaccatgtttcatttgtccagtccttgcactaaatgtagggtgggtgtgtgtgtatatatacacacacacacacacacacacacacatatatataatatttaggcaattctttaggataggcttatatattgaatttgggatgtgaatatacacactttcatcatgatagaaaagttgtatatttaaaaaaaacttcttaaatatctctagaccactaagcagcttaagttctacaagaaacccacagttcacaatcccagaggaagatagattatgtcacgtgacttaaacctttgtaatgcccctagataaatgagttaagttgaggggatcctgaaattgttgggtacatgtaattgtttattttcaggagagggcgtgtagctcttactatattcttagagagttccatgaccccaaaatattgcgcattgccctagatgtttgtctcaattttagcatcatttttattctttgatcttgtctagacttgacttcatctgatttgatttcaacttaagctacaaatctgcttaattctggttatggatttggagggtttaacgaaaagacattatagaactgtcatagttttgatgacatactttatgccacagagtatgtaattttgcattgtacaatttaggaagcttagtgccagaacatgtattcatgtgtctacttgaattttacatctctccccttaaggttgttctggccaacaatatgcttgaggctccccatactccaatatgcttggcactttgtggcaagattttcatgactttgtttgaaaaagaaagaaaagagtactgaaggctttagaatatatttaattttcgtaaggagctaggtagtattattggaagagcattatgctctgagttggaattcctgttgtactccttggtaggtctgtaactgtggggaagtggttaatgtctcactgtcttcatcagtaaaagtggatgataatatctacctcaaaatatggtaatatataaagcagctaattcagaaccaaacatgtaataaagtttaaatagtatattcttctccctactttttattagtgttgtccacattttcctgaaacagaagttgtcccctattaagaaacttctcttaattttactggtagattatgatgtttgttattgccatgcatatttgccaagggatctaaaaacatcaagaattttcagattatttcatagacatgggttccttaatttgaaccagataaaaggagatcaaggaagcagagagattcatatatgtaggattatcacttagaaaaaaaattgttttgtcatattctcatagtattctgtatagtgcttctcccttttcaaagaacttttctgttttctcatattatccttagaatcagaaatgggggactaagcaagagagaaaatatttttagaatctcaggtacagttatttaagggccatcatttgtaccttgctaaaaatagctcctcatcagaaaaccagtgatgacatctactgtgtaaaaatatagtgggtggacttctagtgtgcccaggatttatttggagttctttcttggtcatggcatttttacctttctggttctttattagttcatttataaagctagagggtagagtctgtgatttctaaagtatttttacttctaaaattttatggttctattttatttttattgttgatcattacacaatttggcaacttaattaaaatcactccacattctgtatacaaagataactgcaccatgattcagaatagtaagggtattttaaatttccttttatacgtttgttttatatattatgaggataaaatgtttaacatattgggtttttcttcttccatgcatgccatatgcattaaataaatggcagtcggcagaccacagggcagcttgggactcccagcaggcaaatccccaccatttgagagctcaccttgcagcagacagacatggtggctcggtacaggtattttctgatttttgcatgagtgattattacccagatttatacaactaacccttttttttggaactcatggcatgatttcatatcttaatggaaaatttgttgctgaactactctatccataattctattcctttgttatttaaccagaaaaaccaaaattaacgtggtctagaaagaccatcaggaataccaagatttttcctttgttcatttttgcaactatatgctacaatatttaagtcatatagcagattagaaaaacaaacggtattatgcttgaaataggtattaaacttgactttccaataataagatcagtctttttaatgcttaaattaatagaacatttttgtattttttcccattcattgactttgcctccttcaaacataatcagttaaatatcttttttcatccttagtactcagaatgtactttctgattaattgttcaaacgaacatgaccctaatttttataatacatgttttgtttgtacttatagaaaatatcagatggaaattttaataagaagtgtttattaaatactcccctcaataaattgtatggctttttagataaattcaaagcagtcccttatttatgatttgtttcttttcaccttttttatacacttagagaccgctactatatatattctgccctccgttgccccataaattttaatcatttatgtatattgtagaaatagggaaagattgctgagtctcgtattgtcttttaaaatatcggtttaaggtaatctaaaagccagcttaaagtaagtgagataacaaatgttatcccagtacatttcaatttagaattttttttacattttcatttttttctttacatattttcacttgaataatttgccattttatcaaatttgcatttttcttagtgtatatatttaatcaactgattctgtactctgggtgctattctttcttgatttgagttctaaaaattaaattatgattaaatcttatgagccctcacgtttttctcatcattaaattttagaggtaatttaaattatataatggagtacttttgtagaattttgcagtttatggaattttcagtaatgtgtggtagacttatttgagtagatctataaaagtctagggtgaagaacttagaggcaagagtgtctaaattgtaaaaatttttatgacttcaattcatatagttagaaaagctaattcagcaaatatattctatttgcataacacaaactatattttgtatgtatctgtatatgtttacatgtttttaagtttgtgtgtatgtgtgcaagtgtttttgctcagtgtaacaattaaggcactattagaaaattttcctaccatttctgtaccattaccagatttattttcttagcctcttcttactcttatgtgattccttgaggtggctcgtgggattcctttggactgtcaaagggtgaatgaatttcattattcattcattatttcactacttcacgtttattgtttcacatgttttcacagagatgtttgaacattgctcgtttctcattatttctaagagttttcagcgtactgagactacatctgacttcatcctaatattcaataagtgattaacttaataggtttctagtaatatggaaatacataggtaaaacaaagaatagtattttcattgacttcatgtattttgtaatattaactgacacatgatatgatggactaatatgacagcctaagtaggatcatgcctgaatccttcccactccaaaataaagactgaattcatttataatttatgtcctatacactttcaaaattatttgaaaatttgtaatgtgacccttgtgtaattggactaatgaaattataaattaaaacgtaataagagcaaagaaaagtacctaaaatttgaactgatattataattgaatactatatttgattctgaatgaaggcagaaagggaaacaatatgttctattaatattattctcattgtttgataaagggaggagagaaagagaaaaaaacttttcagtaatacaaaaatatgagaagaatttgccttgggcttatttgtgcaatggtcattaaatcacctgttgaacaaactttcaagcattggctttacaggagatgcaaagactttatatggcaattaaaaaattattcttaataaacatactaagagtatgtcatcaaatagtttttttaggagagacatttccctaattaataagtcactgtctggtattgaaatgtgacgcaggtttaggatatccagaaacagaatcaagttacttaaaatgagcctcggtaagactatggctttcactcctcactatcattgcagtcttttccttggaactgatcattgctgtcagtgaagcactgaaaatcattccaggctgtttagagttgacatgtaagatgaaacctcttgccatttttgacctatagaaagatcctcaggtatttatttcacatgtacttttagtagaagttatcagcagagtctaaatttgaactccctgcctttccagaattattatatagcagaccagacagagttaccaagttgagagttaccaggttgatgatgttgcaattaagagcttaagctctgcagtcagatttgagttcaaactctgtgccaagattatttattagtaaatgaggattttaacaattcctctaccttatggttttgttatgaaaatttaatttaaaaagtatttagcatagatgttgaggcttaggaagtgttagataagtagaatctattgtttttgcaaattaagaaacttgagtagtattttcattttattgatctctgggaagtgaagtattagaggtacagtcaaaagaaagcattgatgaatgggatttttcttattttatctctttagttcagtcatgttaagtcactagctaaaaagatacagctgtacgtttgataaactttttccattcacgagactaagaataatattcagatatctactacctttattttgtatcagcctgtgttctggaaaacccctaggggaatcaagtgtgcccctctcggttccctcttagaatcattggtagtaataaatatggctgagaaactcagacctaccacattcagtttcttggccattcattactcagcaaattgctaagtgttcattatgtgctaggctcttgtaggttttcttgaatgaaaagaagtgtgtaaagacatggtggctgtgtccatgaagaagtcagtcaaggaggctgatgaacaggcagggtgataagtggagatagcacagggtactaggagaattgatacgaaaagcacctaacctggatgagtcaagactttctggggaaagtgacatctaaactgagacgtaaagaatcagtgggagttaatcaactgaagatagaaggggtcaagagaggagtataccaggcagagaagacaatatgaataaggttgtggagagagagacatattgaggaagctgatttagtcaagctggtgtgtgttgagaaatgagactgagaaggtaggctggaggtaaatcatgaaggatctaacgggtcttgttactaaatttggctttattctgaggataatgggtagccataagggggattaggagaccaaatttgactagtgttttctaaagattgcgtttgctggacactagattgaaaggagacaagtctaaatgagggatacagctgtcaaaagtctgtagttgaggaaaaatgttgggtagtggggataaacaagaaatgaaaggctttgaaaagaattagaaggtagagtttagttgggtatggggctgacgggaaaggaaaagttcagttgttacccctttttgacatgtttctacatggcaaatcaagatccccaaaattaggttttaaaatataccactgacaacagatagtagtaatctctaattccattttagctatgcttttcactgtagcacaaatccatcgagctcagtgcaaactgaaaatctgatcctatatagaggcaactgtaagcaaagggaaaaagacaaacattaaggacactgctggaaaactattttacatggttgtactatgtacatgtactatgtatacctcctgattgtttggaaatctcttatagttgtacagtctttggtttgaatctaatgaataatgtgactctgagcacttgggagaaaaaggggcagaattacaaatggtgcagatatgttgtgcaaccaggcattgttgaggaaaacgaaagaataacattcattgttgtaataagcagtctgatcttttagccagtgaagcatcagaacaaataaatacagttggtgataactgaaaaggattatcttgagatgataataaatgtatcttgagatgataataaaacgtgattaaaagtctagaggaatagtagatactattgtctcaattacattaatcgtgaatactgacctttctaaaacatttctaatactagtttcagtctacaaaatatttgaaaatgcagttattaacaaggaacaaaatctagtgactattacaatcacatctttctattcatagttttctggggtactgaaatctgcaaaagagagattgtggagggagtatggttatgtgcctttattacataaataatttatagttcatctagtttaggaaattccttatctagtatcattggggtaaatcagcattatgaatttattttttttttacaataacatttacagtaacatctctgaagactgggatgatcaaggaaaataattatcctaagtgaaagttaattgaaaatccattttggcttatctttgttgaaagttggtgagcatgtcactatctgtgctttagggtcatcttttggaataccaagagtatcaattatacctttagtctttaggatatgtaaataagttggtttcatatagtatatgtatactttagcacaggttcaggaaattatttggaagtcactcttttaactgttaatatatctcattagtgtgctttcttatagatgcctttttaaaaagctgaatacataaataaaatatataatgttttagtatttctaatacattattagatgagaatttggctaattaaaatatttggttaattcatacattgtatcaaggttctacttagtaatcttgcttacaaggtatcaaatagaaattaggaagacaggaggggcgtggtggctcatgcctgtaatcccagcactttgggaggctgaggcgggtgatcacttgaggtcaggagttcgagaccagcctggccaacacggtgaaaccccatctctactaaaaatacaaaaattagccaggcatggtggtgcacacctgtaatcccagctacttggaaggctgaggcaggagaatcgcttgaacccgggaggtggaggttgcaatgagccaagatcatgccactgcacttcagcctgggtgaccgaataagatgccatttcaaaaaaaaaaaaaagaaagaaagaaattaggaagacagtagtataactaatttgtatgaattcattatatttggaaagtacattaattgattttaaaaatcattgacaataaaaatactatatgttatgtctgtactctaaaatctataagaataacatcttttggaattggatttgtcaggcatctgttaagtttacaattatgtctcacacttgcttgtgggctgtttttccaacatccctcttaaattctgacagtaaaactggagtctagttgccttttttttttttttatcttcttaaaataagaaccgtattaagtttcctgtcaaattgggaatgtcagagggaatttttttttaagaacaacaacaatcctgtataatacctgaattattttttgaaatgtcaaacctcagaatatctgtcatttttatgtgctttcaagaaatcagcctgatgtacactagtatttcagagactcatcttctagttcaagttataattctagaaatgtcactttaatagaattattctttagaatttggcttataaaaatatttgtgcatatttgattgttttagccttccaggaatataatgatatattatttacagtagtatatcttcatttcttctttgtaaaacccttttgcaaaaagacacaaattttaagtgaaaataattttaatgccatgatacactctcaagtcaccggtgttaaataggccagtttatgaaagtcaacagcagtatcctatcttaactctgttaccacagtgattctattctgaacttgggatactagcctttactgagaggattggggaatctgggaaaccctggaaaaattacattaaaggaagatgttgcttccttctggtctggttctggtcaaccaggtaaaatggggtttgaaacatttcaataaaataaagtttaccaaagtcaggtataaaaagtcttcctctgtgaactgaagtaaatccgattatataattacagtgtatatatagtcactgttgctagaaaatatgtaatgttgctagaatttagactacctgagtttttcattttcaattatgctgcttaaaataagggaagacatgttagaggagctgcctgtaagttgaggtggcatcccgctagctgtctagggccattgaactaaagggagaataggaaacctgttgaatagtatgttgagaaaagagcagtggaaattgttcagtgaactgtttgattatgtactggatacaggcactctgttcaaggtagtggagaatatgtgagataagaatactactttgtgtctcctttccaatttagtgcagaggcaatgacattttcaaaattaagaataaagaacaaaattatgttcaataattagaaaaaataattatttttaaatgttttcagagagagagagagaaaaataaagagaaaaaatttacagttcaatagaatgacagaaagggggaagcaagtgccccagaaaaggagaggcatgcttagatgtaagaatattcttttctttagattgcctttgaagattatcaaggcagttttgtatgttttcagctgtaggcacaactgcagtgttcatttctaagtacttattccatataggatataggaaactgaatttctacaattcctaagttaaatatgttggttgatttgtagatattaatactttccttggagttggagagggtcctgtttctctacactaaagtgtcagatctagaaggacagggatgtttatcttgcttactttggtattccaaatacctagaacagtgcctaagcatgttgtagactaaagtaagaacttagaaatatgaggtactataaatactacttttaagtctaatagtcagttgtcaactctgtagcccatgacagggttgctaaccttttatttcatttaaagagattaggtagtgggtaggaggggcatcaaagagaattcttagatttttgagcctggaagtctggaagatgggagggctttaactgaaatgggagccttgggaagagaatacatttcagagggagtaggataaatttgcctttagaaatgcagagtttaaggtgccaaacttggcttagcaaactgaggatatgggtgagtggttaggcccagggagtcctttacctagaggtgagagttgaagccatcattatagataaaacatagtgataatgatggccaccatttattgacctcttcccatatgccaggcactgtgctttatatattaacatttatgtattgatctcatctcaccctcatatcaaccttgttagttagatgctactgttcaccatttcatacttgagaacactgaggtttagcaaggtaaggtatctttcccagagtctcatagctggtaagtggtagagctaggctttgagtctagacccatcttactccagaatgatcagctagcgccaagtgatttgatgtacaagaaaatgaggcaccgagcaaagtgtcctgaatacattttctaggaatcattagtaacctttaagataactcttattagagttcttatgtagggttggagaactgattgcaaggagtaaaggaataaacacatggaaaattttataaaaatggaagtggtgagttatatattttttttttccaaaaagtttagtgataagggaaaaggaagaaataataaggtaaatttgcagaaacaagagaatttgggagaatttgggaatttcctcatttttatcttgtttcaggatttcattcatgcatacatgcattcatttatttcaacgtatatttattgagttcctattctctgcgagacatagcaggaaacaatacaaggtctctcttatcctggagcttaattttaatggaggtagggatggatgtcaagaaacacaacaaataaatgagcaagcaaataagaaaaacatgaatactgataaatactgtacaaataatttaaaatagggtgtaacataatttctgtgctgtgtcagcatagaaatttttagctgtgtgatagaaaaggcctgtctcagagatgctgtttgagaatctgaaagatgagaagtcagctaataagtaggaagagaattctaggcagtgacaataggtaatgccaaggcctttaagtgggaagaatctcgacatattggatggaggctagtgagcttcagagaagatggtgtaagctcagagaggtaggcaggcatcacatcatgtgggactttgtcaatttgtgtaaggaatatagattttttattctaagtgaaacgggaagccaacagttggagagttttaagcagagagctatacatgatgtgatttgcatcttaaaaggagcaccctgattgctgtgtggataatacatttgagtgggggacaaagctgaagactagataataggtttttgctcttaatcacataagagatcatagtggcttggactggagtccttgtagtaatagagatggtgagaattgattagatatgggatatgtttggagaaggatttaacaggatctgccatttatggattagatgtgggttttaagttaaagaggaatcacagtgacccctacgtttgaacaactgggtgaatgaatggtgttgtctctatttaaatgggcagtttgaaatggagacttgagcataattgcagattgaagtgaaggatccattagaaggagtaatattgaagtttttcaatattcaaggaaagtaattcatgatatagcaaggtgccagaggacatagacacacaagaggaaactgattgagacatacatgcaggagttagccttaaaaaccagagggaaggagacagaagacacagatttcaataaggaaaggaagtaagttgaaaagcgcatattagatgactttaatctttaataaaatgctagaccaattactgtatttagttatgaacagctacatattgttttgtgttcctcacattaactttctaattgaaatactttaacaattatgtttatccttgtataacctatttaatatgtatgtatatttatgagcatgtgtgtgtacatatacatatataaaaaatttttttttcaaacaggttgtaagttctacaaatggagagttaaacacagatgaccccaccgcaggacgttcaaatgcacccatcacagcccctactgaagtagaagtgatggatgaaaccaagtatgtgtttgttttacttgttttagtaactttttgttcttaaattatgcatgcttgagatttatagttacatacaattatttcaggaaatttttttcagggaataggtgcatgcaaaacaagtggtatgcttaattattttaatcactagaatgagtttaaaatagtgctattccagtaaacattttaataatacaaaatatttaagaactgtgttcaaattcttatttggaattaacaacatatttttagcttttgagttttaggagtgttgatgcatgaaagttattgatgtactatcaatcttttttctgtaagcataagaaattaattttataaaatgcatgttttaatattttgaattagttttttcaaaacataaattataacaacattgcttggaaaaaattaagcatgaaaaacaatgtgataatttcaatgtgagctgtttctgattctctctctctcttttttttccttgtatttttttttttgtgtgtgcgtatagctgccagaaagtgttgaacatgtggtgagtctcaagtgtaggcaggcagaaatagctccattgactgtaatttcaaagatttagcatcattttgtgtcttttgaaaacaaaactctcaacacagtgattataattggtaaaagttattcaaaagtatttgatatcattaagatagctctgaaaagcaagaaataattgtttgaggagctcttttgcctgctgcaacttttttactttaagtgacatagatttggggccactttttaattgcatagatgatacaccaaccctgcttgtgcttgtgcatttgttttataatagtttttatttgctatttaaatagaaagatagatttttgcattaagctttcttttttctctttgcaattgttaaatacatgtagcagatctcatcccccacagtagtatcactaaaacagtatttcatttactaaccaattatcattgcccttgagtacaatattgataaatttcatgataaccttgtagtgagaaagccattttaaaaatcctcatctaaatggttgctaataattgcagatattatggaaagtaacattaatagaaataattttagatttaaattattttctgacatttgcctttaattgtaatactgtgcttaaaatgcttctctcagtttcaggacaaattttgagtcagactgggagtgaataaaggaagttgcttagtttagtaaattttgaaatattttactcatatctaaaggcaccttatataattttcaaaattatgctcatttgttggctgcaaaattaggaaacttttgtggatttttttttgttaaagagcagtgattaagaatccattttaatcacttttgactatagaatttattgacataagattaagactagtgtatgtcaggatataattagctatatacttgtatatttttatgaactacagaaataaatccgtgaaagtatagtcttacttgtgtgtttttaaatcaaatataaaaacaacagcttatgtttgggaattttaggtacaatcctaagacaggaaagtagggtggtggtgtggcagattcgactgcacatgtcctttgcagttagacataggttatagaatcctgtttctgccacttatttgttaccttcaagaaagcttgtttctttttctgtaaaatgaagctaataatacctacttcataggttgagaaaattaaatgtgataaagccctggtattttgtctggcacacggcaggtactcaatagctattatcacccctatttatttcttctcttccaactgctggtgacgtttctcatctctgttcttgggcttgtgcctcttttatctgtgtcctatatttttacttccatacacacactcttcactgaaactggctgttctgtgtttacatcctcctggagacttgcttttaataaaatctattacatttatccatttattcattcagcagttacactgctgaggtttctgacatacctgatgctgtccttgttcttaagtagattacaagccagcaggaagattgcagttgtactagtatatgtcagtatgtgattaatacgataaaaaaggtattttaaaaaatggttagagcttgtaaagataaagattacttcctgacctggatgatcagagaatacttgatggaggtggctctgaagaatggcacagttatttagttgggatgagtgtgggtgtgtgtttgggtccctatctgtagacactggaggatgtgaaagaagaaagtggtgggaaggctattgctataggaagggttctccattgcctgccacatcatgtccagatttcttggcatggcaccaaggcttctcatacctgtcatagtctggcccatctatttttgcagctccgttttccattctgaactttatatagcattggttccttaaatctgcatttgctatgttatcctctgtatgtacttcccacttcttgaaacttactgaatttcttgaaaacaggtattttttcatcctcagattcctagtggctatatgtcctaataaatcattactaaataattaacaatgtggtatacccatacaatggactgccatttgacaatataaagaaatgaaattgaaaacattgtgctaaatgaaagaagccaaacacaaaaggccacatgttatgtgattccatttaaatgaaatgtccagaataggcaaatacatagacatcaaaagattagtgattgcccagggcagggaagaggaggatgggatttctttatggagtgatggaaatgttctaaaattagatagtggtgatagctgctcaattctgaatactaaaagacactgaattatatattttgaaaggataaagtttataacgtgaaaaatatcttaataaaatggttgttttaaaaaaagtatagcaactcataatatcagtgaagccttacttcaggtgggttaggtaggttacagaaatcctcagaactttcctacctctttgctgattaaacattctatttaaacaagattttttctttaggtttattctgacatttctacacgtttgttattgtgttcctcataccctcttaatctgtgactaagaaatttgagcatgattttttttcttttttaagagatggaatcttgctgtgttgccaaggctggccctgaactattgggctcaagtgattttcctgccccagcccccccagtaggtgggactataggtgcacaccatcatacccagctccttttctaaattgcatcttatacttctcttctctgtgccaccatttgacacgtaactagggacctgcttagaattttctttcagaatttctttttcatctttcttcttacctataattagcagagatccttctcaccccaccccatttactagaatgtattctataatgcacattttagcatcctcatgtttcctgagaatagtatctcattggggtaaatacttgatttccaaatgatggaaaatactctattctcccatatggaaaatgatggaaaagctgattagcttcattagtaatgaggttttgtctttcttgtttactgtagctgagaattttaagacaggtaatacaaatgatagcaccttcatcattccttccaggaacttaggaaaacaaaataatttagtttaattatttactttttaagtagtatgaaaccatcctttattctttctctttccttcttccaacatttaccgaacagattatcatgttttgtaatgtgatgattattaaggtatgtcaaagtttgcataccattaagttggttggaaagtatactaacaacttttatacaatggttctcaaccttgatttcacattatagtcacctagggagttttaaagatgtactaatacttaggctgtattttcaaggtttctgattttactagttggtctgtggtggggcctggttatcagtatttttaaaaaacttctaaggtgactctaaggagcagccagggttaaggatcattggtctaatacaaagtattacatgattagcactataggaaagggataatttttactggagttcagaaaatggagtatgtcctcctagttgggaagatcggagaagtcctcatgggtaaggatgcatttacactagttctcaaagatgagaatgatttggcaagggaaatggatagaaggagtcagagagaagaggttgacgcaaggaaagaattgaaccagttggaggagtaactcatgcaggcagagaatatatgaacacgttaatgaaaactgagataggctaatttcccaatctcagagggccttggtagccagtaaccaaatttggacattatctttctcagcacaagaaaggaagccaagaaatgacatgtggttttaagccaagaaacaatatgatcaggttgatccttaggaaaattaatttggcagcagttatgaggcttatgtcacttcctggggttcagcagattgcagaaaatggtttaaaaatataaattaagttttcctatgaaactagatggataatttctattttgggttagtattctctagtaaacaaactattccttaaaaaatgttttaagattatagtattggaccatttgtttagtttctataatactaagtgttcaggactttgatagtctctagaactgtaaagataagtaaagaataatttatttcctcaagagatcagttcagtgaggaagagagaggtataaaaattataatacaaagtgacagagactgtataactcttttgggagagagcaaatggattttaagtggaaagaagagcatgtgcaaagatactgaggtaagaaatcccacgtggtgtgttctgggaatgacaaggagatttttgctttttcttacttttcccttccttccattcatagtataggccacctgggaaggaagcctaatggagaatgagactaagaggagggtggaaataggttgggaacaaaattcttgaagagctctgtgaacttaatgctttagtcaatggagaatcattgatgagatttgagaggaaaagggcatggccatatttatgatgggggcaatttggatggcagattggagagaggagagacttagactgggaagtcctttaaaaggtgcttagcagtggtggaggcaagttgaaaagttcagaactcagccaacatgagaaaatgggaaaattttgaaagtcatttcagacttaagggactagttgcaagtggatagggaggaagaaattggagatgaagatgggcctgcaggcttttggttggagtaattttgtagatgatcttgttctctgatctaaactcttcttgcttagctaaatggttcctcgttttttctttaaatcaagagatccagagatatgaaattacacttcaggtttaaaccttaaggggaaatattctttgtcaaagaattaaagattagatgccataaaatatactttctgtacactcatcaacccaggtcaggagaaactaggttctggagtcctacgtggttagttctaggaggtaccaacagtctctcaaccaaaggatgagcaatgagtcatcttagaagggataaataagaacatcatatccagatagggaaacatgcttcagtttctgggtggatttgagagaaggaagtatatacaaatatatgaagaaaaaggcaatgaacaaaggagaaatggtggtgcggtgtcaatagcacaagcctgtatgtgttttaggactttgatccattttgattgcctgtttgttgcctaattgtatttaaagaaactaaggttgtttctaaagttcatcataagtaggacttaacatatattcccaaagaattttagagtagagatgtagcttcacattttgagaggctgaggtggaaggattgcttgagctcaggagtttgagaccagcctgggcaacatagtgagatgttgtctccactaaaaataatgaaaaaaaaatttaccagctcggcgcctgtagtcccagctactcaggaggctgaagtgggaggaccactattaaataagtactaactttgtgccagtttgttgggctataactgtgagcagtcctttatgaagcttaaattctagtgcaaaggcagataataaataaataaaataatttcaaagtaggagtaagttattacagaaaaataaaacaatagtgtgctcaagtggctacatgggagcagcactgtttcagattaagtgctggggaagaggaagcaattgagatgagacctgatttcttaatctctaagactataaattagctgtttcggtaattacttttatcttaagaaataagccataaggttaaaacatcaatttacttcctaacttctgtaagtatatcgtattttgagaacctctctcttgtctatttggatgcatttgtatcacataaggcaatgctgtcctctggtggtagtaactttaatagcatgccagctttacttttgcaaatctttataaggacgttctttatttagtgggaattatttaaaatagatgtcctttttagattgtgtttgaatttaagggccattagaatttatttgaaaatcttatttagtctcaaataaatgcttggcgtagttcagtaaaacactgttgaaggaaagattacttaagtgtaaagaactcaactctcagaactcaactctcagaactctcagtactggaaatacaaactaagcaaagtaaattgctgatacaagtgtagaaaatttgggactttgtcttgttcatcaaaatgtgtattacattaaattgcccatttcaaagggctaatacaactttagaaaattttgaaagaatctactttggaatttgaaaggatagtgtttaagaatagtgaacattattaaaggaattttatatcaaacaataaatttccattgaaatatggccatattcttaaatttaatattctaagtatttggtctgtcacttctaaatacctatttttatgtcttgctttctgctatttggatatttttctgctcttttctaagtcttaaatttaaaggttcatttggagtaaaggattttatcttttagaaagtaattgagatttgagaaatattaggtagctgacagttaaaaataaatttgacttatttttttaaatccagatcaaatctcttacatgtgtagtcttgttgtactgtggcagctcttctctaggctcttgactgggtaatccatttcagttctttctgctagtcacctccatgagagtaaagttgataaacattcatcattacatatatttctagttgaatctttatcagctggtccacaattttaaattatttacattccacggtctagtcggtgtttactgtttggtttacttaaaaaaatgcagttgtgtaatttggtttgcagtaccctcatagtagtttcataattatggcagaaatcacaataaataatttaaaattatttttgactaaagataatgtgggtagagagattatgtaatttaactggacagtgtagatttctgtttacatttatttcacagaagtatataaaacatacctagtagttattttatattctgtaatcttttgccgggtgggacacttgaagctattttttttttttttttgaaacagagtctcactctgtcgcccaggctggagtgcaatggcgcgaccttggctcactgcaacctccgcctcctgggttcaagtgattctcctgcctcagcctcctgagtagctgggattacaggcgcctgtcaccacgcctggctaatttttgtatttttagtagagacagggttttaccatgttggtcaggctggtcttgaactcctgaccttgtgatctgcccaccttggcctcccaaagtgctgggattacacgcatgagccacccctcctggccaaaactattcttctatgaatatagattagtaagaattatagaaacatctttataagggcatattatacacagtctgaattggcagctctcgatgatgaaatcaccatgtatataaatatactttgcttttattacaaaatatgatttataaacatgcccacatacccacagaggacttcagtggaaaccagggatactcaaccatgcttgcctgcgccaaaagtaaattcaaccttaggaaggggttgactgtttaaaggttaaaagaaaaggtgcctaactatatgtagtgtctgtcatgttgtatattttaatagactcttttatgtctggaaggggaaaatgccataccttcatgcctttatttgaaggattgtgaggcatttaagatagatgtgtatttaatttttttcttttttttttttggtgggagcagatcagtgattttttcagttcataccagaccacagcattttcccacagcagccttgatgtgttcatctcctcttttagagacagggtcttgccctgtcacacagactggggttcagtggcacaatcatagatcaaacattcctcctgcctcagcctctcaaggagatggggtaacaggcgggtgccaccatgtccagtgcatgtgtgtgtgtgtgtgtgtgtgcgtatgtatgtataatataatatatgtgtgtacatttatatatgtatgtgtgtatatatatatttagagatatttgtgtatgtgtatatgtagttagagagagagagatatttagagatggggtcttgctgtattgtccaggctggtcttgaattcttaaactcctgagctcaagcaatcctcctgcctcggcctctcaaagtgctgggattacaggcatgagccactgtgcccagccaagattttttttcacctagaaataaaagtcagtattatatttttttgcatatacagttttgacttgtaaaatggaatcacctcaattgtgctactttaaatattaagcatagtttttaccttaactaaactttcaataagcttgaccttctttaacccttaaagaattcaaaattgccagtcttggtattctatataatgtattttctgtctttcacttttttaatatgatggaaaatgttgactagtgtatattggagtgtctttttatttttggagtctaaactgattattggtgagaataaactccccaatgttaggatcattattgccttcctaatggcttcaacagtcacatataaatatcagggagaaagggtgagaatgcatagaatgaaattcttaattactcttagtgaaaaaccttttgaatttaatggctcctttttatgttgcatagaatgtcttgctattcttaaaaggcatgtgaatgaaacataatagtaatagctctgccatattttcactaatacgtatgcttcattggtgtaatcactgtttatcttgcactagcctgttgctttttatgatcatttaagttaaagtgatacagtcaactttgtgatattttagtgcttttaaaataaaaagagtgtttccctcatctgcaggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaacttgctctttcccatttcctctaaagatgggtaaaataatgtcactccctaatttaagataggaattataaaaatttggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctgataaattaagggaaatagcatcatttttcctttttgagaatggaatcatactattatgttcacagaaattaagcattattccagttttaagtgaatgactttaaaatcattgtagatggggagcccatatttctaacagtatctcatagttcatcattgtgctaggtgctttaagggattttacaaaatggcattaatggtacgctacttactgagggatgctacaggtaagaaaaggcaaagcagccctctctcaccctgtgaatattgtgtccattaagcagcagagaccttcagaagcaggagaaagatctggagatgacacaaaactgttaaaggctctatttagaaaaattcgactttaagattgggatttcagtctgaatgaatgtatagttgcattagt

SEQ ID NO: 12359 - DNA, 7125 bp, Human
gaggaagggccgcaaggccgctgacatgcagctccgtccaaggagaatttgggttgggaggtgaagaggtggggggacgaggtttcctgggccttgaacgccccacatttaagaaaaggcatcctccacagactagactaacaattccagacccccagtagtccctggctcagaaactcgaggcgtgatttcggcgtggcagcccaggcctgttactgacggctggcgcctagaagccggggtcagggcgttgcgcgcctcctgggctgccctgcggggctcacctctctccccagcatggaggccccaggtcctgggagtgtggctttgatgagggacaggaaaagtcccaacatcaggccaatgcttgacttcacttgcgtcggcgtctcagacggcacactgtcgggtttgagcacccaagatgtacgttctggacagacactattttgtccccatacatggagcgtttcctccgcaccttgggcgcgcctgcgggagctgtgtctttaggtagtttttggccctgcgccgcctttattctactccaagcgcctcttgccaacccgcactccgcaaagagccaagccctccacatccccattctcagcaagtccacgcgtcccgcccagcttcccgcccgcggttccctgtaccagctagggccgtgagaagccaacgcttttccactgacaaatcctgtcatccccagctctagaaggcgtccttaacctgggcccgctctgcctgcccggactcctgaattgtaagcaaaataaaactcctctctgcagtgttctggggaatggagaagaccccaagctttcatcagacctcccaaggagtgcggggacccagagaaatgaggccacccgggcaggatctggccatgtagctggcgctcctgaaactctggcagatttgtctgacttctgtgccctactctactgaccctgggctaaaaatgatcatgatcaccccacttgccctgcccttcccccacgcgcctgaccgagccgcaggggtgccccactggaagtccggcccagaggcctcagagaaatcctggcctagctgggctcagaggagccccgcctccctgagagctaaacctgggctaggaccctgaaacctcgaggttggcagaagcctgagggccttgctgccaggcagggagggcacgggaaggagggaggtgggatcgatggcctccaaacaggggaaacaaggtggctggtagctggggcactccacaagacaggtgtctcctgggaagctgagcttaccagctgggattcctgatttatttcattattaaggggagaggcatttccctgggagggtactggcagtgactgatgccccctggagttgtgctgtgcataacactactgtaggaggcagcaactcctaccccacctggccatcactcaccttgcccttactttcgttgactcgcccagaagcacccagagcctgcggcatgactgaccctgtaggccaagccaaaccaaacccccgaattgtccagaatctcgccctgctgctatccccaaagccagccctgtcctccaggcttctcttcctattcagactctccctcatcccaccaccttcagtaataaagccttcctcaaatcactctcctccccaccgcttcccaccccatccttctctctcccatgctggtttgggtgctgaggaatatttcttcaaacccacacccatccagccctgcccagaggcctgactctgcatgcctctggtaggcttttcaggctcacattagggagcaaacgcaggctgcaggagcaaaaggagacccttccaaatgcgtcgtggccccctttaaaaaagctgggcagggctttttttttttttttttttttttttttttttttttttttttgccgtatgactatattaggtgacacgaaactgctcatcgctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaaggtgaggaggaaacacaggcccccttctcccctcctgggtcgctttcgtccccaagaaactcagggccaggaggaggagacacgcgcccttgggccgagggctgggctgcggcggggggttcagaatgtaagatgcctggtgttgtcgccaggctcccgcgccccgcgtccaatcggaggttcagaggaaatgccggattgaaaggatcagaagcaagagaccaaaaaacgtttccccccggcctaacaaagccccgggcggcttcggctctgctcctgggtctggtaggaagttgagaaatcggtttatggtagacagaacagagagacaagcagataatctctgtttttaaatctcctttggatttacgaatctttttaaagatctgatgagaaccgctaaacagaaattgaaatgttgctcaccagacagcttttgcgtacaatcggaggagggtcctggaccttctttctgcagcccacccacgacccgggtttctggtgcctttctttctttgcgccaggaaagtggagtctgggatcgagggccttgattttaaaatgggatactgcggaccctcaggaatctgacttcactttattttttcagcacaacttgccggcgcggccagggcggagaggttccctcgtggaaaagttaggaaatgctgcgctaccgcgggcacaagggagtggacgagatgagtgcgggatcatcccgcaggccatcccaggatcggggagggaggccggccccgctgcagaaaggggccttctgggagaccccccagcccaaggcaggagcccgggcgattcccgggaggccgcaggcgctgggcgaagcgctgggcgaagggccgctgccagccgggagagaattcataggtttgttgaggagcagaggcctgggaacaaattcgggcgggcacggcggctagaactgatcgctaccaattcgaggaagccagcaaggcaggttccgaggccgcctgcccacccgcagcttcttggacactgcgcaaaccctgctgcggccaggctggagcctccgatcaccaaaccaacactccctggccttctgtttcttgattccttaattttgagataagaccgtccctagcagtgaggcctcggcctctgttcatttaacttctcaaaccaaactagccctaattcagttcaccccagagcatcacctggttttatttttatttttttatttttttatttattttttttttttttgcagcctgaaattttaagtcaccgtctgtctccctcaccagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaccccgcacgtgtgcttctttcagcttgcggcgcttcagaagcaggagagaggtggccgcccgggactggtctcagatctcaggcacaggcattccctgagcaaattgataacattgatactaataaaacctaacccttgctggaaccatactggttccgtgtcgggcactttctgagattgtctcatataatcctcaataatccaaaaaaaaaaaaatcctaaagtttagaagctgaggcccggagaggtttaatgacttacctgcgagcaaatagccagtactagtcgaactctggttaaattcaggatgcctcacttcagagaccgccttccctgtgctcccaagctcccctccttgaatcctaatgtgtgccaggcacggttccaggcactgggcattaaatggacagcaaaagaacctgggccctctgtagctggagagcaccgtgatcatcccacttaaaagaactccttagcctgtttccagatggaaaagccaagaacccaagcccttggcaagcgttctcaggctcctcagatgcccccagatgccacgtcggggcctcatcagctgcccgtgggactgagtgccgaggctggaccccagagaggtgtcctgcggatggtgctcacctccagctgtggtgaggccccataaattcacatggtcaagggagcccctaagccctaaccttactgatgtcctttccttagggcatttaatttcaccatagttctgaccaacaaatgttactagtgtcctgattttatagatgagaaaactgaggctcagcgaaatcaagtttaaaccctgcttgttatgggacttgcccactgcatgcctcggtggtggtggtggcggtggtggtggtggcggcggcggcggtggttgctcttgtttgtctgtaaaatgaggataacaaacacaccttgctcgcatccaggatcgccagtcagcaggtgctgggaccggacctccagctcctctatcaccagccccagagcctgaggaactgacccaggatctttttaagatacgtctttaaaagggaccaaagccagagggagttgaggatttgttttctcactggatatgggtttttctgatattttgcccaggaagcactgagttggaggcctggggcattggggcatccggctgagagctccctgacacagccaaagcattgcttgtggcagccaggaaccgagtgcttctcaatgttcccctgactcccagtaagggtcgccaggctggcctggcacaaccaggagctgtcctactgcctcaccaggaaccatgcagccccgccagcgcctgtggtgtctctctgggtaagtgccacacgcccgtggaagaggggaggatgccaggaggttctaagtacaaccactgtctatacccagtgttaccactggacacagtaggatacaagggcagtggagtgcaggcagtctaccatcacagggttctgggctgtgctgtgggaaggaagaggaaagggctgtgctcaaggcttggctgagtagaagaagggacctgaaggtctgggccagctggcagctagagagagccatcaggagtgggagccggatgatcagctcagccctggcattccacctcctgggcctgtgaccctgctgcgagtctttaacatgttcctgtctcagtcttacggagggacacactgaggctcctccaggttgccagaccagctcctaagcaggacggtgctctcctgctaggcagccccagcccacagccccagcaggcctaactcacacaactgggaaattcttctatccgaaatgacccgtatttgctcttaaccagatcgctgtggcctccgtcccgcactcctgtgggcctttttcaccttacaggtgtctgcagtagcattagaaacaatatttatttcacttaacgttataccacgaggatttctccatgatacttccctctttatgtgtca

SEQ ID NO: 12360 - DNA, 105679 bp, Human
cgggaaagactccagatactgacctttgcatcagaattacctatgtcctaaagagagaaggtttcaagaatctatataagtagagataattatatgacttgatgctctttccaaggaaactaaaaacatactccagatgggacaatatgattgctcctgcattaagaacatgagattacccatagcatcttttacaaacccacaaaatagaaaatctggtctaaggtaggaaaacacaagggctgtgggtcgcaattttaaaatggggagatacaaccaacgtggccagtcttcttgtcgatattgtcttccacggataggaagactcaaacttctgacgctttcatggatgtgattttttttttcttttgtttttttgtttgtttgtttgttttgctgttggctatttgtttcttgtttcagtccccacctcacattatctaaatgactgtagctcattttgacttgtgctgtccaatacagtagccactagccatatatgactacttaaattgtttttctattatggtatacatcatgaagtttaccatctcaatcctttgtaagtgtacatttctatggcattcagtacatttacactgttgtgcaaccattaccaccctccatctccagaacatgttcatcttcctcaacagatactctgtacttactgaatgtaaactccccatctgccttccatttctatgaatttgactaatacaggtatctcacatcagttgagtcacacaatatttgtccttttgtgactggcttatttcatttagcataatgtcttcaaagttcatgcatatattgtagcatatactcaaatgcgtttccttttaaaggtttaataatgttccattgaatgcatgtaccacccacattttctttatccactcatctcttaataagcacttgggttgcttccaccttttggctattatgaataatgctgcactgtacatgagtgtataagtatgtaagttcctgctttcatttcttttaagtgtatacccagaagtggaattgcaggatcatatagtaattcttttaaatgtttgaggaatcacaatattatttttcacagtggctgcaccattttacattcccaccagcaatacacaagtgttcaaatttttccacaatggtcaaatttctccacatccttgccaaaacttgttttctgtttttttcttgatagtagccatcctaatggatgtgaagtggtgtctcatggtggttttaatttgtatttccctaatgattaattatgttgaacaactttcctatgcttattggcattgtatatctcctttggaacaatgtctatccaagtcttttgcccattttttagttgggttgtttgtttgcttttttgttgttgagttgtaggagtccttggtatattccggatattaatttcttatcaggaattacaaattcctgataaagaattactattttctctcattttattggtttctttttcactatttgttgatagtgttctttgacacacacaagtttttaatcttgaagttcaacatctttttttttcttttgttgcttatacttttggtgtcatatgcaagaaattattaccaaatccaatgtcatgaagttttctcctgtgttttcttctttgagttttatactttagttcttatggttaggtctttcatccatttttagttaatttttaaatgaggtataacatgaggactgctgctgcttttgcatgtagataatccagttttaccagcaccatttattgaaaacactgcccttttccaagacccaaatcttagcaaaaatcttagtacctttgtggaaaatcatttgaccttatatatatatataaggatctatttctgaactccattctattccattggtctctatgtctgtctgtatgccagtatgacactattttgattatagtaagttttaaaatcaaaaattgtgaggtctccaatttttgttcttttcaagattgctttggctatttgtgttgccttgagagtccatgtgaattttaggatggatttttaaattttggccaaaatgcctttgggttttgatagggattacagtgaatctgtagatctctttcagtagtattgacatcttaatattaagtcttccaatccacatttattgaatgactttccatttatttttgtaatttcaacaatattttgtagttttcagcatgcaagtcttctgactccatggttaagcttattcctaaacattttatttttttgatactgttctaaatggagttattttcttcattttcttttaggatttttttatttactagtgtctagaaacattttgtatcctgcaacttgcctgaattcaattattagttttaccaggactttttttaaagaatcttaagcattttctacatgtaagatcatgtcacctgttaacagagataattttgcttcttcctttccaatttgaatgccttttagttctttaacttgcctgattgcactggctgggatttccggtactatgttgaataggagtggcaagagcaggcatccttgctttgatcctggtcttagaggtaaagcttttattattcaccattgagtatgaataaagtaagctgtgggttttaaaattttcattaagatgaaataaaactgaaacactgtttgacagttttttttaaagctaaaaacctgtggtggtatttctgaggtctctgttatgttctgttggtgtatatgtgtgttttggtaccagtaccatgctgttttggttactgtagctttgtagtttagtttgaagtcaggtagcatgatgcctccagctttgtcctttttgcttaggatcgtcttggctatacaggctttttttgtttcacatgaaatttaaagtagtttttttctaattctgtgaagaaagtcaatggaagcttgatgggaatagcattgaatctataaattactttgggcagtgtggccattgtcacaatattgattcttcctatccatgagcatggaatgtttttccatttgtttgtgtcctctcttatttccttgagcagtggtttgtagttctcatagaagaggttcttcacattacttataagttgtattcctagttattttattatctttgtagtaattgtgaatggaagttcactcatgatttggctctctgcttgtctattgttgatgtataggaatgcctgtgatttttgcacattgattttgcatcctgagactttactgaagttgcttatcgacttaaggagtttttttgggctgagacaaggttgtttttttttttttttttgagacggagtctcgctctgttgccaaggctggagtgcagtggcgtgatctcggctcactgcaagctccacctcccgggttcatgccattctcctgcctcagcctcccgagtagctgggactacaggtgcccgccaccatgcccggctaatttttttgtgtgtttttagtagagacggggcttcaccgtgttcgccaggatggtcttgatctcctgacctcgtgatctgcccaccttggcctctcaaagtgctgggattacaggcctgagccaccgcaccaggccaacaaggggtttttctaagtacacaatcatgtcatctgcaaacagagacaatttgacttcttttctttctatttgaatacactttatttctttttgttgcctgattgccctggccagaacttccaatactatgttgaataggagtgatgagaaagggcatccttgtcttgtgtccggttttcaaagggaatacttccagcttttgcccattcagtttgatattgggtatgggtttgtcataaatagctctcactattctgaggtatgttccatcaatgcctagtttgttaagagttttcaacatgaagtgatgttgaattttatcgaaggccttttctgcttctattaagataatcatggtttttgtcactggttctgtttatgtgattaattacatttattgatttgcctgtgttgaaccaaccttgcatcccagggatgaactcaacttgatcatggtggataagctttttgatgtgctgctggattcagtttgccagtatttaactgaggatttttgcatcgatgttcatcagggatattggcctcgacaaccatctgatctttgacaaaccagacaaaaacaagcaatgtggaaaggattccctatttaataaatgggtactgggaaaactggctagccatatgcagaaaactgaaactggaccccttccttacaccttatacaaaaattaactcaacgtggactaaagacttaaatgtaaaacccaaaaccaaacaaacaaacaaacaaaaaccctagaagaaaacctaggcacaaccattcaggacataggcgtgggcaaagacttcatgactaaaacaccaaaagcaattgtaacaaaaaccaaaattgacaaatgggatcgaattaatctaaagagcttctccacagcaaaagaaactagcatcagagtgaacaggcaacctacagaatgggataaattttttataaattacccatctggcaagggtctaatatccagaatctacaagaaacttaaacacatttacaagaaaaaaaacaccaccttcaaaaagtgggcaaaggatatgaacagacacttgtcaaaagaagacatttatgtggccaacaaacataaaaaaagctcatcatcactgatcattagagaaatgcaattcaaaaccacaatgagataccatctcatgccagtcagaatggcgatcattaaaaagtcaggaaacaatagatgctggcaaggctgtggtgaaataggaatgtttttacactgttggtgggagtgtaaattagttgaaccattgtggaagacagtgtggtgattactcaaagatctagaaccagaaataataccattactggacatacacccaaaggattataaatcattctactacaaagacacttgcatatatgtatgtttattgcagcactatttacaatagcatagacttggaaccaactcagatgcccatcaatgatagactggataaagaaaatctagcacatatacaccatggaatagtatccagccataaagaagaatgagatcatattaattgcagggacatggatgaagctggaagccatcattctcagcaaactaacaaaggaacaaaaaaacaccacatgttctcactcataagtaggagttgaacaatgaaaacacatggacacagggaggggaacaacacacactggggcctgtcaagggttggggagcaagggaaggaagagcattaggacaaatacctaacacatgcggggcttaaaacctagatgacaggttgataggtgctgcaaactaccatgccacatataaagctatgtaacctgtacattctgcacacatagcgtagaacttaaagtataaaaaaaaaaagaatctcaaaaaactaaaaagggatttactacaggacccagatattttgctctcagacatttatccagagacgtaaaaacttgtattcaccccaaaccctataccataaacaattacgtcaggtttatttgtaatagtcccacactggaaactactcaaatgtccttcattgggcaaatggttaaatggttaagcaaactatgttacatctatgccacagactactactcagcaataaaaatgcatgcaatgatttggataaacctttagataattatgctgagtgaaaaacagttatctcaaatatttcatactgtatgattccatttggatggcattcctgacataacaaacttgtagaggtggagaagagattcatgattaggaatatgttaggagtgggttaaatggtataaacagtatgagagaaacttgtggtaatagtacggttctgtgtctcaattgtagtagttacatgaagctatacttacacaagtgcataaaaaatagtgaaagatgaatattccctatggattttaccggtatcaatttcctggttttgctattgtactgcagtcatacaagatattaacatgagaaaggctgggagaagagtgaataggacatttctatacatatctctgaatttccacagaatctgtaatatttcaaaataaaaagttaaaaatagaagacaaacttaaataaaattaaacttagttcctcagccacactagccatattttaagtgttctataattacatgtggctagtgactccatattggatagtgcagaattatagaatgaacatcattacagaaattctgttaaaattgctataggcactcggatgtctgaaggagctttagaatccacttgaaacctatgcgatgatagcattaaaagaacatgctacccttgctacataagccaaattcaaggtcttctcttttaaagatatggttattattccacagttattcttcagctaccagtaagggcagccacacaatctgttatgtaagcaaaaggaaatgagtaactttggtcccctacctccagaaatggcacaactattttttttctatttcccttctcttctgttcatgatgtggggaaactgggtcatgtcactaactttgtgctcatttaaagaaacctgggccttgaaactttcttagaagggtgttgcatcatgctcagaacacatatgagatattcaggatttcccagatgattcaaataattttctttattttacacatgactttaactgcattttagtagttcaaaattttttttaatgtttatttattattatactttttagggtacacgtgcacaatgtgccgattagttacatatgtatacatgtgccatgctggtgtgctgcacccattaactcgtcatttagcattaggtatatctcctaatgctatccctcccccctccccccaccccaagtagttcaaatttttatgaatatttagacaatagaatttggtagttgacaatttttctcatgttatttttctgggtatttttgcattctgtgtttatattttatagtaatacatttacttatacagaatttaaagataaaaggtaataaaatttaaaaataaaattgttcgggaaaggattaacttttcaatgtattgtccagggacaattggttactggttggaaaaataaagagtgtgattcctatctcaccctatacaaaaggcataaactgtaggtggatttaatatctaaatataaaaaggaaactttaaaattttagaataaaatggaaggatattttcaattaccttgggataaggaagagcttcttaaaggaatgtatgaaaagcacaaacggtagtgtaaatgatgaatacatttgactacaataaaattaaaatttatattttaaaaactgtaaaaaaaagaaacctaacatatagaccaagactaggagtaatttgcagtataacaaaagatcagaatccaaaatatctgaagagcttagataagcaatttagaaagagtcaatagaaacatatgcaaaagatttgaaaagacaactcagagaaaatatataaatcattaataatgatcaataaatgatgaagagactcagtctcctctgtcataacagaaatgaaaattatttttttaataaccatcagcttgacaagaaaaagtaaatacattttaacatctaaacgactgaacatatctacagaaaaataaatatgccactttccgcctccttctgggctcaagcaaacctctcacatcagcctccgagtagctgggactataggatggtcttgagcccctggcaagtgatctaccagcctctgcctcccaaagtgctgggattacaggtgtgaggcacctgtcagtatacgactttaattaaagtaacttgtacaactatcacccagctcaagaaaccttcataaaccttttctaagtcccaatacctttattctcgactagttgtaactattaccttgagctttttcaagatctgatgacggtctacaggggaaaaagccctgaactttgtagcatttgctgatgtccaggaagtaaatattcccattatggcagatttcaagctcccaacatttcaactggcttgcccagttcctaaaaacctaacaaataattctcgtatgtataagcctactccagcactcatgtcaattctgtcatttcttcgggttttttcttctttttgtgtgtgtgtgtgtaccacctaagtgagcatctttaaatagttttgttttagttgcttctgggaatatcaatattatgtaactgaatgaaattactttccttctgatattctggaagagtttaaatagcattgagattatcttctctttaaaggtttagttaactcctgtaagaaaccacctggatttaatgacttttttctttctttcttttttttttttttttttgatgagttctatctgacaactttgtttcttccatggaaatcagactgttttgatttttcggaatctcctttctggtctgttttgataatttatattctcctagaaacttatttcatctgttttcacatttacttacatatatttgagaaagcagctttgtgatacatttttttgttttctaaggttattgctgtcttatcttttttacttttggatatttttctcctattatttcttgatagtgttctaaatatattttctatatctttttggtttagagctagttttaggatttatccataatttctagtgttttgttttctgacacattaatatctgtttgtaattttattagtttttttccaacctcttctttctgaattcttgagccatctatttagttagtgttttttgtaacttcgtgtgtattaatgtatgtagttaaggctacttgtttttctctgagcacgttactttagctgttaagaatgaatcatatttagaaaaaaagtgtactaaattatgattcaggacacacagacttccatcctgtttctctctgtgcgtagcagtgtcatttgggcatgttactttgtcttcctccctagatttcagcttccccaactggaaaatgagaaaatatttgatctcagaacttctattttgctctctaattttatgaaatataccctcatacccatgttgcgactccagtaatttgaattgagtctacaacatgaattctaaagtctcaaactttttttttcctaacatactagtaagtctatgaactgtagtctctggtgtaatcaaaaagacatgcttcttttcattctttgtctacaatatgggggcctgagcatcaagcagattcaggatctatatagacattcttcattaacttggaacattttgtcagaatcaatcagctggtggaagttattatggaacgttcatgaggaagcattttccaagatcctttgaaattcttgaaatacacaattgttagcaatgcagaatcaaacagaatgcagtcttattgaatgggttaagatgaagttacaacaaatattgtgtcagagtaaacatcagaaaatagattttctaaggtctagaagttacaaagaaatatgcaataatgagaatattattaaacattgacagattctgtatccaagtgttccttaaaaaataaaaaccatttattttgcgctaataaaaatatgttagggaatagcaaacagattgtcacagaatgtttaactcatccatattacataaaattcacaagtgaaattactgtctgcattttaaaatctaagtagcaactgcaaaatcaaagtactttgtggaagagttaacgtcactacaacaaaatgaaataccttaagttgtgtgtctgtctttgtatttaaacattaatagaaacccagtatattttacttatactgactaatgtagaaaaatccaagaaggtgagttagtagagaaatggaacaaaatatcattcatttacattagtttactgaaagacattttgtcttctattttataaaatgttattatgtaacaatagcaatcattgccctctctgtataaccctacacggtctgaataaatcccttctgaatagtttttctgtacagctcaccacatttctaactacaggaatgtaatcttacagccttaaaaaacacattgatttttatgcacataaagagaccaggttaattaacgatgctaaaaatgataaacataatttattctttacctctcacaataagggaaagaaaagttattacatgctatattttgtttaaagatttatgatgcagcataatttccatttcccttataataaatatttaaaagacatataatattaaacacttcacctaattgcaaaccttatatgaaaatattagggtgatggtttggaagcacaaaaacatttactgtcactcagtgctttgtacgttctttcataaatcagtatcggaagcccacaggccaacaaaactctgaaattctggccaaacagttcccagttatgtgcaagagataattgcttctcaaagtgccaaactggacttaaaatttaaataatagaatataaatatgctggacatgagtaggaagataaagcatatgcatttattttggctagagtctgcttaaaattttgaattttttacttatgacctgtataagcttggataagttactagatcattttgggctcattttattttctaaatgggagtgatgatacctactttgtagagttgttataaagtcagaatgaggtagtctgtacaacagcttttggtacacggtaagcaactataaaattttcatttctcttgtgatgatcttttataactggccattgtttagaaatatagaacttaatgtaaaagataaaatgtgaacatgcacataaaaatgtgggaaaatatttccaaaaacgactactaatatagaaactggagttaagcaggaaaatattcaaaattcgactaatgtggccagtgccaaataaaatacaacactagactcctggacaaaggatatggtaggttggtctctttcccgtcattaagtggatttctaattatgttgtatatgttgtttcagaggcaaaggcccattgaaaaatacatctgatgtcattaatgctgccaagaaaattgccgaagcaggttctcgaatggacaaattagctcgtgctgtggctgatcaggtaatagaagagggaagggtgggcacatgctgagtggagtcactaattagcacttgggttttgtaactagttttatgcaccctataaaatgcctctgaagaatgaatcagaggggagaatcactgatattttacacactggtatctgcctctcctgacactgtgctagtggcaaacgtagatttagctcaggagagaatgctaaggcttctgaccaaaattccttgagaaagaagaacatactacttaggagacatcagcccctgaagagtcacggattgtcccagccttccccattcagaaaggcaactatactgcataatgaaggggggaaaagcaggtttttaaattttcattgttaggctcttggtttaaatatattttcagagattcctacctaatgccctcttttgtttacttcatggtgcttatcacatttaaaaaatatatatttattattgctttacttttattttctgttgcccccaggaaatttaggttgcacattttaactgcctgacagaatgaataaaggagagaaaagagcaacctgccttgtggtcagggaactgaattagcagagctttagggatgtgatgggtcatgatttgatggtttctttaaaaagttgtcgcggactctaccaggagtagaatggaaactgggggtaggacagtcaggggcatttggagatcaaagggcagaaacaggttgcagaatctgggagaacatcatgtttttaaatgtagaaataagaaactagaacttcaccttttcttatttaatatggctctcactctaatgatattcttcataataacttatgctccaccataaacgggattattccacatgatcaagaaccttcagatttcagctttattctaacccagactcagaagcatcagagataaatgaaattctcagagtatctcttaatgctttcaaaccaaactaggatatacattaaaagagttctcaccttgaatgtttatttccatacttttcgttttatttggcttgaattggaactttaaaatcctgttctaaatgttttgttgcaattatggtccatttcttttaagagtgctttaggtagtagacttttccaggtaactaacagttatccctataagcaatagtgatttacagtttgaaccactttggatggattgtatcataaaatataagttttggaaataaaatattatatatgctactatctacatggaaatattaacatgaatttgcttagtatactgcagtacattgatgcaagctggagatactgaaagagaattgcatccttctccatatatggctctagtctctgatgatctgatgatttttgagtctttgtgttgcttattgtagttttcctccctcattcctatatataagggttgctcctctaaatacttactgcctcagcatcccaggctctaacatccttcattcaagtcaataccaaattcacacacctttaaaggctgaaaaaacaaaacaaacaaaacccctcatgattttactatcaggattgcacttaagagtcaagagtcaacgaattctcattttaattttattttacatttaagatggctaatccaagaaatttttttaacttttgacttttggagaaatgcttattggttgagataactcaagtactatgagaatttgagaactgcttacaatttgtaggtgttgagtgttaacccattgctattgcctaatttcagggcaatatcaaccatgaggcttcacagcataaactgagggttttttttgacagacttccataagtattccagaaagttcatgtagaggagggaagagacaatgaatttacttgaaagtatgcatacaaaaaaattaccaactagaaaaggccacattctttttctgcagatgttgagaagagttgggatgtgtagagtgaccagaaattggccatccaccaatttgttaggaaggacttcttgggagtgaaaatgagcggagtttgaatggctgtttcattatactttaaatctcaatggtcaaaagtatttcttggcatctttaggcccttcaagttcaatagttttggttgtgacttttgtttttgattttacctttttgggcttttattttcaactatgcaacctaaagcataactcaaaacagttgatatgtgaaaaacacatcaaacacacacacacacacacacacacacacacacacacacacaccccaggatacatttattttgagattcagtgacagagtatttaaatgctactatttcacagtgactcaaaataaacggattaagtttaaacctaatcctctttgtggcattattattgtcattagctgtgaaataacttgcaatttttgataaagaaatcttcagaaaaaaatgttatcaaattctgcacctatttccatgatttaggagttattttccttgattcaacatgcctttttaaatgtgtattttaactgctttggtttaaataatagaatagaatgagtattatcaaggactggattggttacatttattttgccggaaaatattttataaagatttgagatatgcatgccatataaactttttacggactgttgcatttttaattactgttccattgagatagaactttcagtttaatttgctgcaaggtatttgtatcaaaagccttgtcagccctctggggagatatcattttaaagttaatccctttccgtgtatgggtccctggagtaggataaatattacagtatgaagtacttgtaagaagctaaaaacagtctctgtggaattctttcttgataaatgcagttagtgaaaaaataccacaatggtaagtgttaaatataaaaaatatccctttatcatttattcagtagatggttatatgtaatcactggctttacagtattgataaaagaatttcctttcttgagcttgagggaaacttagctcagagtctttctcccatcctctcattctaaataagatacttcagttgtggctgtaggtacttatttcttatagtattaaggatctggtgattttatgtcctttacaagtaccaaattgatacagaacaattaaatggcctggaagtagctcaagctgaacctttgatagcaaaagaaatatgtaggcatctcaattcctcggtagccattggcaatgaagcctcagaaatgttttcaggagtcatgtcaatgtctctagaagtgttcagccaagctctgtgtgtgcttgatggacacccgcctacttcggtcataatgaaaatccaaactccttagccagagttgactccggtgcgtccatcaaaggactctgttgctactcttatgaacttctttcagctggcttcagatacattctgtcaaatctgtttttcttacagtagtcatgaaccatttcagtctctcatttaaaggcaggttattatgttgcttacattttgataaatattaaattccaaaaagtgtaatagattttttataagtgaatgatacatttattagagaacaaaggaaacaaattgattttcttcccccaactaactggattgaaactgtccattatgcttggcagagagtgccacacaaagtgatttacttttagcatcctttggtcctctgcattaaaataacatttcacatagtgaaagttgaaggaaactgtaaaatatttaggtttctttagagtttagaagacagcaggtaaaaatactcataaacatgtatagaagtcccaataaaactttctggaatatcttcaattttcttctgataaaattttattaaagtagagccaaccattctaaactacagtctgtggcctttctaaaatgcactgtgaaaaagttaagttaaatgaatgtaattaaggtatatgacactgaaaacttttcttcctgcagcttttctataacaaatgttagaaactgaagagtacttactaatcaagatcactcttttaatgttttatagtgtcctgattcagcatgtaagcaggatttattagcctaccttcaacgaattgccttgtattgccatcagcttaatatctgcagcaaggtgaaggcagaagtgcagaatctgggaggagagctcattgtgtcaggggtaagctggacttgggcttcacaatgtaaagttcccaccgttgcacttccaaggcaaacattcttggcaacagtactgctaaaaacaccaaactacagtgatttatagggagggctttttttaaataaatgttatcaccattattccagaccttacaataactcacaaagagcaatttgattttccaattaccctgtgtttattctagccttgtaaaatctccattcttcacaagaaaactaattttgtagtctggaaactcattgccaagctgtgactattgtaattatttggggcttttgtatatttactcattgtgagtctacttccttttgttagtcctagtaattttcattctctgttcaggagccagcctctctatgtgtggattgtgttcacatgttagagatgatgaaaacaataggaattcattcatcaggttccaatgcatactaggttatcagtaacccttgaaagccagaagatgtttgaatttaatacaggttgatgtgctgttgccaaaaactaacataattgtcgaacactaacaattatatattctttgctcaatcactgcagtgtttcctttctcatgaaaatataattatctggtccatttttatcaaatgcatagaaataagttcaatgaatatttagaagaatcacaatttcttggcaagatttccaaatatgtgttgaggttcttcaccttggcttcttctcctccctcaacccctttctctcaacacagggtgccatttgttgcaaattatttgcaagtccagaaatgtggctctgacaccttagttcttttcccagtcagacatgatgatgctaccatttcaagtgagtaattaccaggcacgtaatattatcagcgtggtgaataccttatgaaaatcagactagtcacaaagctcaggtcttcctgaagccatttttggaaatttagaagtttggccatttggtaaaaacacgtgaacaaatcattcttgaacccaactgtttttgttcccatattgtttgagttgcagaaaacatagctgggaaaagaactgatctggcttgcatagagacaccatctggaaagcctgtttcatgcagtcccacctagagcccagtaaattggctattttgtgcctcttcccaaagcacagtcacctctttgcatttccaaaatgatcctgcttcaacattcttcagcaaccaagagcaatctgtcttgcaatgtgtcctttctgccaagctggtaattaccaagattctctcgccaagaagtgatcaaatcattgcatcttccttgctgcctttcttatcttcagccttgatggtatagtttcccataccactcagctttcatgtccatctgtatatagcccctgtggaactgagtgctttttgttcagcttgccttgtgtgctttcatttgttactttccaatcttattatttacatggatgcgcaaagcatctttgtggatctcagactccacaacctcatctgggcaatttttactagcagagccgctctccatcatcctctcagtacccattgtttgtcactgcctccaaagcttcatttccattgtctttttctcatttagatgtagtccaaaccatcactggcttttatcacttgcactgttggcttttatagaggtgtttgagattgggaacaccatcaagaagcctgttcccttctttgagtcttgttggtaaagttcataaatccttgcatgggagaaggcttcttttagaagaatgttgttcaacttgataattattctgaggcaaatgcattataaatatttgctatatatgctctgtcatgggcctgctcttggcttcctcatgatttattccaagcttgattgctgtttggtgccacacctacatctatagtctgctgtctttgccaattctgcctccatctttttcttcatgctccttcactgatggccaatggagaaaaaaaatgaatatgcttactgtgcaaaatagccacaaatgactgctttcaaagttctgaaagagtcaagaatgtgagaccccatacacacacattttcaatgattttgccaagaaaattacacccatttattctgtcatgtggcatggcaaagttgctgttttttttcagaagaagccatcatagtttaatgtacaatcaaaaaagaaatacttaaatcttctttcttttttccctgtgtttatacacatgggattcaaagccacggcttctctgaaatatatgaaagcccccaggaaagttacatttgttagaagtcaacctctctacccaaacagaagagatttggacatattatttccattttgccaagaaaaatgattttgatgtcaaaacagagagccacgtttttagtcttatgctggcatgatgaacatatgttaagcaaaatgcgcaattatgtcttatgtcagcgtgtttttgttttatgtgattctatgtatacaaactgagaaaggcctcttgtcttgtgtctgcttttggcttgagaggtggggacagataattcaacaggtcacggaggagaatggatacaaaagctctccaggcatcatgacggcgatctggagaaataaagcagtccaggatgtgtttctgtgtatgctcatccacacaactgctatctaagaaataccattggtttcctacctggcaattaggtttttttttttgtcattggcttaaacctgtctcaaccaaaaagtgacattcttattaaatctcaaagtagaaaatgcatttgtgagccaattcagcttaacccggttactaagggagtaatggaaaagaaaaaatatgatagaattgttaaagtgaaagtagaggaaactgagtttcagaagattaaaccgtctataaattggctttatttatttgcttagtttaatgtttgcttgaattcttaagccagtttacaggcttttttgagaaaaagaatattgaaagcagaaagaaagataaggaggggaggggagggtagaagagaagaggcataaaagaagaaggtagaagaaaagaaaaaagaaagagaaagttaaagataacatgtcttgaattagtttagtgcaagtaatgtccattaaatgtgacagcattatcttatgggagaaaagttaagccatatattttttagtatgtaaatactattttgaatacaaatatgttccagtatcataatatgggtattacctgtatatttaattatcatgtttttgactaatttttgtttgctaggtttcacagggtttaatcagcacctttaaagttaaaaatggagatgtatacatggatctggaaaaataaaaatcattccatgacctttaatattttttagctacccaaagatttatacagagcgtatgattctgaacaatattagaaatactaatgtaggacttttaaattagcatactgaatatcaaacattctgataaacctaataaagcctacctaaactgtttttttaaagttaaaagataacaggagcttcattataacaatgaagtcagaacataacagcaataaccctactttgatgaggaattcaatgttcaggatgtaatttatggccaaatgtacacaaaaatggtacaaattttaatagattttattacatataaatgtctctgtattaacaaaatatttgagtcaagtttggaggtgaggaatgctagttgcttaagtccttgggctgaatgaatggattactgacctattcctgagagattgagaagcttgccctaatatgtacttttgttctttgccatttaaatatctcttttccaaatctgaattcctctcaattgggtttaggggagaggtttgacaaggtgagcaagtttaacttgggacactggtaggatttgaattggtaaagagaagattggagactgaggggtcaattatagtaattcttattgcccacgtttcacattattttaaaaaattggactctaattacaatcaacatgaatattcatgatataggtaatatacattcctaaaaatgttggaaactgataatattcaaatcaactctacctgacactgtcatatattcaaagatgcatatgtgcatacaaacatacaaacacagagcacaattgatttgatatttactcttataccctcaataaaccttagtgaagtggtcaggaactgaacaagattgataagtataaactatctgatccaatacaaattagggaaaagaaaatgtgggatatattttgtacaataatatatatatggtttgttgagatgagaattacattgtatttgaagagcgttgtgttccttttatttttaaaaagtgccagtattttgtaatgagctaaaacagccattgaaacaagaattgcatctaattgtgtagacctgtacattaagcaacctttttttcttaatttttatatcttctattttgtctatagtcaattcttcatgatctccatggatcaaagtgtaacagtaatgaaaaaaatctaaagtgctagctatttcaatttgggtttggaatgcatgttagtgtttcatttgaacaaaagggtagatgttctaggaattcatagcagttcaaaataattttatccagaccttccgtgcttaaaggaccttcccttatgtaggaaaagttgcagtgtccaaacctagagagagtaagataaaaacaaacttcagattgtaaatctggatgttaggcatagtggagaaattgtgacaaatgaaatgagtagttaccttttacagagtaaatggcagtagttctttgcatatactttgctagtaaaatgagttgttgcatgattccatattttccccaaaatccattccccaatctgttgatagtgaaactataaccatttaaattctgattcctgcattaagtcttccttagttacattcataccagtatgaatggtcattgatttctgcacaacccaaattatagacaccctcagagggaaataacctttctatggtttttttcactgaacattcattcccccagagtgttaaaagtgacagtttaccaattcaagacttgtttttggaagaaatgggaagttaataggaattttaatgagaaagtaaaaatttctttgggtgctgggcatcatagaaagctttgtgtcttttgcactgcacctgtgtctgttctctgaattcagacagtcttgtacgaaggagtctggtatactgctccactatagaaagtgactcttcagttacattttctgtgatggtcaccctaaacttaccaatataatcagttatggccattaaaaaaaatcagttattcattgatggaattaaagcagttggttatctaactgaattgtttaatgcatagggaaatactatgttccaatatactcattttaaaataagaaaacatactgtgttgtggcaaagctaggatgcaaatcaagcaaataactcttcttaccttaactggagacatggattgaccttaattcgatctactactctgtggatggatttgattgtgtcacctaaacttgtgggctgacgagtaatttctattttagtttgagggcattactgcttgtaacagcaggagttagtagctttaagaagagtgtcccctgagatatcagtgccattacttgtcattcaatcagtaaaatttcattcctttgggtcttagaattttttcaagttttgagatgctctaattaaaagaagaaaggtaaataattgacaacttaatttattatcaattaatgccttagatttcagttgatattctgagaatgatttagtagccaattagcagtaatactttttgaaaacttggaaattggacacatgggaggtacctggatgaggggaggtgattgcatatacagttggccttctgtatctgtgagttctatatctgagaatgcaaccaacctgggattgaaaatatttggaaaaaaataaaagtaacaatacagcaataaaaatagtacagataaaacacaatgtagtacttatataatatttatgtaacatttgcatcataataggtataagtgatctggagaggatttaaagtatacaggaggatgtgtgtaggtttcatgtaaatactatgccattttatatcagagacttgagcatccttgaattctggtatctgctagggtcctagaaccaatcccccatggataccaagggatgactgtatcttgggatatgtgtaaaacccagacaaacctatttaagaagtattattttataaagcttccccataagacatatcctaattttgactacttgttcatatatgagaatagtctgatttcattccaagattttttttaaataatttaaaaatacttcaaataatgtttcaaattattattgctttgagaagtgtcttaaaagctaccctctccccagttttgaaccagttttggatctgtaagagcaaatccaaatacgttcaatgtaatgtttccttacattgaaccaaataattatgggaagccaaagtgttgagtgaagacctttatttagaaatggtgtctgtaaattcagcccctgtaaacacttgaatttttcagttctcagctctagtcaagaaacagattatttagaattggttacttaaatgcattgtgattttttttttcttgtttctactggggcttaccccaggaattcctggactgaagtctgttgaagaaaaaagttgatatgtgaacaaggtgatataatgtgaataggcaaaagagaagggatattgaaatcatatgctaaagattatctggggattttgtcattgattttacacatctttccattaccttagctggttaaaaataagatagaatccatagcaaaactgagtcaggatttttttattcagtactggatttgataacattttgacaataatatttttcttaaaatacatcagtttccataagtcgtttctaatttccaatggcaaacaatcagagattcaaagagctgcatttatttgttgttcacataagaatattttctgattcattcactgaattcaacatttccattgcatccctactatgtaaaaggcacggtgatatattttgactgagttgggaatttaaagtctctttatctctaataccaaataattttcatgaaaaggataaatttttctgtcccttgtgtttttattagactgtgtagtctatgtttattttttttccatttagtttctcagcttactgaaatagggttttcagctagaatagcagagtatctgttgatggctatttctgtgcattcgttgttttcttggtttactatatgctagaaataaaagtgtgtttaacttactgttgtctacattctgtccctgcagattattttgtcaagtgctttttccagcctaagttaaatcatttataaaatatgactttgagtgcagcccttagaaaagaaatatgtgccactttatggcccatgtatcttacaaataagaaagtttccggatgggcaatgtggagtttctttgttcagatttcttttactgcatcggaacacattgtcttactctatcttaaatagtaattttccttctgggctataaatatatctcaaatacttcatcctaattctattttcttgaaggcaagctttcttaattcagacttttaatcttttcttttatcatcaatactgtatcttgttttattagttttctctgaacaccttcatctgtgcagatgccttgctgataatgaaattgactggaactctggctagatgtcctgtcaaatcggaacaacctgtctcttgacctctttcatccattttctttggcaaatctcttttgcaactgagaatatcctggagaagttatggtcaacatcgtcttttaagaaccatgtacgtttgtcagcccaaatttctgtatgtgagacgctaccataaaacaaaatcaaaacatctctttatccgagaacttccaatttgaatctgctgctatccacatttattggagcccctcttattgagatatttctcttcaattataacattttgatcaacttacatgaaaaaaatgcctgaccttgtcttccatgatgaatgcatctgcagattgttcttttggaatgcacatgttattccacctgacttttctcaatcttttgtgctaagaagctaaacaactttttattaacctcaaagatttgagaccagccctacatctgtctggtcagaatgaaattactaccgtgactataataatggagtcttgactactgaaatcttgcaaacacttcatatcttgtcttaaagggctacttacccatttctgaaatatcatgggaagtatacagctaatctacagttggagtagagcttagttttcatgaaaaatgtcaagaggctagatcctgagatttggaaattatctgatcctggcattgcatcctgtatcaaaggcagttttattattttaactaatatcatatataaaggcattattataatatcacaatcaatcatactaaattcacctaagaggtcagcacagttcaccactctgcatccttttgatgcagcctagttttgcattgggttcctgaagtcattttccatttccaaagagacaataggcaattataagaaatgccaatagacaatctaagttcagtttgttttatttcaatattttaaaagtgtttaactccatttttattttaatatcttaatgctgggagaattgtaccatctgtattgggtagtaaaaacttaaggtgtttattggaagaatggacaattgcatcattaatcttaatgaactttaaattttttatgagatgatccaagtaagtttctaatacgtaataatttttaaaactgagaaattgtgctaagtgactaatttatttcctacaatgggaaaaatcagaaaatccctaacttataaaaccaaatgagattgttataaaaaatcaaagataagccaactagtcaatgatccaatatgtaaaagtggagagaaaataaaacttcatagggccattaattgcaaaatctcacacacaaaaaaagctgttgaatatataatttgaatttagacttagaattgttgaaaataaaaataataaatgatacagcaaggaaaatatatgcagagtatcattgcctcttctgttaagtacagaaaaagtcaaatataggcaaaacacccatctttttatatgcaagacttttttttcttttctatttactttaattctttaaagacattctttaaatgtctctaacatttattttgaagtgaaaaatggacatgatgttgccaaatccataatcagtttgaatttagtagcttctgtgtttcaaactgctctctcatctgccaattttgcttaattttaaattgcaattattgtaatacacttatgtatttagtacgctaagaatgatgggcttagaaatagaattatattggcttaaaacagaaaaatcccaaattaagatttttgtttatctgtatatagaaacaggctttggtttttagccatttatgatgccataatttgcaagctattgttttgaatgtctaggtttcctaaatttttttctgtggaaagagatggtttcacttttcatgtattccactagtcagatgaaggccttttatgtggatggtttcaggatgtgcctgctcttcaatagtgtctgttacttttgttttgccataatcaataactttgagtattctattttaaactcctaaattttcattgaaaaaaaatactttagtggtctacatactattctcatgccttttcttgtttttctatgaaaactagacttggtaaataaagctatgactagagcagaaatcgtccatgacaaaaacattttggtcagttggcatcactgggtcatgtaacttgacctctgagagtgacagtgcatttttttatgattgcagaaaacttgccatttgattttttctacagttctgaagatgaactctaactactccttttagttgtatatttgatacacgcagaaaaagtcaagattgtaacattttatattgaaagaatcttatgaaaagactctaaaggtagaaaagggcattggttattggcttatcctttaaattatgcccctcacacaatccacccttgggttaaaaggaacagtcaaaagagttgcaattgtagcaacaatgaatgcattagtccttcagtgatcccaatgaaagaggtaagtatccccttagtagaggaccatgtacagaggttggatgtgcagaggccaaaggcttaaggaaggtcacacagcagggcgatggaacttccaagaaagacatcagggatccccacataccgttccaggctttaagagctgcagcccttgccttctctcttggtgatcttcaacactttaaataggggattcaccccctttgagccccactatagttgtcccattcagtgcctgacaaggcagggtgcatcttcattctcctcccacatggttcctttatctgttcaagagccaatgagaaatcgaaatggccaggccgcttaatgtcaagaaagcccatatgtatatctctttcagcacgtaattccttcatatacctcttttttcccaattacccattccctcttccactccctaatcccttcccaagtagggtactttttttttttttcttttgctctctctctcattctctcttttctgtatctctcggaaatcagacaggagttcagagcactttcactaccttttatgaggtagattgtgatgtcatagatgggggcagggctagtcaactttctacccacctcccaacctgtgctgagggagctccgatcgggagtggaagcagtgattcctccatggtgagtaaattgactttctaatctaatgtctttcattgtaatcatgaattctgaaggcaggggggattggattttagggaaataaaaatgtgcccactgaaggcctcttaatattaaccaactttgggcaaaggacttatttattctttatgtgggtcagaaattccacagcacagatatatcttcaattgtggtctaaacttgagaagtgaaaaaggtatttttatttctttatttctcagtctttcttcccattgggactgaaagtcatggcatatgtggaatgaatccattctatagtctctttgtgagcttcactaaggaagggtagtcagaaggatgtattcttctttgtttggaagatttcagggtcatgaaatatcctttactcatgtttgccatgagaatcagtgggcccttctaaaactgtggaggttaaaatgtgcatgaggatgatacatgaggattatcaacaaatactttgggtgttaacaaataaaagctttctaatgcagtgactaaaatgttcattttttgaaaaaagttacaactcctgcaagtttaaggtcacagccatttcaaggtgtcacagccagatttactacccatttttgttgttgcacgtcctaaccctgatgctgtttcatagggtctcttgctagttaagaggcatgaaaagctgctattgtttcatttgggtttctatatattgctgattagttcttttatatgccttagtatttagaaagaaaagatcaactggagcgggcacttttctccacttctttcctcgttctctcctgggtacctattaaaactatcaagatgcaagcttttgtataaaagggtaaagggagttcatggaggtggttgactttttaagggatatcaaagcactagggtgggtgttcttagaagggtttgaccaccagaatgtgaaaccctgtttttttcttagggtgggatgaaagcatcctggtgtggattatgagtattataaaatatataaagagggtatcatcccttttttttttcctaaatatacatccctggttggctagccatgatgaacatttgtgttggagaattggtttcggtttaaaaatgaagagtcctttctgtctcatcaacggcttctttgttatgcataaatccctgacccccaaagttatacacttttatatttaaaagcactacagctgatactgccctctttagtaccctggggctggggaatgggttttgaagttatttgatacctaagttttctaacctaaataagtgactataacagtaaagatttcaggcctgataaagaaaggtagggccataactggccaataggaagattttgatgacagtcccctgcaggcaacttaatattgcaatgtgggcaataatgccagagtcttatatgttggtttatccctcttaagtctctgacctaccttccattaaaagtactagacccctgaaacccaggtagaagcaaaccttcagtgacagaaaaatctgatgtctaatcatagctcaagtttttaatgtcttttatcaacccctcatacagctgccaggtaagaaatgctcatattttcaaacccttgggacacaatcatctttaaacttcgtgagttaagaacggttgtgttgtgcgcttgtgcaaattcagagagtctatcatggaatgcattgtgcatgcacttatttatcttcatgtgcatgtttcatttatagtgatgttcagtgttttttaaattcatttcgtatgtattaaaagtttaattttaaaatacatacatatattgtgctctaaaggagacagtgaaatggagtggaggttgcattaatttggggtctgaacacttgctatgctagttctatctctgcgcttgacttgttaggtaactcaaagcaaattacttagatctctcgggcctcagtttttctcatctgtaaaatgatggtagatgatcaaaaagagatattctaatgcatccctgctctaaaaatctatggttttatggtatattattgaagaaatggtttatgagaaaatgactgaatagttgatgaaatacagtttttattttgtacatacaattattaaatccagaaaaaacattcagtttaaacaaggttttaaaatgtgctgcctacctgatatactgctatttggttaataatagatgtggctgagccatttcttttaaatagacaacgtcatttgattaatctgctaaatctaaaccacttagaaagttatatataaattgatacctgaagagaggcagaatccatgataggtagctacataatgattttggaagaccgattcatgttttaactccatacctttgtgttattctaattattggggatgtaaaaaacatttactaggtaatagatgtagctgatcttactggggcttcaaagtttaaaattacctatgtaatattgcaggaaatcccaggtggttttggaagggttgataagtagggaattggtgagtatggaactatgtactatgggggataaaaaagtgtaaagccttgctcctgaatttgaggaatgtgcaacctctttgaggagtctgtacatgtgccaagtgccgacttggaagtgaatacagtaagtgccaaaataaatatccctgtggcctgggtgggctggattgcactggggagtcttataaaaagctgatacttttagctagctgagaacagaacggtttagatgtttgtgttattgtatataaaaaggacagggaagcgttccaggtcttcaagaccacagaattgtaaatggagctgaagatatatcttgtgttcagacatgacatgtgtcaaaatcaaaatgtattgcttacagttcaacctcatactttttctgaacccctttcccctaaatcatatgctgactgtactagaggagatacatgtctttggaagaatttaggaggcagcaagtgagtgaattgagtaattataaagatataatcaggcaggcatttggtcagttacacaaaactccacatgatcactcacagccacaactatgcaagagaaatacataacaggcagaggaaggaaagaggaagactctagcttggagatattctggtattgtgataaaagtggaaagagatcatcatttgggggtatcattaacagatttagaaacgtcagatggtgatggaaatgtccatcagctaatgagaatccgtgtaaccaagatgactttataaagcaaacaatttccttgggcactaagcaagaataacatcagtttctccatcctttaacagccaatattgacaaggttttaacactaagtaaaactgaacatgattatgcaagtctccttcccatatactcttgggaataggttattgatttgggtatgatttattcacactgacgaagaacacttaatttgaaagcctctctgttgctgtagacttgcagaagatttgcggtggatattttgcctcacgtagggaaaactgtttttgtatttcttgccattcgagtctcttccaagttattaccttggccattctaaaagactggaattccacgattagaactgctttgttacctagcccctttaccagattataagaacttagtaagtaaaccaaggactcagtttagatcacccagtgacatggcttctaatttcctattgtgacatcagaattagcttctagaatttgttttctcaggaaatcactttcaaaggctaaatttttctgtttggggatggtgaagtagtatgatcaaaggtagtttaacaaagcaagactactagcgctagtttctaaaaaaaaaaaaaaaaaaagttcaagcagaagttagattatgtttgtttcaagagaaaaatgatgaggatgacaactgttctcctttcttcctcctaagtgtctctggaggtcattttagaaataaagcatcagtcagagctataattcaacaaattcattgagtatgtaatatgggatattccctgttctacgtatgatgcattcatagaattagcatggaaaacaagcacgtgaactagtaactatgatgatagtaatcattttaaaagacatattgtgaccatttttgtagaaaaggataaaggggtgtaattttttttgagccttcacacataactgaataggagttttccaggtggaaggagagggaggaatatctcagaaaagaaacgaaacatccataacattgaggtatataagtattccaggataactgaagctgaaaatgtcagagagggctggaaagatggagaaaagtaaaagatgtgaggttggtgttggacatcaaagaaattcttctgaccatgctgagtttaatgagtagcattgaaaatgatcaggattatctgcatgccagctaagcaaggggtttgggggagactactaaaatgcacgatcctgggccatgttgcaaaaacttcttgaatcaggaatggtagggagtaggttcttggagtctgtaattaactaccccatcccactccccagcacacaacaggtgattcattttcacaccaaagttttagaatccctgcaaggcaacagaactgactcattctgtttctatgttgttagaagcagtttcagagtaaaaaattaaagtatcatgttattaaaagattttgggaaaaatagtttagggtagtataagcatattctcaagaaaattggtttaaattgtggttaagcatgagaactaagaaagatggttattaaatataatcagtgatgctattgaatctccttgaaagtgagacaagaaactgtaaacattcaagagaccatccttcatttttctttgtcatgctccaatacaaggagttaatgaagattgaagctaagttgttctacatcttccaagttgtgccaagataagagataggggcaataatccagagtaacatttgtttggggatggtattcttttgtagggccatttgacttctttaattaagtgaacttccttggaaaaaaaacgtgtatgtcagcattctcatcatgactggaagaaccgaactttcatgcccatgcagtatatgacctatatggtctatgttgaaaatgttaattatgtatgtttaaatcaatagtcacttacaagtgctaaattctttgttgtttgtttttctttttttcgtgaacaacagctgttaccttacacccatcaatctgtgtagaaagttagagaagtggtaaaagacctaaggagagggagatactagaaaggaattttacattttactgagacatgaaaatgagccctggttgagaagaaagtgagtcttagttcacagcaacaaggattgattctaatttagccccctaattgctttgcatacaacgtatcatttccagattgccagaatcttctgtatttattttttttatttgagaatagctttgtttggaagtcgaggattgatggggaaccctatttttaattgttttctgccgttaatttcagtgtcttctcttgggtatagatactgtcactttctagaatcagttgactggtaggaggcagtgcctgccattaagtgaacaaactaaggttgacgacctaaggatatatgtatctatatctaggtatctagatatagatatatgtagttaattttagttcttacagatatctcttgccaatgatctgtggctctgtcattgcccttgttacaccaactaaagcaaatacaaccttgggtggttctaaaaagatgttccaggcaaaattatttacctcaaggcctattcttttacctaaataaatgccaagcagagaacagcaacagctatgtggttttgattgttacagatctgaagaatataagttaaataatgttaaaattataagagtgatattgctattaggtgtgaatttagaaaccaactctcttgtacaattgatgaaactgggcaacattcttaacctccctgggcttttgctttttattagaatagcaatagctactcagagggataattgcccatggtaaatatcaaaatatcaacagttacattaacataaactgaaggattagtatgtgccaggcattgtatgaagcatttaaaatgcactatgaaatatgttttttcaattgtgctctggaggaaatactatcatccccattgaaaatattagaataatgaggttcagaggagttcagaaacttcctggaggtcacaaagtcagtgtttggtacacactagtgcttcaggaagacttctttgatattctccaacagcatggtgtactctttctgtcattttttgtatgacacttaaatgtcattatatttctctcaactagtctgtaagctagttataacagggaatatgtttgaatgctcatttttttccctggttccctgcataatgaacacataatctatgcttaacacattagcttctttatcatcctttcttccattgtagtgagttatcacacccaaaaagtcccaataattgattttgaagtctatcagtcattcatactttcattcatttatttctatgtgaaagcatctgacttcaaatgctagatttcgaaatgcactgtttaactaggatttggggccaaaaatcaagtaattaaatgcaattatttttctagttaacttaatttctttataatttactctgttaaattttcagatatattaaaccctttttaagaaaagattatgccatagaaacctacagaattttttcccaaaaagctgaatgaatcaaattagtaatttattgtaaaaagaaatttgaaagtaacatggttgatttcatttgcccccttatgcaaaggttatgacacacaaattgttatataattatatataaatatgaaatattttaacttaagtctactaaatatttaatgcccactattgtattaaaaatttgtatatagtttcaactacaaatgatgaaacatacaactagagttatttctctctcacatggaatacatctgtctgtagttcagggagagtagagtgaacacagagtcatcaaggactttgacacctcctaactttatggcccatctattctcaagttcatcttttggtctaagatgactgctagtgttccacctttccaattttcatgtaggaagaagaggtgagagggttaaaccaggtgcttcctagctatgttagtaccctctaaggaggcttcctggaaacttccacccctctgcccttcttcagtttccactttcatcaccatacatatggtttgctgcaagagagactggtaaacacaatgttttagctcagcacattgctgctctgattaagattgagatgccactaaataaagagaagggcaaatgaatattagatgagcaaccaagacaggatgctaagaataagaattaaattacccttataagattcaattcgaagtaagcaagaatttggggaatggaaatcaaaatctattcttttttttaattattagactttaagttctggggtacatgtgcagaacgtacaggtttgttacataggtatacatatgccatggtggtttgccgcacccatcaacctgtcatctactttaggtatttctcctaatgctatccctccccgagccccctaccccctgacaggccccagtgtgtgatgttcccttccctgtgtccatgtgttctcattgttcaactcccacttatggtgagaatgtgcggtgtttggttttctgttcttgtgttagtttgctgagaatgatggtttccaacttcatccatgtccctgtaaaggacatgaactcattctttgtttatggctgcatagtattccatggtgtatatgtgccacattttcttaacccattctatcattgatgggcatttgggttggttccaagtctttgctattgtgaacagtgctggaataaacatacgtgtgtgtgtgtctttatagtaaaatgatttataatcctttgggcatttacccagtaatgggatggctaggtcaaatggtatttctagttctagatccttgaagaatcgccacactgtcttccacaatggttgaattagtttatagttccaccaacattgtaaaagctttcctatttctccacatcctctccagcatctgttgtttcctgactttttaatgatcgccattctaactggtgtgagatggtatctcattgtggctttgatttgcatttctctaatgatcagtgatgatgagcattatttcatatgtttgttggctgcataaatgtcttcttttgagaagtgtctgttcatatcctttgcccactttttgatggtttttttcttcttgtaaatttaagttctttgtaggttctgaatattagccctttgtcagatggatagattgcaaaaattttctcccattttgtaggttgcatgttcactctgatgatagtttcctttgctgtgcagaagctcattagtttaattagatcccatttatctattttggcttgtgttgcctttgctttttgtgttttagtcataaagtctttgtccatgcctgtgtcctgaatggtattgcctaggttttcctctagggtttttatgatttttaagtcctacatttaagtctttagtccatcgtctcagccccaaatctccttaagctgataagcaacttcagcaaagtctcagggtacaaaatcaatgtgcaaaaattgcaagcattcctatttaccaataagagacaaacagagagccaagtcatgagtgaactcccattcacaattgctacaaagagaataaaatacctagcaatacaacttgcaagggatataaaggacctcttcaaggagaactacaaaccactgctcaaggaaacaagagaggacacaaacaaatggaaaagcattccatgctcatggataggaaggatcaatattgtgaaaatggccatcatgcccaaggtagtttgtagattcaatgctatccccatcaagctaccattgactttcttcacagaattggaaaaaaaaacactttaaatttcatgtggaaccaaaaaagagcccacatagccaagacaatcctaagcaaaaagaacaaagctggaggcatcacgttacctgacttcaaactactacaaggctacagtaacaaaaacagcatggtactggtaccaaaccagagatatcaaccaatggaacagaacagaggcctcagaaataacaccacacatctacaaccagttttcccaacactatttattaataaatagtgttgggaaaactggctaaccatatgcagaaagctgaagttggatcccttccttacaccttacacaaaacctattcttacaccttatacaaaacctattctttgtagttttttgaaactcaatactcatatttagttgttccgcaaacagtttaaaaggcttttttttctacagtttttagggaattaagataggtaactcctgcctacagcataccagcttttctgggaggtagagggctttgtttcccagtagccttcccttgctgagttatactggcagatagaagctgccaatgaaggctttgagtggcacgatgatccccatcatatgaggaatctgaaaagcactgggaagagttaggcttggggtgcagttcttgcaagtgtatgccctccattgagtggaacaagaactgaatgctgactttcagtagctggctatatgacctgagcaagttgcctcacctctctgagccccattttctcagctgtaaagtgaaaatgatattagtatctacttcattgagttattgttaggattaatggtattgatgtgcaccatacattgagcacagggtccagaatgtaggtgtactaaataaatgagtaggtattttttgttatcttctctccccacaaaagactatatagtcttttggataatattggtgccctccggttcttatatcatgtctaccccaaggaaggtgctggacataacagcagtgagcaaccaacgaatcaaggtctctgctgtcatcaagattgcattcttttgtcactgggagtccttgaggaatcaccgacagagaggggatagttgaaaatacagaagggaataacctcaatagaagtgaaacagtgattgtcacatttcactctgtaaaacgaatctcatgggtagccaaccaaaatggagattcctgaaatccacagttctgaaactcagctctgagaagggatcaggaatctgcattttattcctaaatctttcggatacagatgattcatggatcacacttttaaaaaaacactggtctaggaagtggaggaaagagaaacctataggctatagtgagaatttctccagacagtttaatccctttcctagtcccttttctaggaaaactgggtttgcttcttcaggctggttcagtctagcctcgtttggataattctttactatagggagcttgttgtagttatccactgtaggatgtttaagaacatctttggcttctcccaactagatgcctgtagcaacttttcttctccagtagtgataatcacaaacatctccaaactttgctgaacgtatcctggagtgggtggcaaaattacccctagatgagaaccataggactggttgaaatcttgacctttcacctaggataaacatactgctttaaatggagcctttcaagtcttccctctggaagggtggaagatggcagataagatagttccagatttagctgccaacctcgtttccagccaggtgtcagtgggtggaggtacacttctctaaaagtcaggcccctgagagcccaccacagtaatcctctagacataacctttctacaaagtacagaggtctagatctacctctttgcctggttatccccaaatcttcctgtcttagagcttatgtatttctattcccaacggtaattaagggtttcagtgaaaatattgtctgaaataaaagtttaaacaaggtaaaatggctttcacttcttactttttacaaacaagagtattgaagttaaaacaattgttttcctaccgcttttttagaaaaccttttcatatgtcattacatatttacctagtctctctgtctctctgtacattttaaaatttttgctcatgcctgtaatcccagcactttgggaggccgaggcgggtggatcacaaactcaagagatcaagaccatactggccaacatggtaaaaccccgtctctactaaaaataaaaaaattagctgggcatggtggggcatgcctgtaatcccagctacttgggagactgaggcaggagaatcgcttgaacccaagaggtggaggttgcagtgagccgagattgcgccgctacactccagcctggcaacggagcaagactccgtctcaaaaataaataaataaaaataaatagttaaaataaaatttttacatggtgagagaatgagtaactacattttaaaaaataagaaaaaactaaagtgatagttaaaataatcattttaataatgttaagaacataaggctaaggatccccttgagattcaaattgcttctgtgtttgttaatatatattatgatgatgagtaactctgccatgttgaaattagtgctgggtgagcccttcaaaccaagcaagttgtaggtagaagctgaagaagttgcatggcttagcattcgttttttaaaagaaaattggagaactgtaacaggcagtgacttcagatgtaacagaaatcatgctttctttcaaagatataccttcggtataattgaagaatttttcctggcattttttaatgtatcagataaaggaataatgatgcaacctttacatcttgtaataaatatggaggtgatttaactttgtcaaaggctagattcacagggactctaagatagcaattgtgccatgaggaaactttcatcttaatattaagcatgatttttagtaggtacaagatactgtatcataccatctccagccctttaatgtttatctttgttccttggttaaaagttgtcatcttattggaagttaaaggtagtacttttttttcaaagaagttttccaattgcatgaacttgaggctttctttcaaagaaaccactaatttttttttttttttttttagcaacactattatgcatttccagtccgctgaggattcgattcctttaatctgttgttttgaaagtttcttgtataactcagcctcgttgcaagggaacagacaatatgttgtccatccatggaggctctttgttggaccaaagagatgatatttccagttttagattgaagggaaccctttggcgcttttgctgaattttccctgaagtacattcactccaggagaaacagactagaaggttccaattaggccaagccctggcaggcacctatatggagaagtatcctggcttattaggagaaccaccttaaatgccctttatttcatcttttatttaaaggcagttggaactgtggtatattgataaatgcactatacctgaggatacaggtcatgcgcttgaatccctggtaattgtctattagctagcaagttcttcctccctaagcctcagtttcctatctgtagaatgatgcgcctaaagtgatgtagtactttttgttgttgttgttgttgagaattaagtgatagtagcatataggagagatctaattggttgggagggtcaatatgttttgaatctggaaaaaaaataaagtatattaaccaatagagaagtactaatcaacttttattgattattaaattgatgcataagaccacctgactgataaataattgatgttcaggggcagcctgcaccaaggaaacataagagaatccttcacagaacagaccatccataatctccatttgtacagcgaatcccagcatgatttatgtggttctagccttagtggagaacataccagcataccagtaaaggtgggcaagaagctacttattcataaagactcagaaatctagctatggcaacatgaccccccccaccccaacacacacacacacacacagtcttggaggacaatgcagtaaataagtaactaaagatttgattccagaataaatggcaaccagatttaaggtggaatcaccaaggacaggctcatcaatgagctgacagctcctattgtaagaatggtctaccttcagtttttggttgaatttctttgtctttttgtgctgcactccaaagccaaatttgagggccccaagcatgtttcctgtgttctatagtttggaaactgtatttcctgaccattctctgtaactggaaaaaaataagatcgtaactaggctaccccacgagtacttcaggtagaagaagaaaacttcttttagaagtacttttctcttgttttgctagggcttatcatgccctcatgctatgctggtcatctgttggaataccctctcctgtggagccaagaccctgggactgaggcaccgaggagttctaataaattaaaatgaagatcccaaaagaacttcccaaaggtacccagaggtgatgtaataatcttttatagtcacagacttctctaaaatttaacaagtattttattttctcacttggacctcagaataactcacaaaagtatattgttattaacccccttttacagttgaaaaaataaatagaaactcaaagagattacagagtgtccaaactttcacagccagtaagtgggacagccaagacttagagccagtttctctaatgtattatcttgtgctttgtgcagtgtaaggatggtgctggtatctctgtgctctgtagactagtggttgaacaagaaatacagggaatagcatgtttcagatggtatagatgataacaggtaatatgtattaggttcttataaattatattatcagcctcacatcatttcgtggtgtgtgctgcatgacacattaaaagattatgttttaaaagtttttaaattttttgataaataagtggtatataacgtttagggataaggagaattagaagttgtatttaattgtatttaatcaagttttctgtgaacatgtagacagcttttttggctgctggcaagaaaatgaaaaagtggaagatgatgttccctgcaatttgactaattcatatctcaggtgaatcctgatggcaagattgggagtttgtacaacttttctccccttatggcttaaggaagttcacctcatgactgcttcgtcacatgactcacgcttgtgaacagttaaaacacatcataaggcatgtttccctccacataaatggcatcaatagccaggaataaagacttagggcaggaaaagcctatggtagatctgcctggtcaaagaagactgcatgttctacccagaaatgaattttatgagccttcaagtagaccaaaaaaagttaacttttctctatttcggttttctcatatataaagcagcaatgatggtattcaacttgtacatgttatgaagattaatttattaaggcaccagcactatacctagcaaacataattctgtgcctcttagatgctggtgctattaatggaggagatggtttttaaattgtggctgtcttttgagcaaagactgatcttgaaatgcttacatgcaaggtacagtaagaggaagaagacatagatacgtattgcaatttggctgaagtttactttctcttttatttctccaaattttactctcctgacaatctcatgtatttgcaagaatgaataggtagtaagaatggatactgaactaggcattgtgccctagctttgtgtctttggacaagcctttcacgtcctatttccccacccataaaattacaatgcttcaacatctcggcaaatatttatggaggactcatatgctaggcactgttttagatgtttgggatataatgggaggtggtgaacaagaaacataaaaatatgagtatataagaatattaaaatagagaaagaatggcaaattaaggcatgaggatggaaatggagctgcaatttgaaaagtatggcttgggtagttttcaccaagatgctgatatttggataaagttcagatggatgtgagggagcaagccttacaggtatctcaggtggggaagagttttctaggcagaagaaatagtaagcgctaaggccttacattgcaaacatgactggtctttctgagcagtaaacaagaaaccagtatttaggaattgagttaatgagagcaaaatcagaagtattgggccccatgtgaagaccattttgatagatttggatttaactcagtctgtgattgggaagccactcaaggttgttgataagataagtgatattgagttcatgtaacaggatcgttctggcttccatttgagaataaacggggtaaagggtgggaagcaaggaaactagttaggggaagcttttgtaacaagccagtaagaggttctgagaagttggccaagtggataagagtgaagaagatgaaaagagatcaagtaatagatatgttttgaaaatattgctgacaggacatgatggcagattagatgttgagttggagaaaacaggtatagcataagattctgggtgtttaaccaaagcattgggaagaactgtgttgccaataactgagatgaagaggcatgcacgagggtcaggttaggggcaagggtggagttaatcatagagctctcactgtctctggaaggttgggaacagtctacaagaaaaggcttacggatgcttagatcattctcttcatgtcaagaggtggtctttgtgaagataactcttgcaagaacctgaagtataatttagatggaagatagataatagaatggttacaactcattgttaaaagtaataggaaacccctacctgcatctgtgatcgtgtacacagtaatcatttgaaaattatttgaatgtgtgttaatgttagtggtggatttacagctcacaatggaaaaagcagtgaccaggaaaaaagaaaatgatttggagggcattattctgtgtcaactcaaaaaatattttaaagaagacagaaaaagttcaattattaaaaacccatggatcgactgctcaaatttaaaactaatttagttaaaattactgatttttaaactattatactaaagacctcttatgagcccttaaatgatgatagcatttcctcttaattctaatttctgtaatgaaaaaagagttgaaattttaggttaatgtagtgaattattttatatagctacatatgtgtctaacattttacttcaattttctgtgctatagttaagagctcattcgttatgaattatgtgaggagaaattatattagaggtagaagtgatattaatatactcttaattggagcaatgattgcacaggtgacatgagtcaaatcatagccctctcctgtgcagttctgttagttagaaggcccacactggatatggtaaatggttttatgatgattgctaactctcatcaattgctagtgtttgactgagctatgtgttgagaagaatgctgagaccatggctaggatcagtaggaaaaaaggacctgattgattgggcatatctgttaaggataccaatgaagaaatggcagtaaatgtgtcacacactaatcatccttgttttattggttctagaaagggcttagagtattgacaagtatgggttgtcttaaggatgcccattgctttttttttttttttttttgatatatatcttcttgccttttcctggcttttacacccattagcccaggcactgtccttttcaataaccttggatttgttctttggaaggtcttttcatataacctgccatttgctactttatttggttagtaaatgtgtgcagagcaggaccaaaggcagcaagattgttgtacttatgttctggaaagctagttggatgagattttcaagtaatcctaaagaatatgtagattcgaaactgggaatttattggtagacttagatgctgagataaggtcagtcttagttagagatggcaggtgctggcttcagtggtttaagaccgaataaaagattaaaaattatgcatttataacccactttgtagcaaaatacagttaaagatttaggaaacagtgctagggaacccaagtgtttgtgttttgaaggagataaacacagagctttgggagatttggccttcagtgtttggtaggcacttccaaacaagaagggggctcccttttaggggtagtgagggatctcagctggggtctaacagtgtatacctgagaatcgaatgaggtaaggtggtgtcatcctttaccaggtaacaccatttggtttttaatatgagatatttataaatgatattcttaaccaaaatgaatagctggaatttggggaatttaaggtccttgaagtggtcgtataaaatattttatatagactatttattttgatgcttcccaaattacatgtttaaacatcagcttcccaggctagattgcctttcctccaccttctagtagagccaccttgactctctattatcagtattccttaccaagtcctaaatgttcttagatattttaggtgtcacatttttacataaaattcctatgttttcttgcactcagtcttgactacccctttattccatctaaaggattcagtagtgctagaaaagatacataagtgttggtattttcctattcccctcatgaacttctccattccttatccctaaaactgtaatattcaggcactgagaccaagccaagatggtggtagcttcagtaagaagagagtttaaaaaaatctaaaatgctgaatgggggaaactttgaaaggaaaagaaggatgaagatgtaggaaaagagaaacataaattttttaagaccatgtttggactcacctggtgatttaaggaaagatgggtcataataataataaaagctgagatgtattaagggcttaccatgtgccaggcactcaacttcagtggcattatctcatttaatgctttataatactagaaagtgctattttcatttttaattttaaagaacttttatgaggtagaggtaagtttagtggttgttcaagatcgtgtagttagtgatccatccagtcaaggtttgaactcaggctttaagtctagagtccaggtttccctcagtaggagagatgaaaacatgcatgtaagaatgaattaccagtgacagagagtgcacaggagaggaagaaagaggtggggaagaggtgatcacaggaacaaaaggggctggggtcccaaggagaggcagcaaacattcactgggaacggaatctctctgctctctcctcatcctggacctcggtagcaacagagcctttgactagttatttccatacacctgatgaggagaggatcacaggctgcatgggtgtttacttcccccaacatatgaataatgccacattagaacatagctcctagggcttagatgagaagagaagtgaaagaatgaggaaggatcgttccagatcttcagattttgctaattttccaggcatagtactccaccaacctgcacccaaaccgcagcctttgactcttctagtctacttttctctcagtgattatgcattgcatgctggagggtaggagccattttgcaagttattaaatggccttcagtacttagcagcagataccatgttcatacaaggttaggcagttcagaaagggtggggtcatttagtgactttgatccattttatgaaaacatatttctcatgggttcctagataattgttcctcttacatttgtcttctggtcatgatgatatcacctagggagggagaagggtagaaatagagggatcaaaggtagtgatgctctgctagctggctctcctatcggtaaggcaaaaaggaggcttagctccttgcataattatttatgagacataaaccttgggtggtcaagacatgctgatgcacagaatcagagacaagatcaacagttaatgccttatgtattcatgtgacataaggactgtctgcccaagaatatttcccaattatggggggggtgcctgaaagcccattggctcttctctttgttgcataattcctcatgatttttttgttacatggaaaccaataacttagaggaggtctctggcaggagatcctgaagggttgggataagcgagggtgctgaaaggaaggcaaggaaagagtaagtataggaaaagaaggtggggactacctggataaacaggtggccctgttccgaactttccaagggccaacctgtcagtactcccacttatctttgagatttccatgttagaaagaatgccttgtttcgggttgagcaaaaactgtttcacctttattggtgagaaaaaaaatggctctaagccatatttaggaaatttgttgactataattaagatttcatgggcgtccccaaggtttacttacccataattgaaaaaatgcaaatgaagacagttaatcagtggactggccgactatgaagcactactacctatgtaaatgaattaaaaatgaagacacaaaatatgtccagttgagaaagttaccaaagagccaagtggtaaatttctcagcaaggctgtggagaattttttcttagcctgacagcctgcagtgccttcctgccaaggtctttgccaatttaatcttgagccattccatacagatttcctcacaactggccttcagcactggctggttctctggcattacttaaggaagccctgaagaaaagataacagacctctttgtcctcttttctgtgtaattgatccactacttagagctgtaaaatatttgctttacaagatcctgttatcaaatggaatttgaaactctttaggagttatcgcacagaatttcacttatcagggatcagtatgtgttgtaatattaactcttttaatgtggttttgtttgttttgagacacagtctgtttctgtcacccagggtggagtgcagtggctccatctcagctcactacaacctccgcctcctgggttcaagtgattctcctgcctcagcctccccagtagttgggattacaggcacctgccaccacgccaggctaatttttgtatttttggtagagatggggtttcaccatgttggccagactggtctcgatctcctgacctcaagtgatccgcccacctcggcctcctaaaatgctgggattataggcatgaaccaccatgcccagccttgatgtgtgtgtgtgtgtgtgtgtgtgtgtgtctgtgtttttaacaataaatacaacatatctgtgatggtcacttttacctctaacaccatccttccttgttaaaatatgcaaccaatttttatcacctgatttaaaatcatccccaaaatgttttgcatttctgttaatacttaaatcttctccttaatgatttcattaattagcaactcataatatggtattagtacaaaaaagtgcacaatatgtctgtaaaatcagctgtggaaataaaagcataaatgcaacatcctttagataaaaatatttgtcggccgggcgcggtggctcacgcctgtaattccagcactttgggaggtcgaggtgggcagatcatgaggtcaggagttcaagaccagcctgaccaacatggtgaaacccccatctctactaaaaatacacaaattagccaggcgtggtggcacacatctgtaatcccagctactcaggaggctgaggtaggagaatcgcttgaacccggtaggcggaggttgcagtgagccgagattgtgccactgcactccagcctgggtgacagcgagataacatctcaaaaaaaaacaaaaaaacaaaaaagtcagtatcagacaatatttgatagctaacaaacaatagaaatcaaacaattcaaatacagaagtcgtgatacaatggatgatatatctgtgccataaacagaatcaagtttttttggacaaccctgttaaaatgtctgctcttgggaggtaaataagtttcctttcccacactacttagcagattctgaaggagcaaggtgcctgagtgattaataatgcctgccctggacactatggatgagaatttgtttgatgagaaagagtgagtagactccaacacagaaatgagagcttgctatcaaggaaatgtctttctgtgaacatataaacattctgagataacttaagtgggaaaagatgtgattaggctgaaccttttcaccatgtctttgtttgcttgagttatttattaccctggactttctagaggtttttaaaaagtgttattgatatagactctggaaaatgtacgcaggtatttcaagatatttcaaacatgtcacagtttctaaggacatcaaatagctcttcaaagcctcatggatttttaaaacatgaaatgttcttcttggaggataataggctccaatgctctgggtttctaacctctaattcattaacagcaaagctgacttgtagcaaaatttttttttccttgcaagcaatatgtgactcctttgagggagataacagtttaaatataaataaatgaccagctccagtggaaagattccagtttccttgaggtgtttgctttcaatttattgccaattctcccatcaaaatttcctaccctgaaaacctactctaggtctgaacatgtttagaacaacccccttaaaatcgttcttgttcttatatgttaaagctatgctattcccattttaaaatattgcaaaaggctaaagtggactttacacatatttagggaaatattttagcattatcaaactcattagtgttattggctctgacttacaaaaatgaaaataaaatagcaaggcccaaatggaactggttccttcttccaggcatttctaagccatttgaagtaatcaaagcaaacacctcagttcttttatttcaaaatcaccttccagatggatttggcttattttattctatttagcttagccagcggtcccatgacatttgcattatttttaatccaatgacagattgctttgtgatttggattttcatgaactgccatttatgtgtcattaatttttgttagtagatgatcagcttttttgaaaaaagacatacaatgtgaaaattgatctctctctccatgcatattgtaaatatatgaattcagaacacacagtcaaatcctaattctcttctttaatcgtatgcccggcctccacaagttaacattctaagacatttactatgtcatgtcatctgcaatgtgtcccctacttgttttatattatttttcacttttgacaatactattatttgtttttaaagcaagctgttacaaaatagcatttattttatttctatcttacctcaggaagttcaccattctgaagggtaaaagattgctaattacttaactattccctacttaaccaaggaaggttattttctattcaagtaaaatacttgttgatgacgttatatcttagattattaaaaatatcttagattattaaaaggatattaatattgattttaaaggtcttattctgagaaattttttggtaaatttattgaacttttgtgtatggatttaatctttgtaaaaacagtaaggaatatgaaaggacaaaatcaaacatgttatacacctacagtatgcagaacatcaccctacatgaaacaattgggaagatcaatataagcaaaacatgatttttttaatatttactcccataaatacaactggacctctgataaatcacctagatgtaacatacacacctcaaactcggtatgtccaaagttatactcagcattgtagcacttcaacatcctttatatttccgcaatctaggttgagagcattgatgtatactaagttggactagttaggtatttgagaattgtccttcctcgtcactgttaaccattcagtcaccaacaacctcttattaaagagtgtttagatatcatgcccacaatgaagctgtttcccttctcctatccctacttgactcaaggtaaattgctattccttttgttcatttagcatctcgcatcctactaaaacactgtcatacagtgttaaaacctttagtttgtgtctatttttctcattgtattgtgagctcttgtgtttcagtgcttatgtctatttgtgtttctatacccaacacttaagcacagtagttggcagaaagtattcagtaggtgtctgaagaaatacttggatgatgtgtagatggaaaaatgtagggatagactggaggataaaaagtcagtgataattcaacatttcaagaggtgtagttgcactttcctttgaaagaatgtggttgacttctgcagtcgaattctgtttctgttgaaactgaacacctgttgcagcataagtcctgtttgaatgaagtagcatgcagctaaggacataggctttcagaaatattcagttgataacataagctgtagcaagagtcatttcaaatacttattacgatgttcttcagctttggtgatataaggaattaggctgcacaaatattgataaatggaagaatcacaattcagataagtctttgctccagtctttctgcccattcaaaacacaaaatgaggagagtatagggaacagaaatcttttagaagttgagtggtattaagaagagtaggaatagaggcaggggaaaaaaagacaatgtcctatagaaaggcctataaaacagctctcctgcccctatttgcttttcatggactgtaatagcacaagatgggaggaaacatctgttttcttttaaacatagtattttgatgttttaagagaatcataataattagcagaagtctaatttcctgtggttagggacagcagatacctatgggatggaatagggagaatgagtgtagcagatcttggtagattttgagggctgaggattcatctgctctggatggctctgggaaatagcatggaggaatggtaagatcatgggctcagtggttagatggcctgggtttacatcttggcttcaccacatgttagcagtgtgataatgggcaagctatatgcttctaagtctcaattggtcaagccttgtctcagggctggttgtgagatagaatgaaataaacgaaactcagggaactagttcagaaaacagcacatggtctaatttgttaaatgtatgcccttgtttttaaactagctgaaaataagcagtttctcttaggttagatacaggaacttaatgggatatcctataggaatataaaaggcccttaaccaggaaaagatggatatgtctttctgctgaaaaggcctgtcactgtaattcaggtcagcttgaggaagggctgagaggtggttgatttttgaggccattttaaaactagcaagactggaccaggtaaaggattagatgactaataagagtagctgagccctgcctagtataaatgtgcttcagaataatggagcaaatccaagacaaattagcagagatcagtttccagtgtctatttatttccataagggtgactcaaggccaggaagaacaaggaagggctgagctctgggcagcaacatacctgaggccagaggctatagtcagcaaggatttgggctatgaggatgagactaagaatcacagattgtgagagatgaagcacttatcagacatagccatgatgttaaaaggatgttgccaggtttaggggacaggcttccagcctgttcattagtagaaaagagttcattttggataggcaataactaaaaaacaagacctgagagatcaagtgatgcttcgggggaacattgctccatggtggggttcagatgagtgggccttggagagagatagtagtggtcctaatccctactttgccaatgactgcagggacaacaacttacgttacctccctaagcttcaacttcctcacttattaaatggggagtaataatcattcctacttcgagaatttttgaaaattaaatcacacaattaaaaggactcaatgtcaggcgtctagtaagtgctcactgaattttgattattatgaaaacttatacgtattcacttacctatcttgttgaaaacgccatcattacaataagtcacaaaagagaatgcaactatgttaaataaatgttcctaaacttggtatttaaaaactgttgccatgcagctttattctaatatcttttctttaggaagtgaagttttagccaaccttgccaattggaaaacagagttttggcaccatcttggaaaggcataaagaaacccatttttaaattggaaagaattgtgattgtgctgataatgatctaaatcatgaaagtgcatctacagaaaagggcaaaatgtaacctttggaaattcaactttttttaaaagtcaaattttgtattaactttaaattgggcttattgtttgtggaaatatttgttccagttcagttggctggatctctcacctcctcactttaccttgctgcaaattcaagatctgccttagcaggtggcttgaataaaattcttggctttatatttcaaagctatctcactctcaaacagtgtattaggtttatttacaggattcctgcatcaggtttgaaaggcaaaggggttctgaagaagagacaggctctcatatttttgctgcagaattaaacaccatctatttgaaaatggaatctgtggtaaaaatctccaaatttacttgtaatcccttctcttcagatcagctcaattctcccaagactcactctttggggaccatttaataatacaagagcaatatcatcttgttctatttctactaattctgttgcccaaagcaaatcaatgaaacgtccctgtcatattttaccctttatttactcatagcatgcgatagaattaactaattttatgaattaacattactcatttttgaaacctgacagacttacagagaactgtgcattggccaaaggtgttaggtatttagcttctaaagaaactgtgacttatctgttcctgattgttcccaacattttgctgtctcatctctgtccttcattatttacacttctacctgggggtaagatgggaaagacgaaaaagtaaaattcatgtgagataactggctatgatattaccaaacttgtgtatgacggaagtcctgaaatcactggataaagtaaaccatcaagacagtctttaggtttcattaatccagtggttctcaaactttggcaagtatcagaacctcctggatggctagctagttaaaacaaagattgcaaggttttgattcagtaagttttggattgggcctgataaatgcgatttctaacagattcccgggtgatgctgatgctgttgcacctcagggactaggctttgagaatcaccccactaattcatgcttggcttctctcctgttaacatgaataacctagagtttgcttttccttagctatctttagaaatttgggctgtataaacgaaagagtatggggttcagcagtgattttggtatacgtgcattttgtatggcataatagaagtgatcaagtaagtgggttactccatccatttggttgagttaattcacaaagcaattatataaaacatcttccattgttttccccaatggtcagactacaagcttttctggtgatggaaaaattgagctcatttgattgacatttttaaaaacacagcgcaacattaatttagcttaaataagggatatggaacaaaaagcagccaaaggaacagtatcacagttgtgttagatacaacttctgataacctcaatactgcgtgggacatattttgttaataagaaatgatacgaagctaaagtgaatgccagtcacgtcagatggaagaaccataagatctacagtctctcagtttaaacactttcttagtcacctagcccccagaaggcttaatgcagctacagttcatgaagttcatgaattacaggctacacaacaaataatctctccaactaggaacagcatacttaagaacatctttgcttccttcagttaactgtaattgatatatctcattagttgatgttacaagaagtttgatgaaagatcagactatgctcaaacatccctgaggctggaatgatatttgcagttcagctgttaattcttttctttcactagctcacatgtagactcctggctgatggagagtctaggaaatgcatttttgagcctcaccaatcctgagctcaggatatagaaatagtgtatagataaataggtacttccattggttgggctataacattgagacataaccccagcatctgtgatgcaggcagtgaagcaagaaggttgaagaagatattgaatgatctagtatacagtacataccacactaactacttaaagacagaaaaaaggtaacccaaaatattcctggcctaaaagtctggtgatgggcctctaaacctattctcaagttgtgacttgtcttggcatttttaaaagccatcctatccaacaaggtgacagtacagatgagtagtatctttaaagactaaaacctgtgctagttactggacctctgcatgtatcagctctctcattctaaaagggcatgacgataatgcctatattatagagttgttaacaagagctaagtgggaaaatacaaatttctcataatagtatttggcacatagtaaatactgaatatttcattaatgcatggatgagaaggtctcactgaatgctatgagatcctgacataagtatcagtatttatataggaggtatactgaggacctgttaatagttaaattgatactccaagctcaattaacacctcatagaagcaagaacacccatggattgttcttctgcctaaatgactgtatcctcaccaaccctgagctcaagatacagaaatagcctatagatagatacttccatttcttgggccataaaattgagaggtaaccccttataactttttttctttagtgtctgccaaatgcttgtccaacatttgagtaaatgtcaccattgctaattaccctaatgtaataatatgagatgttctactttggaaaacttttgttaccttggaattcctacctgctaagatgagggctttgccattagctgtattgagattttaaaaaccttaacttgtgataatttgctccttttcagcaatactatttatttgcacaaggaaaacattattttaaccgtgaaagtacatcaccattttgtgaatttggggcctccattaacccacatgtatctcattcttttcctactctagctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttcttttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcattaaaaaaatgcattatgttttggtttttagagattagtaataaaattttagagattagtaataataaaatagatgatatccaaataattgtcatttttagagttcacatatttattttgtggtttgtttttccacttgttttcattcactttcatactgcattgaaaatgacagtctttctttgtaatagaagagccaattaatttaaaaatattttactcattttagactttttccttttaagtaagttggaaaaacaggacctctgtcccattattaaaaagtggtgatagtatttcaactatgaactgagaaatggagaaaaagtccccaaatagtcacctgaattctccaaactcctctcattggaatgattgctacaagttatcacattaccatgtctccaaaaggcttctagtaaatatgcatgtttctttcttagcaaagaagtgatgataacacaatgggagtcatgaacacctaagcttatgtgcaagatcccaaagggaaggagctataagggagttgtggaaggagaaaaagcttaatctaaaatcttatttagaaatgattcttctcaaacccctgcttactactactggaaaataacaccaccaagactgagaacatttcagtagaggagacaccacggaagccgtacactgattttcaacactaatcattagatcacagataactaactagcctgcttcattaatttgcataaacattcagagggtgccactgacacacactcacagatatttaaggaaggccttaactgagccaggttctaggctgagcgcaccactagttaaatgtatgggtgacttttctgttagcacataaccatgacataacaagaaaccagcatgccatttttgcccaatgacctgaaaacaaagaaagacagcttgttcttggcagcatatttttgatctaaggaatctgagtttctcccaaacagcaataaaaatacccttttgagaagtttttcctgacaagagccactcattctgtttttctcctccctaacagatgcttagagaaatggaaagatctctttagcctccccttcttcacaggatctagggaaataatagaaatattaaggggttaaagacaggaaagaaaagtacatcaacctagtgatgatgatcctatagaaagaaagagtcaacacaatgccattcagaagtccccaaggaaatgtaattagcataattaactttctggattcatacattattatttattgggtcaaatattttgcagaccagccaagaagcttttgaattttaaaagtttcttggcaaatcctgaaaaattgccagtaggtatcagaggaatatatagagaatgcccttgactttgacctataaaacattaaatgtttcaatgcacgcttatgaacagtgtttatgtgtgtgtgtgtgttgatttcagtgcttactgagtaagcatcatcactatcctttccatcattgcttttgtgatcaaggaaaacagtaactattcagaaagataaatatagacacttagttgaaaccattaaagcaataaagaagttggtaaatttcttgtcctcaagaaaaatacagtctaattgagaacatattacatagacaaaaaaaatgtgccaagaaatcgtactcaaaagtaccaaatgaatatggtagagaaattactgtgtggtgctagtgaagtcaaacccattgaagactaaagtagctgggtaagaataatgcaagaagcaggacttggaaatgagaaaataaatacattctgaatgaatgaaaattataaatcagcaaatttggcaagaggggtgatggttggacattcaaggaagaacagcttactttaaatatgtgaagacaagtgtagtcagagggaacacaggatttatcaaggggattaaggggtataaatgtggagatgagatgtagtttgaaactaaactatggaggtcataaaggagggtgaccattacccaataggaaaggtggagtttttaagtgggatgatgacactgaaattaatgatgtgtggggagatgagagctgaaaggggctgagagttagaagaggcatatatgatagaaacgtcagaatgactttcagtgacttcttgaataactatatatggggaaagaattattacagtatatgctttcttcaaggagattaaagaatagaaaataggaataattaaaaagtgatattttaagatgggctggaagggtatatttgaggaacatagaatcctaagcaaatacttgtgggtattttctaaagaagcatttttggctgcagcaggatggatcctcctgatgggaggaaactaaataaatctgtttcctatgcccgctattctaagatggatgttttggaagccaaaactgttatattcttctaaggacacaaagtatccaggaaatcataagagatctacagaagatttatagttttttttccattaagtattgaaaaccatgaagtcaacttgattcttagaagtcaaccctgtaagcaattggttatgatttgggctcatggggaaatagactatacaaatgccatcatgatggtcatcaattttggggcattagttatgtataggacaccttttattcactcgaggcataaagatctataaaataaggtgtatagcagaatacctaagctaaataagcataccaaaatattgtcattcaaattgataaattataactcctaaatgtgctggtcataggtcataagtgatttgacttttattgctgtgtcatcacacattaatccaattaaaaaggccagtgcttactcttgaagattgtggcatcatttagaggtaatgagagggaaaaaaaattatagaaaaatgtcagtaaaaatatactagagtagtggagtaatatcagaaagatggtggactaggaagctccaggtccttgttccttcatggaaacacaaagtaaacaacatattaaccacaatagctttatggaaactttagaaacagttaaggatttgcagcaaccaagataatgtccatcaagagaaagccacactcaacatggtaggaaatttggggtcatttctgctcacttgtgcccccacccctccctggcatgttcaggagggaagccactcaattcctcgtgttatagaagagaccaggttcttgtcacacgaccaggaaaatttaggcacatggacacattgtagggtgagtagggcagagtgcactgggtgaaaaaaaaggcaagagcaactcagcaaagccagagagagtcctgctagcaggtttcctgcctcactgattgaatcccaggtcacatagtaacaggcaaggccacgctcctcccccatgcaaagggcacgaattccgaggctccaccccatcctcccagtgtgcaggtgggcattattcagaaagaattagttgagaaagtgtgggtgtcatccacaaccagcagtccagtgttttcagctttcaggctgttttaggcttgaaatcagggtttctccagggacccttggctgtctcctgtctctatcatgagttcctcctttacaatggaagaaaaagagtagaacttctcccttgttttgtggcttcctagaggaatagtttctttctcccctaactcagagagtaattgggaatgatgatatagtttgaaaatcaggtttcaggccactgaaagccgcaataggcacaacaacacattaaagctttggggaattcaagacctatggggtcctggaggcaacagagtagaggccgaggaatacaatagaagacttaaggtcctgaaaagaatcagaagtaaggctcttaaggaaaataggatatataaaagcagctgtgtataccgggacttgggagaaggaagaagaacacacagaggctcagtaaatacatatgtttagaaatgacctgaaaaggcataagatttcacaccatgctgatgagtgaatgtcttcccttggatgagccaatccacaaaattggcataggtagctgttttttcaaatgttcaagtatatgtgtctacaagagactcactttggatttaagaactgcattagattgaaagtgaaataataagaaagatattccataaaaatagtaaccgaaagggaacagaggtggctatatgaatatctgacaaaatggactttaagtcaaaactgttacaaaagataaataagggctctatataataaaagtgtccctgcaccaagaaaatgtcatcataataagaacaagtgcacttgttctcactcacatgcaaaagctaaaagagatgacctcatagaagttgagagtagaatagtggttactagaggctagtaacggtaggtaggaaagaaggagaataaggaaggattggttaaaggatacaaaattacagctagatagaagaaataagttctagtgttttacagcactgtagagtgactatggtcaataataatttattatatattttcaaagtttgaagaatctcttcaacttatatattgtgttcccaacacaaatataagtgtttgaaatgatggatatgctgattaccttgatttgatcactatgcattgtatgtatcaaaagtcattatgcacctaatatgtacactatgtatcaacttataaaaaatatatgcatcaagcaccagagcacttaaatatatgaagtaaacactgacccaattaaaggaagaaatagataattctagaataatagtataagacttcaatactacaccttcaagaatagacagaacaaccagactgaagagtaataaggagttagaggacttgaactacactatagaccaattggacccaacagacatatacagaacaacccaccaacaatagcagatcacatacttttctcaagtgcacatgggttgttttccaagttagaccatatattaggtcacaaagttagtcttaataaacttttaaatgttaaaattatacaaattatatttttcaatcataatggattgaaactagaaatcaaaagcaaatggaacacaggaaaatccacaaattccacatggaagttaagcaacacactcttaaacagtgggtcaaggaaaaaaattttcaaaaaattagaaaaatcttaaggcaataaaagcaaaatataccaaaacttatgggataaagtgaaaacagtgctaaaagggaaaattatagccacaggtgcttacattaaaaaggaagaaagtctcaaaaatctgaatttctatctcaaagaggcagaaaacaattaaaaactaaacccaaagctagcagaaggaaaatgtaaaggttaattttatgtgttaactttaatgggctaaaggatgtccagatagctggtaaaatattatttcttccaatgtctatgagagtgtgtccagatgagattagcatttgaattgatagactaaataaaaaagattgtcctcaccaaatttgggggacatcatggaatccattgagagaccaaatggaacacaaaggcagaagagcacattcaccttctttacttgagctaagttatttaattttttctttatacatttgtgctcctggttctttggccttcagactcagactgggatttaaaccattgactcccttgttctcaagccataacaaacttgggctggaactatacaactggctgtcccgggtctccagcttgcagatggcagatcatgagacttatagctcataatttctcataataaatgttttcttttgttttttcttctttctttctttttctttcttccttcctttctttctttctttctgtctttctttctttctttctttctctctctctttctctttgtctctcttttactttctttctattggctttattctgtctggagaaccctgactgatacagaaaaagaaaataaaaattaagacagagataaacaattaaaggtaatagaaaaaacaataaagaaaaatcaacaaaattcaaagttggttcttaaaaaaaatcaacaaaatgtataaatgtctggcaagattgactaagaaaaaagggagatgactcaaatcactaaaattataaatgaaaggaaatattcctatcaattttacagaagtaaaaaatcataaatatgccttgaacaaatatataccaatgaattggaaacctagatgaaattgataaattccagaaactcgtaaactaacaacactgaatatcgaagaaatctgagcagattttaaactagtaaggagattgaatcagtaatcaaaatctcaacaacagaaaaagactaagtcctagaagtcttcattagtgaattctacaaatcatttatttaataaagacttaactttaatattcctcaaactcttccaaaaagtttaaaattccaactaattcaattagactatcactaccctgataatcaagccagccaaagatactataagaaaactatagactaatatccgtggtaagtactaattcaaaaatccttagtaaaataccaggaaacagaatacaatagcacattaacaggattacacaccatggccaagtgtaattttttgctggaatgcaaggatggttcaacatcttaaaatcaagcaatgtaaatacaacattaacagaatgaagaaaacatcacatgatgatctgaattcatgaataaaagtatttgacaaaattcaacacctttttataatcaaaaacattttgagcaaactataaatagaaggaaattacatcaaaataataaatatcatatatgaacatcccatagctgacattatagttaatggtcaaagacaagacttttcatctgagattaataacaagacaagggcactcactctcaccatttcttttcaacactgtactagatattctagccaaagcaattaagaaataaaagaagaaaattctaattgaaaagaaagaagtaaaattaactgcagacaatataatagaaaattctaaagatttcacaaactgttagaaccaataaacaaatgtaggaaagttacagaacacaagatcaacatacaaaagtcagttgtttctagacactaacaataaacaatttagaggagcatcagaaagaatacttagaaataaacttaaccaaggaagtgaaagacttgcacactgaaaattcaaaatgttgcagaaataaattaggaaaacacaaataagtgaaaagatatcccaagcacacaaataagaagatttaatattaaggtctcaatagatctacagaacaatccatgccaaaatcccaacagtgtattttgccaaaatacaaaaattcattctaaaattcataaggaatttcaatataccccaaatagccaaagcaatcctaaaacaaaaacaaagtttcaggcttcacactttctggtttcaaaatgtaaagctgcagtagtcaaaacaatgtagtactggcataaagacagatataatactggtacaatataaagctacagtaatcaaaacagtgtagtactggcataaagacagacatagagaccagttgaatagcatagagagcccagaaacaaaccctcacaaatatcatcaaatgattttgacaagagtgccaagagcatttaatgaagaaagtatagtcttttcaacaaatagctctggaaaaactggctatttatatgtataaaaataaatttaaaccttacagcatttacaaaaattaagtcaaaatgaaagaaacacctacatataatacataaaactataaaacccttagaagaaaacaaccaaaagctttataacattggatttggcaatgatttcttggacatgacaccaaaagcgcaagaatcaaaaataaataaattggatatgtcaaaatgctaaaagtatgtatcaaaggcataatcaacagagtagaaaggcaacatatggaaagaaataaaatatttgcaaatcaagtatctgataggaaattaataaatataatatacagtatatatctacacacacacacacacacatatatatatacacacattaactaaacactaaaaaacttttgtacaccaaaggacactatcaacagatagtaaaaagtcaacccatggactaggtgcagtggctcatgcttgtaatcccagccttaggaggctgaagcaggagaatcacttgaagccaggagtacgagacctgcctgagcaacacagtgagtcctcatctgtacaaaaatttttaaaactagctaggtatggtggtaggtacctgtagtcccagctacttgggagactgaggtgggaggattgcttcaacccaggagtttgaggttacagtgagctatgattatgtcactgcattccagcctgggagacagaccaaaaccctgtcactaaaaacacaatgaaacaaagcaaaacaaacaaacaaacatgaaatggtagaaaatatttgcaaatcatatagtctgaaaaggaattaatatcctcttaatatataaaggacttctacaacttaacaacaacaaaaaaacactcaattttaaaaaaaattggtaatggactagaatagacatttctccaaagagaatatacaaatggccaataagcatgtgaaaagatgttaaacaatactaatcattagggaaatgtaaatcaaaaccacaataagataccactttacatcctttaggatggttaccataaaaagaaagaaaaagcaaaataaaaccaaaaaagcaaaatagaaaataaaaagtgttggcaaagatgtggagaaattggcacccttttgcactgttggtgagaatgcaaaatggtgcagctgctatggaaaatacacaaaaaaattaaaagtagattctcaaaagaaatgtttgtaaacccatattcatagcagctttacaactgctgaaaggtgaaagcattcaaaatgactgctgatagatgaatggagaaacaaaatgtggtacatatatgtaatgcattattcagtcttgaaaaggaataaagtcacaatggcaaagacatggaatcaacctaaatgcccatcagtgatagattggataaataaaatgtggtatgtatataccatggaataccatgaagccataagaaagaatgagatcatttcctttacagggacaccgatggagctggaggccattatccttagcaaactaatgcaggaacagaaaaccatggagaatagagggtaggaggagggagaggattaggaaaaataacttatgggtactaggcttaatacctggatgatgaaataatctgtacaacaaacccccaggacacaagcttaccatatacaacaaacctgcagttgtaccccagcacttaaactaaaagttaaaaaaacagaaagaaatctgacccatgctatagcatggataaaccttgagaaaattatgttaggtgaaataaatcagtcacaaaatgacaaatactatatgattctactggtataatgtacccgagactagttaaattcatagagacagaaagtagaacaatgattctgaggagatagagcaggagtcctcaactccctctcctcttccccgccccctgtactggtcaatggcctgttagaaaccaggccacacagcaggtggtgagcaagcattactgcctaagttccacctcttgtcagatcagcaggggcattagattcttacaggaacaggaaccctactgtaaactgcacatgcgagggatttaggctgcatgctccttataagaacccaatgcctgatagtgtgtcactatctcccatcatccccagatgggaccatttagttacaggaaaacaagctcaggactcccactgactctacattatggtaagtatgtaataataataaagtgcacattaaatgtaatgtgcttgaattatcccgaaaccatcccccaccatcctatccatggaaaaattgtcttacatgaaaccagttcctggtaccaaaaagattggggaccactcttttaatggatacagagtttcagttttacaacataaaaagagtcctggagatagacggcagtgatggttgcacaacagtgagtataattaacagcactaaatggtaaattagaaaattgttaagatagtacattttatgtctatcttaccacaattaaaaattaaaataccagtgctactgatgctcttagcagtgccagatgtttcaggtattatgctctctttaacaaaaaccacttcccatttctagtttaaactcatacctatgaaattagaaccctcctggggcactggaaagcttcaatctgtgtttttgaacttgttcatggtttttcactgaggtaactagtaaaattatctacactgttacttacggaaggattcgcttcacagtgtgagtaaaacctcagaaatttggggagggttttaacgatgatggtcatttaaaagtaattaactataactcttcagtgaatgagaatattttggaagaatatttacatctaaattgagtttactgtcttatcaccataagatatatacataaaaaaattacattcagagccaggaatcaaaatcaggcaagaaccagggtacaaaataaattttaccaagtcaagcctaaatttcaactagaaagctagttaattatttgaaggactgaagatggtctgattcctagattaaatgcagttgagaagtgtatttgcactgagtgtatgaggcatgaaacgacagactgaatgttttggaacagaagctgtcttagtttaaattgctgtgaaaacagagcctgaaacaagaatttggatgaagattatttatttgaatggtgatcccaagaagtaggagtgagggctcaggaatgtcaagatagagtcagggaaagagaaaactccaacataagatgctttctcattgtcactcgtactggtgggaaactcagttctgctgaatctccctgtaaagcatccttacctcaatcattttatctcacatggcatcagggaaggccttggatcaggagaagctgcatgtgcttgtagaaggactctcagcacaaagggaatatgaggtcataaagagctacagagttgtggctaaatcaaaagtaggccaagaggacttgaagatgagaaagagagcttttgctacaggccactccttgcactactctcataaacttgttactcttagatatactccatcaccaactcaagatgatatttagccaaaatatctatgaaagatttaacctaatgataaactttaatttccattgctgcaccttttctctagtccacaactggcatttgttacctccttcttccactgcccagtgtatgactgaaatcttcatccaagaaagatatggactctgataacctttttttaattttaatttttatttttttgagatggagtttcgctcttgttgcccaggctggagtgcaatggtgcgatcttggctcaccacaacctccccctcctaggttcaagcaattctcctgactcagcctcctgagtagctgggattacaggcatgcaccaccacacccggctaattttgtatttttagaagagacggggtttctccatgttaaggctggtcttgaactcctgacctcaggtgatctgcctgcctcggcctcccagagtgctgggattacaggcgtgagccaccgcgcctggcctaaccttatttttattaagccatggttgctgcaattggaaatgtgatggtatttaggtccctgggtatcagtgtcagctcaatacctcctattcatttgtgtaccctactatacaatttagcaggtgaattatctagtaagtggacccaagtccctttggggaagaatcagggaatattatatacagtatacttgcactgaggttcctcctcaatcggaccctgctcctggaactaagaacttaatctgtttacaaattaggtaaaagactgtgattttctattatggtgctgaccttagtctcccactcatgtgttcttaatcttattgaatatatacatcaaacagcacctcaattgacagttaataccttgattctgcccatctctcttgtctctagcaaccctttgtttaataggcatttccaactatccctgtagttgaggctcctggattatcatgccagttgttcattaaagtaattgcatttaccctgcttctggtggttaaatgcttccacctggcatgtgcctttctggaattctatccctattgactttaggaagccccttttcatagaatcatctcctaccaacaaatatggcctacagaagacagtcatgcttaagctgctcagagctgtttgtgtatatgttcccttcccaggttcccatttattactttagtgactacaatgtcaacattccattctaccagaaaaaatattcagtattcctcttagaactgtccaccagaatgactgcatgctggagcatttatctacaacaatcccagggacgttaactgtcccacacatctgggctgagcttgtatgttaatcaaagagggttccagacaaattggggaagactaattggagagacagaaatagatgcatagcacacatttgagatgggatttgtcatcatgaagtcactcatataaaaccatctaccacaactgttgattagatcagacagatgctgaagagatatgctatggggtcctaagatatctgctctgcaggctctgtcataggagtaggcatggtgttctgcacattttctaatttttcatataaaggagtctgcataaaatttgggagagagaaaacctacaaaagcacagaatcatagatgggttagagcatgaggtcacaatcatgtgacagagttcagagatgaacagctctggaagacatcctaactctcccaacacatacacacatttctgtcatgaagagtggggtataggacagctgaaagtttggaatttggtggcatagggaaaataacctcatctgactcctatgtacctgattaaacttttactatatgttgcttatggttaataagaattctttggaaaagaagactacctgtcagttacacgagccatatataaaatctttttttaaaaaaatacttagaccaaccagacgcagtggctcatgcctgtaatccaagcactttgggaggctgaggagggcagatcacctgaggtcagtagttcaagaccagcccacatgatgaaaccctgtctctactgaaaatacaaaaattagacgagagtggtggcgggcacctgtaatcccagctactcaagagactgaggcgggataattgcttgaacctgggaagtggaggttgcagtgagccaagatcatgccactgcactccagactgggtgacagagtgagactccatctcaaaaaaaaaaaaaaattacttagaccattacagattaagctcaagctcccttcccttttactcgtaatctggtccatgtgtgctcctttctttctcagaggcatccactactgtgacttataacgagtcatgtgtttttcttaacatttatacacatttatgagcccacaggtaatacatattattgttatccattttcataagcatctctttcaaatgcctgttgtaggagtcctagctagaagatggagcaaactacgtctcctcttttgcagtagtgatattctcaggaatgccagaagatgggattatactgacaaagacaattatcctgaaaaactaattatctgggggtatttgtgaaaagaaacacgaaaatgtgtgttcaagtaatagattatggggaaatgggaagtccaacactgggttaacactagctcatcttatatttggggtcagctagtgttgtgaatcaatccagtattaatgttgcaataagatgcaaagaagagtcagctttattgcacaaattaacagaaaggggataaacaaccacagaaaaaaacatacacctgaatcctttcatacctccatgtttctgtgttgagtagagagagggtgaaagtataagcgtcctcagtgctgtgtgatacaaagaaggagggatggtgtatgtgaaggaagaacaagccaaagccctcctggcatgaatgtacatgggagtgagtgggaaagacactgtccattactatataacatttattctcaaaacatggaactgagatttaacagaatgttattatccttttagtctgaatcaattattcatatcagaccagaatacattgtctctcaatttattaacagtacccagaaattttattctttctgaaatatttatttagaatctcttatgttccagtcacaattttcagaggcagtttctgaatatatagaattctatatataatattcagaattgtattctatagttacctcaaaaggcaatgcagggattttaataccttacatgagataaaaatatgtgaaagcagtttgcatgatctaaaacaggatttagcaaactttttctgtaaaaggccaggtagcaaatattttcagctttcttggccaaatgaataggtggccagattttagctcttcaattctgctgttgtacaagaatagccatgaacaacacacaaataagcatagctgtgtttcaacacaactttacttacacaactgttagcagagtttagaacacaggccatggtttgccaacccctacggcttcttcctcccataagttctcctgaaaatgaacacttagcaaataatgactttatgttttcactttgagagcttttcttcttctgatgtccctttaagaatatgaagtaactcataaaaggaaaacgatgtttgatgtgatctctaaacttaggatcactaattcattcagcagttattcactgaatgccacatttgtgccaagcactgctttaagtgctggcaaaatagagatgaacgatgcacaactggttctcaggaagcttatagttgcatgatgatagacaggtaaagagaaaactacagtctgctattgagagaggttgttcaagactcaacagttatggcacactcttagaaaagccctgtgggaacctggtgctcaagttctttgagtgtaggaggtaagaaggttgttgttcacctggaccatgaagattcatatttcctgttttgcacgactcaaggacaactctatcctgtgctccatttctcttgtgggcagtaattctggtataccttgaaggatgcttgctcttcaaagaatcctcctaatccttgacgtgattctgttcccttacttggaaagtgattgccctttgaaattccactctaaagtgatgctgagtgccaggttacctgtattcttgttttcctgcaccattacctagccttagataagtctctgcatctctttgagctttattattccacattttaaaacgactgcttttgagtgctaaaggataaagagcagatacacagaatagaagaaccggagaagaatcaaaaattaagaaatatattctatatgtgaggcactttcgcttacaatgtcatgtacatctccagcctgaacctgagaggatttattaataacaccattttacagacaatgaagccgggtcttagaggcttagcaacttagctaattaacaaaaagccaagatgcaaatttaagtctgtgatatcttagatctctgccttctttccatatgctccttatctccccttgaggttcataacatccaaagactatacactgtaatcacagactaagtaaaaaaaacaaagcatgagaaaccaaataataagagaagttaaataacaatgaaaaagatgctacaaaatatatgtgtttaagcaggaaataaacattacacaaaatatggaccacatgatttcagtgggttgtgatggtgggaaaacataataaagagtagatttcaactgagtcatagaaaaatggtttgagtgtgtgtgggtttgggagtgtgtgtttgtgagagagagaggagagagaaataattctgtcattctagttttaccaggtcttaaacatgacatttaacaagatagaatttttgtgtagatttcctggcatctaccagtgagattcagacaaattatactgactggaaacctgtttcgtcatttgacagatgtggcttcaatccttaccaccttattcactaactatggatccaatcctttttgagccttaattttttacctctgtaagactgaagttattatatgattcaatctataattcaaagtcactctctatggtccattaatcttctttgaaggccaaacaggtaagctaaagaaaaatgtgatagtaattaagaccactgcatctttcagggttttaatggtgatattaatgtcttactttttccagggttgtattgttgcacatgatttgctattatgaaacagaggggaagtttctagggttctgacctggtatttttccttctcgattatgtcccacacctatgaaatgctatttcatagcctatgtgtgagcctatttcagtgagcccaggtgggaattcagtcagtgttagggtatgtttattctacctgtgtattaagaagctggaggggacggggcactgtggctcatgcctgtaatcccaccactttgggaggctgaggcaggtggatcacttgaggtcaggagttcaagaccaacctggccaacgtggtgaaaccctgtctctactaaaaatacaaaaattagccaggcttggtggtgcatgcatgtaatcccagctactcggatggctgaggcaagagaatcccttgaacttgggaggcaaagtttgcagtaagccaaagttgtaccattgcactccagcctgggtaacagtgcaactcgaaaaaaaaaaaaaaaaagaaaaagaaagaaggaaagcaagcaagcaagcaagcaagcaagcaaactggggggacaaaaaaacacagggtgggtctgtagaattactgcacccattgacagatagctttagattacatgtctattgtttaccagatcctcatgaacctccactcaaactaggggagcccggtgctattttaatagctctataatagctccataattagtattaaccaagaggccatgtgtagtaactgctgaaatatttggtaatttctttttggtctgtgctcagatatcctgctaaagacacaggtcccttttgagagactttggaggaagatttacatatataaatatggcaggatccttcctcaggggtccttccccagcttcatcttcattgaggggatgcaagtctgaaatgggtcagctctgggtgacattccgttgtggaattcaagctttttctctacacattatatctaaatactttcagatcttaaagatcaagtcatactttggtaagatgcctgtgtgttttattcttagtgacatcatgatatgttagccaacacaaaataactttaaaggtgatgattactgaggccctgctctaaccttacagtaattgtccttaccttatatccgataattaagcagggatacatctccgccagtccaggattccattaaccccactgaaatcagaaaatctatatcaatatcagcagcttctaccatcattccagcatacagaggaaatcctcaaggatttgtttcctgaattaaagcacttttggatgtcttagcaaaataaatatcattttagccctataaggagacattctggagaaaggaaaagaaggtaggaaggttgctgcaagaaaaatcaactccaatatttctgtctccttaaattttgggatttatttctttcaccagggaagttctgggatgtaaatttcattaactttaaatcaacattggctttagggttttttcaaccaatcaagaaaattgctagaacaacttctaactgttcaggctaatgtattgaaccatcatctctaagtacatggatgcatcaacatagcttcaaaccaacattattcccgtcctctttgacctatggattttagaattaatttctacatatatgccatgtgtttttctcatatcacttagcaagaacctgaaattctctaatcatgtgaattattgtctgctgggttagactttgcccttttactcccaggatgatgatgagctctttctctagttttcagtctaaagacaataaggagtagttatgaagagatttggcatctacgtttgagacgatggcctcagatgtgataattacttgcctttaaacaggaaaggctactcttttcagacagaaaaggaggattgaatttctctggaaagagagactcagtgggatttggggattgaaggttatcacgtcccctaagtgcaactaaattcctctaccccaaatgttagttctcgttccttgtcattcaatgcttgaaattaaacataagaggcttgacaaagatgtaaactcaacttacattgcagcatcaaacttagtatttattttaaactgtattaatcccgtgtctattaaaagaattattttggggggtccatcatagaatatatccagttctgtatcttggactgagagtttagtgccctcagcctgtaatttccttctctaaactcttcagtgcagtaagaaatagccagccaattgcatgattcttagtgtaaccattactaccataatggtcaagttcattagcacttggtctccaaatgccttatgtactttactccaagccaccactgataatttaagtactttccatggattatcagaatcccatttaccaatatcaatgagctcacttcagcttacaagtctaatcaggtaagataaccaattctattttccaaaatctgagagacagttaactggaaccattcctgttttagtttggatcccatcaggaaaacgtatccattctgggtattacaaagagagtatcttttatattaacaatggtttacaaatatgttggaaggaccggaggagcaaaataagaaggggtattagaagatgagaaagaaagaatatctgtgtgtaacactcagctcaagtggtaaattccctgggctgttacccataagactgccttatttatttttggaagtactatagttcctggacctggaagagttcctgaagagttgctgatgagctcagggtttctggagtttgcagtcactttgtccctcctgctgtaacagggtgagacactttgtgggagccaggaagagagaccttctcccttcctcctgccttctaatctcctaccagtgcttcccactggccaactttaaacacatatataaaagttatattaatctgggaaatgtagggttatttttttctattactccagtccagcagttcagagcagagtgtaaaagttatgggtatgggtttgtcatgtttgatattgagtgtcaacttaacttgattgaagaatgcaaactatcgttcctgggtgcgtctgtgagggtgctgtcaaagattaacctttgagtcagtgcatttggaaaggcagacccaccttcattctgggtgggcacaatctaatcagctgccagtttggccagaattaaagcaggcagaagaatgtggaaagactggactggctaagtcttctggcctccatctttcttctgttctgtatgcttcttgccctcaaacatcagactccaagttcttcatcttttggactcctgggtatacaccagtgatttgccaggggctcttgggccttcagccacagactgaaggctgcactgttggcttccctacttttgagtgtttgggacttgggactggcttcttgactccttagcttgcagaaggcctattatgggacttcacattttgatcatgtgagtcaattcacctagcaaagtccccttcatatattcatctatcctaatagttctgcccctctagagaaccctgactaatacagggtttgagcaacaatctttgaatactgacaaattggaaccttaagtatatgatttaccatattagactttattgtaagattcatattgtaatataaaatctatggacatgattttttttttttttttttttttagatggagtctcactcttgttgctcaggctgggtgcaatggcatgatctcgtctcactgcaacctccacctcccaggttcaagcaattctcatgcctcagcttcccaagtagctgggattataggcatgagccaccatgcccagctaattttgtattttttgtagagatggggtttcatcatgttggccagactggtttcaaacccctgacctcaggtgatccacccgccttgtcctcccaaagtgctgggattataggcgtgagccactgcacccggtctggatgtgatttttatttgacatactaattaggactatcacctctcagtgagacagggttcaaattatgactaccatatagatttagttttatgactttcaacttgatatttctccttaaaggggctcttcgtttttctatttgtaaaatgggggatatatgccttattaagtggtgtatattaaatgcgtcaacagccatgacacataaaagtcctcttctaatatttgtgctgatggtggtgatgatggcaatgtccatgaagatgtcagcattggtagtgatgatgctgaaagctgatactgatgattttttctctatagtgagagaattcattattttgcttatattttcaaagtgatcaaagattctccaaatgttaataattactactaagggtaataagggactactgagagttttgagaaggcaagcgacataaagcagctttgggattattaacctaatcatggcattatggaaggatgttgagcagaggttatttatttatttttgagatggagtctcattcttgttgcccaggctggcttgcaatggcacggtcttggctcactgccacctctgcctcccgggttcaagtgattctcctgcctcagcctcctaaggacctgggactactggcatgcaccaaccacgcccagctaatttttttttttttttttttaagtagagacaggtttcaccatgttggccaggatggtctcgattgcttgacctcatgatccacccccctcggcctctcaaagtgctgggattacaggcatgagccaccacaccctgacaagtggaggttaaagagaatgatacaagaccattacagtcatttattaacaattctttgctaggtattaaacaagttataaagttttaaattaagaaaattttgatacaaggtattccctactctgaagaaattatgtaattggtatgtgattgagattattcatatgtgatgatatttttgaaatataagcaacagatcttggttcctgagtgtgagaaatgagagagagtggacattaagtaggtcctttaacagaaatagcaaaatcaggagtaaatatccagttggaagatacagtatcaatttttatttcctccttcctttcttttctgaaaagagaagttttttgctatttacaatataagacaatttattttgtattttaacttttctaaattaaaaaatctacctacttattccagttttataaaataagcattgaagtcaatttttctacattttgacacttcccctctacaaatttttaaccttcacagatattctctatgttagtataattcagtcttatgcaggagaacaattcagtctaatgcaggagaatacctccaccatataacgactggtacaattgtcccaatcaaggctgggattgatgcctagcagcgacaatgaagatggcaattatccaagctctatcattgtgagcagcatcacttactctctttgaagatagagtgcaaaccataaagatgatgcattccagatgcgaactttctcaagaactataaagattccacctctaataacccgaagtgtcagaaatagaaggaatgcccttggcagagaatatgctgtgttcgtttcgatccagacacctactgctactttggtatccttcaatggatttttatttaatttggctcttaaaacatcctttgaaggagtgtttgctcagctcagggatcctcctagcagcaatgcctgatcactagcaggctttttattggctcttcatgacaatgcaggtccctgaacttgtctgtttccatttgtaagtcaatccctacctccgtagcagccaacaggtaatttttttctttttcccacacagaccctatggggaaaaaaggaagctgcaacattgctagcactttaaaaatacagtagtcaggcagaaaaaaaaaaaacacagtgttacttagtgtctttttccttgacaaaagccaagtgggaaattctgctctgattgaaatcatttaggtaaacaacaataacagaaacaaaattatatactacacaggcatacacataggcaatcacaaaaacacaatgtagacaaatatataaacttaatcatctattgacaatggaggaaatctttgtggctctatcagctgtgaatactatataacacccttccttaaaaatatgttggatgtgtgtgtgtataaaattgggtataggctaacttcttaaagttagaaatataaaaacctttctagatattgtggattcttctattcatgattttctacatggctctctcctgatttcttttaaacaaaagataactgttcatcatatccataatggcttccaaatcattgaagagaaaaatatttaagtcagttgatcaatttcctaaaaaaaaaattaaaaaaatttttgtctcatattgtagtaggcatgaatcctgaggcataaagaaccatactttttcccactcttaccttggtacaagtatcaaaccattaaaaaacttcacagtcttactatcctaggaagcttcaagaaatggaaacacaaaattctgatacttctgggaagctggcttatgtgaccatcattggatcaggctctgataatgcaatgagaaggcaaagaacttacatcgtttctgctgacgtgtaaaaggaagtggtacactagtaaatgctcaacaatcaactgtctggaaaaaacaaacatgcagtttttagtgttttttaatttcccttgtgcaaatattcctatcaagcctgatttcaagctatcacatggcatcagtgaatgcaaaaatggagatgagaagcacataactggctcttctaagtcattaggagtcagttcaagcacaccactgaaacatcttcagaaagggactgagctatgttgagtgtcataatttgaaggacaaaacatcttttaatgtttttcccgcccaactcttctacagaaagttgaggctaattttctctctcagcacagtggtgctgcttggtaggcaacatgataacaataaaatctaaaagttttgggcataatcatgtttatctactttcatggcaaccctaaaatggcacagctactgaaaaaaaaaggttcctggcactcgtaagaatttcctttgagattatgggacttattcataaaagagttgctttgtattctctattaggacaagacaaattagagaggttttcattattccccaaacccctgttactcaaagtgtgatatatgggccagcaatatctgcattacctcagagcatgttagaaaagcaaaatcttaatcctaaacctagaacaaatgcgtcagaatctctattttaaaaaaaaattcccatatgttttgcatgcacattaaagtttgagagacactgccctaaatcactgttttaaagtttttcttaggtagtatgagatcttctgtttcattaaaacttacacattctttctgaggtgaatctttgtaatccaagtctttactattctggctgagtcagagaatatggatgtatcaatgtagtccctcctcagttctggcaactaaaagcactgccaatatttaatgggagtccatactcaatttagtgtatatgacaaaggctaactctcacttttaggaaccagaattgaaggtgaaggttgctcagaatttcataatgtgaataccagtagaaaaatgactggaaggaaatatatcaaaatgataataatgtttatctcaaggtagtgaaattttaggcactttcttcttttcaaaaaatatcttccaaattttttacaatctggtttcattttaaaaacttcaaaaagaggccaggtgaggtggttcatgcctgtaatcccagcactttgggaggcctaggcgggcggatcacaaggtctggagtttgaaacaagcctggccaacatagtgaaaccccgtctctgctaaaaatacaaaaattagccgagtgtggtagcatgcacctgtatttccagctactggggaggctgaggcaggagaattgttcaaatctgggaggcggaggttgcagtgagcctagccgagactgtgctattgcactccagcctgggcgacagagcgagactccgtctcaaaaaacaaaacaaacaaacaaacaaaaacttcaaaaagagagaaaaaaacataaaatagaaatcctctgtgagtttttctatagatgcaatcaatgggtagttatttatgatttatgatgtctttaactcctacatatcagttattttattagcgtaattaaatattcctaattatttgttttgcacctgttctttagccacagaactgcccttctcataaaagcagggaacatttctagcatgccttctggaaataagtgggtacttaataaatatttattaaattaatggaagacaaggagggataagtagtatgatttggggaagcttaaccagagtcagatatacattttaaagttagtgaaataagattttcctattctcatttctcctttctttcaaatcttttattttcccagcctccacagcttattgcccccttttgggtctcaacgtcttctctctctctccttctctatctcctctccaaatggaccttaggtacacagcattagataaatcagaattcttaatttaggcctgactcacatcatggttccacacctgtaatctttcccttatttacaggtttattttgaataatatacttaacactgtgaatctatcgctcaatctattaagaacattgacagtaatctaaatagacctatattctccctccctgttttcacccacagtaaataccatgcttaattttatgtttattccacaaatatttttaaataattctatcatatatataatctaagctaaaagatatttaatgttattattcttgaacttcatgaaaaaggcaccatgctgtatatagttcccataacttacttctttcacatcatgtaaccaggcttcatccatgttattgcatgtagatggagtgtattcattttcactcagtatatctcagctgcagtggtatatttcagccactgtcttcaaaattagacaaatggtaatgacattgttcctggcaaagcctaatggcctgttctcttttccaaaaaaatatgttcagaaagatatatgatctaccaactatgaaattctgtagatgtgatactttcttgtaacatgaaaaataaggaataatttgttattttttaaatgaaccatcttatatttgtaaggcctggaatagcacttgatactagataactagaaatagtgggctaatttaggagaaatatttctggttttaatgttattcagtatcatatatgggatggttgttgagggagatgaaaatcttagactctgactgcaagtcatatcttcttcaaaccactcagtgtgtagaaattttaaacctttctagctccaaatatatctgttttgtttcatttaaattaattaaagtattcgttcattataatttcaggatatttgaactccccacaagaccatatgaaagagaaatgatatttatccttgagatgaagtaacaagtatggccagaatcagtgagccatagtccaataggctcaagtgagataggaacattttgtctacgataacatttcaatcactgaatatcataacagacctggtatcagtctccattctgaagaaagaaaagtcaaaagatggaccaaaacaagatcatagatttcaactgaaaactaaattcgttgatatgtcccttgcttagtccacaattgacgttgtctcctaaaaggtgcggcacatatatctttgtatcagtttccttctctggattacttgtgagtcccttctagccattcatacctggtaattttatgcactcctttcactcttcagcggtagggaatgagaaggcagactcaaattggtgagcacgcgtcctttcggagctttcatccatctatctatctatcatctatctatctatctatctatctatctatccatccatccatccatatttttttttttgagatggagtctcgctctgttgcccaggctggagtgcagtggcacgatctcagctcactgcaagctccgcctcccgggttcaagctattctcctgcctcagcctcctgagtagctgggactacaggcgcccgccaccatgcctggctaatttttgtatttttagtagagacagggcttcaccatgtgggccaggctggttttgatctcctgacctcatgatctgcccacctcggcctcccaaagtgctgggattacaggcatgagattataggcatctttaaagagtccaatattcctcctagactgctgtgaaattcaaggaggaaaccttttcataactattttaacaaaatgcttttgctgttgttgtgaatctttttctacatgtatctacagacatactgaatacttgttttcttatgaaaatctgctcctaatattagaaaatcaggtagggtaaagctgagaaataatgtttaatctgggaggcaatgagtatggcctgggttgaattcttgttttaccacaaatgaccactgtaatttgaggcaggagactttaccttcaaatgttttttttattttttcatctcaaaactgaaataacaatagatacttcagatgattattgtgaaagttaaattacataatgcttatgagaattcctagcatagcaggcactccataaagatttgtggattctgaggagggccagtggaggggatacttggagaacttttaggtttgattttcccagcacaatgaagtactgactctcattttaatgacaagtgtggtgaaggcactttgctcaaggaagcaatttgcattaatgttaattaattaatgataattaatgagtagttttttttaggttaagtgtccaaggccagatgtttgcatcagttccatagctaggtatgggagtaattctcatgccctccaaagggctccagcttcattctttcatccggagacagccctcaagctaaatggtagcctgaaaagactgtcacctttatggtagccccactctacactccctccgtacaagatatcaggcctgtggttgaaacttcaggaacagagttcattccaaatatctcagcacatctcttagagccatcaagccatcttgttattgccacctgcaacatattcttaacaccaaaccaacaaacaaatgtcaaaacaacatcaacaacaaaacatcgaaactcttctccccatctattcaattagaggtgtcatggcagactgcaggggaaatctcatttttgctctgaataaatattgctctgggttgtttgttgtttgcagaacactcatacttttctaattcctactttcttacccccaagatatgttggtcaagtggcctatatatgtatatattttaaaatatttctagattttttgtgcgtgtgtttgtatgcatatatgtgggtgtgtatgtataaaatcttgaaaacctctgccacatttaaaaatgccacaggaaaaaaatattcttaggatctatgtctatgtctagatctatgtaagattgagaaccactgccaatgttactaaaaaaaatcattaaaatcatttttgtgcctcagtttctttatctgaaaaacagggttaacaaaggtatattttaaaaagtagagataatgtataatgcaaaaaggatctggcacaaaggaagtatccactgtatattgtttattcttattcttgacagtgtgagaaatgtttattatacgggctaagtaaaagtagcatcatcccagatatataaaagacataagttacgtagattcaggcaaaaataccagcaagttgccctggatatagagtctgttatttctagaccaagacattcatagaagggcaaaccgtcttacttgcaaggaactttggaactcatgtgatttagtttcctttcctatgcagaaatccccctttaaactatggttctttggaacctaagccaataaattaggttcagagattatctggagagcagatcttgcccatactttaccgtaaggggtaaggattaaagtctccattcccagtgggcatagtttcaaccagagaatgccaaagatgctatagaggaatggaggatttaatccttaccccttacaatagcccatggttaagtttaacattaagatttgctcctggtaaatgttattggggaaacaaggtttttatattcccaggacaccttgtggcaatctctctttccccagacataaagctaaaggccatgtggtttttaaattccccactttttccataataaaacatagcatctggatataatctgactcatcattggcttagagatgcaaatgtctacggatgctcggtgcagatactttttaaggtaactggaagtaattccctatttgactgaaactatgtaataaaaataagattttctggtgccaaagacctatgtaggaggctctttctgcttgcacgcaagggaaggaacagagaatgcctttaattctggctttgatttaaatctgcatcaccatttaccaattgtaagccaatgagcaagtcattaaaccactgtaagcctcagtttcctcatttgtaaaatggggataattgtagctgcctcacagtgatgtacaattaaatggggataatatttataattagagtatctgaccaaatgtattaaataaatttagctactataaagatctaattaaaggagagttgttattgctattattatatttattctctgtggttttcaggctgtctatagaccatatatatgctctgcagggacacggagaactgtattttctcagccatgctgtggagccaaatagcagaaacccaggcagcctgtaaggagaagcaagacaaattcaagagattgcaaggggatctcgttgaactgagcctggaattacatgaaaagaaatcttttaacagttatttcctattcaaaaaagacttggtgcattattcaattccatcgtactgggagctttgctccttcacattcatgctttcaaatcttactcattactgccctagcctggatggggtgaaggaagctggaaaagaaattctgggcagtagatcacaaaggagatatttgcagggatgagaatagctctagcttcctacctacatttgtgagttacttttaacttttcaaaatactttcatgcctaccttctctattggggtgggtagcaagcaccttggacccctagatagaaaactcctagataatagaacctctaaacccctgcctactcattcagtttcttgaacacattctgaataataagaacactacagctattataacagcataatttacttagcatctgccacgtgtgcaatacgtgctgaatatctcatatacattgtctatatagtttttaaatcaactctttgaaatagccggttttgttttttcatctcagtgacttggtataagggtcctatagatactaagtagcagatcttggatttgaacacaggcatgtgacacaaaatttgtgctttaacaactctactaaaattctgaagacttcgtcctatgtttggaaatagttaagggatacagagaccggtagaagcctctgtcctgtgctacaagaacagagcagacccttagaagcagaataacatttcactgtcagtgtttatttaagtggtcgaagtcaatttcaagagacatagagggcagagaaagagtgattttaaaggacctagaggagaagcaataaatacagctgaaaacgtgggggacaggaaaccaccatcagagtgtaggtcagctaagtagttaggaagtgttgcatgaaaggaagaagcttcagtaaaatgtcatctgtgacctgtttaggtaactacatatcctgctaagttaaatagatgtcagtcccagccagctggctttcatttgggaaaaaatataaataaagaagtaacccttaatgagtcagttcagaatttgtggaatccttcagcaaaaagagatttcagaggagtagaatggggaaagaataggagtatctcttcagaaacaaggaagagtcactcagaaatgttaattgacttgcctcagatcaaaatttctctgggactaactcaggttacctgggacattaccttttgtgctaactatttgagaattaatgaaaagaaaaaaaaacctaagttctctaaagttaaaatttttcatttacctataaccaaaggactcattcgttcagaaagctgtgggacgcctttgtgaacaatggatgcaacagctaggcctggatcacacgaattacaatcaacccttccttaccctatttgtgatgtttctgtgctaagggaaggcattttcacattatcttctctgttctcatctgagtcttatgccttttatattttgtgcctcttcttaaattatacctctttctcaagattgtatcccaccagccctgtgggcccttagctgtcctcagcaagctgtctctattccagttcagcctgtccttcagcctgtccatcaggcttctcaccatggggttgatgaaagtctcatctccccaagaccatgctttccttagaaccaagtattgtgtctcttttatacagaccaatagtacaccaaccaaggatgtactcaataaacctttgctgattgactacagcattggctttttctcaaccagaaattataaaatgttaaaaaagttgtgctgaaatacagcatttactgggctaaagggcaagtttggctttccagtaagtttcaactttaatcagatcacttgttggggttgggtaagaatgtggctgttgtcatgatttggggaccctaatgattccagctgtgtctactcagccaatggcacagaatccgtgatagccgaggtcatgaagagtcaccttcctgatccgaccccctccatcttggttctgctgctattacacttttctataccacctcttcttatccctagcagatgacatagaaatggaatgtattatttggaagcatactgaaagatacagtagattcttattgtttatggtagtgatattctgtaaaatcaatgcaaacattgaattagtgaatactaaatcattgttcctagggtagatacaggattaggtttctgagagctactatgcacaacattttctgcaaccattcaatacataaccctgtttaatggatgtttctgttcagacattatattgtatattgttgattcattaacatcacatgcacagccaactgcactatttcttgtgcctgaatgaagcttttctaacatatgcaatttctctgtaaagcacatcaaagtcttcttgtgctttgtgtcactaggcatcacttcagctctctgcctggggatcattttaaatagcaaaattaccaacataaattacaaaaatacaaaaaatatgtcaccaaacagactgcgaaaagaattatttactgtactagaacttaaacaagaagacagagcattgtctcgttggactgctgctgggaatgtgcactttggtgactcaaattttttgtgactctctgcatgtgcatgtctgtcaacgaccatgaaggtgttcaagtattgatttgtgagtaacaaacaaattttggcaaatagatgaattggtaaatacagaatcaatgaataatgaggactgaatgtacctttaaatggtatctactttcatttggcatttttatgtcttagatctggggattctccatttatccacttcagtgaaatggcccatgttctcttacaggggaaagaaaatccatacgtaatctggaattcaaacgatctcaagcaatgagagccattttaacatttgtaattatgctttaccgccaaaagagttgtttgggctttatagaaattggagctcataagaatgtagacttcgctatcatagagatctaaatttaaaaccagattatgctactgattaggtgagtagtcacccaccttcttgcacagaagctgtcttatttctaacgacaaaatataacaatatacatattttttgcagggcttgaaagaacatacatggaaaatgcctgccatgagggcacactgagtttactctttttctttccttcccattcaaggtattctggaatgaagcatatttagtcattgtgttttccacaatgctgaggtggaggaacatgcagcctgagactatgtataggaactggctattaacacaggttaattaaaaaacatatattgtgttcttctctaatcaaaatatgattattaccaagaggtgagtcttgtttcaagcagtggggagggaatgaacagaatcatccaaattacaactataaaaataggtatacatttggacaaagtctgcaagagaatacacagaaatcaaaatagttgtttccaagcgatggaattatggaaatttttttcttcaaaatgttctcaaatgttatacgttctttttacaatacaaatgcagtgcatatgaaaagaattataatgaatgaagcaatcagggattgtcttgaagcaaagcagtaacatgaaatcaagataatgtagatgagagatgatttacattattttgttcccatcaagcgaagggcattttccagaagcctaagatggtggatcaacaaagagtgttgacaacaacacagggtaaagagaggtgagaagggggtacaaacatggcaggcccactatcaacccatttccagactgtttctcttgcccctcttctgactttcagcattgattcctgttaatctgcactttattaacaactttttccactccatgcttccgtcatctcctcttccctacaccaaattgacatgcaacttcccaaggattgcctaagactagtcagtacattgagcagaaatgataggaagcaagcccctgtccagctttcagaggggtttagtattgcgacgtgtcaaaatctgtggggagctgccggtggtagaataagcaggtggggagagaacggaagtttgtcaggctaagcgtccagattgatgcattctattccatgctattataaatattcttcttttgaaattgtatttgactttgtattggggggagaaatcataattgagtttaaaactgtggatctttgtcctgtagtatggtattaggacttaaattctatttccatgtacatatttcatccaataaaatttaaaatactggctcaagcataactggtatataattttattgtcatgatagccaatccgttataaattaaatcaagctttcacacactaatatcaactcacacatttattctaactaccaaatagtacttgattctagacttgtcatatcttttttgggccctgaaaaggtattaccatgtctattttaatatttcatctattttttagaactgttatttaaatttcacaagacctctagttgctgccctacatatttttttaatttatatacaccgtatattagggcctgtgttaaagtctggatactgttggacaaaatacaacaatttggtgcccagaaaaatgaactgtgaaaatcattaatgcttttcacaaaacagtgtggcgtttgccttataatcacatgcaacaattaaacatccatgccctcttctaacattgctaaggacatgtgatttgctctgtccaatgaaacctgtacagaagtgttacttctgagaggtgaacattaaaagccagtgcacaattacccactttttcccttcccatcacttcagtgattcaaaaactcttggcaagatgaagccttggtcagtttggggatgtgagaaatcaagaggagcagagctttctgctgatctgtggtgagcacataccattgggtaaggaatagacatctgctttggtaagcccatgaaattttttggagctattcgttaccacagcataatggagttttcttagctgaattataatgaataaagatctgagaagtttctcaagtgttattcatagcttttagaaaaaaatgtgttatttagcatttgatacaaaggaaatatatatgaattgttcagtcatcccttggtatctgtagaggatttgttccaggaccctcccaaaataccaaaatctacagattttcaagacacttatataagatggtgtagtatttgcatataacctatatacatcctcctgtaaactttaagtcatctctagattatttataatacctaatacaactatcataggcttaactacatttttgatccacggtttgttgaattcatggaagcagaacctgtggatccagggctgattccatatgtacgctaataagtataaaaatgcagcaaacagccataaacttatcacccaatttaagaactggaacattcatacattgtttgaaactgtctttaggcttctcctacatcctaacacatggcctcctccttagatataagtatttgaaacaaaacaggttagagaaagtggtcccaaccattttggcaccaaggactggtttcgtggaagacaattttttccatggaatgggtggtgagggggtgggtatggttttgggatgaaactgttctaccttagatcatcaggcattagttacagattctcataaggagcgtgcaacctagatcccttgcatgtgcagttcacaatagggttcacgctcctatgagaatctcatgccaccactgatctgacaggaggtggagctcaggcggtaatgctcactcaaggctcaccccctgtgttgtgcagcctagttcctaacaggccatggactggcgggtcctggtccatagcccggggacaggggactcctgacataggagactgcatttataatatcatctttgtaaagtactcattgtcttttcaatcacattctttgaatatatgaataattactaccactactgtgatactatggtaacaggtactgagcacttactatttgcctaataatgtttattaactttttatgtacttattcctttgtatgaggtaggatctatcgctaggagtacaggcatgagctaccacactgggccccagagttctctttatatagctggtttagtagacagatagttactttcagaatgcatttttaattgcagttgggtaaaatgcttctactcattttaaagatgaaacagttaaaggtccagtattaaatttcttatttaagatcagatatattaacaatgacagatctggaacatttggttccagtattagattctctctgtggctgcaacaaattaccacaaacttggtggcccaaaacaagagaaacttattgtcttatattggttcaaaatgggtctttctaaaacaaaagtgttggcaaggctgaattctttccggagggtctagggaagaatccatctccttatccttttcagccagtaaggccacctgccatctttgggtgtggccccttcctccattttcaaaactagcaccttagcatcttcagatctctctctgactctgactaccctgcctcactcttttacttataaagacccttgtcattagagcgggttcacacagctaacccaaaataatttccccatctcaagatatttaacttaatcttatctgcaaagtcccctttgcaatgtaaggtaaaacattcactaggtccagccattaggatttggacaactttttggagaccattattctgcctgccacaggttcaaaacctattgtgttagtcactatgctatactgcctcttgggggatgatagtcctacagccctattttgaagtgtcatgtttaaaatcaacaacagtaacaactgcaattaaaaatgtattctgagagtaaccatctgcgtactaaaccagctacataaagaaaactctgggactgagtgtggtggctcatacctgtaatcctaacactttgggaggctgaagtgggagaatgcttgagctcaggagtttgagacaagcctgggcaacatagtgagaacccatctctataagattaaaaaatattaaaataaaaagtagaaagaactctgatctcctaatttgaatccaatctatcaatttttaatgtgttttataatggagttatagacttatacaggggtggagtcctatccgtgccattttttattattaacaatattttatagataaagaacatgaggacgtttaagtaccttgcatgatataacacagtaaataaatggtgagttatctcatgacacataaattttgctgaacaagtataataggaattcattgttgggagtttgaggaggaataaatcacaatgggttggagtacttagggacattttaattcagttttggatattgaattgtaccctggaggaatatcaagatctataattagagaatttttgtaattctaaatattaacttcagtaatgtacattgctgtcttactctgggctgggggaatgtgctaggtatattcacatattaaaaccaacaaacaaaaaaacttgatgagatgactaaaacccccagtcattacacataaatatgcttgttttcttcctatgtgaaagaagactctgaaaagtgaagagaaaaggcagactagctcaggacctcaggattcaagcaagaacatggtgttgagttctttgtgtttctttttgtcccttatatgccaaccggaagctgaagaagctggtaacccagaaatgccaaaacaacaaccaaaagtctgaacaaaagcttgttccagaaagggaatagactaggaaaaataaaacttttagacaataatcactctattccaactaaacacgacagataaactgtggcctccacccacacccataccacgaagggcaaagtggggagcctagaccctcctgcttcagaggctattgtgaggtgcccccagacctccaccagagaattggcagagatggttgagtgggaacccaggacttttcatccccactggattatagcaaggtcctcctgccccctgtagtgtcagcggagaccacgagtcctcctgctccatgtggtgtcaagcggagaccacttccattcccacaactatccgtaatgaagcaatgcctgtctctcctttggggttctcttagagggtcaaaggaggcttaatgaagtcatgactttcaccactcccatggtaaccaagcgtaccacctacctcccattacggtgtcagtggaagccttgaggggcatagtaaagaggcattcctacctctctcagccagggagatgccagcggaggcctagtgggagccaagactcccaccccaactgagagtaatgcggagcctttcacttgggtgtcaggggaagccacataagccttacataaagaaaggccaaaattatagaaatggataacagattagtagttaccaagggttaagagatagatgtgtgtggctataaaaaggcaacaagagggattgttgccataatgggagtccagtattttgtatcttaagtgtatcaatgactgtatctcatctgatactgtattagtttttcaagatgtcaccattgagggaaactctaaagggtataccagatttctctgtattatttcttataactgcatatgaatctataattatctaaaaaattttaaattatgaaaaaaatcttgatgaagcatagctattatacttagaaagccatgatattgaggtaacatacagaatttttgtgttgttaagacagggtctcactctattgcctaggctggagtgcagtggtgcaatcacagctcactgcagccttgatttcccagactcaagtgatcctcttgccttagccttctgagtagctgagactacaagcatgtgccatcacacccagttgatttttaaatttttatttttagtagagatcaggtctcgctatgttgctcaggcgggtcttgaactcctgagctcaagcaatcctcccacctcaactggacaaagggttgggattacaggaatgagccaccacaaccggcctacatgcagtattttgattaggagaccatgatataggtttgttctggagaggagtagactcagatactccaaattttaagtactcaggaaagtgattattgttgctccgtggtttttcttatgccaactaacatttttaaaagtctaaagaattggcttgaaatttaaactattagtttagtgtataaaataagattgccaaaaagcctggaatattcaaaatcactaatttgtgttatcatccctaagaaaagatttatatagaaagcaaattgtcataaaagccttgtatagtaaatatgcattcaggccatgaaagaatggttgtcaaatgactggctcccatagcttaaggaccctaaggcactgggggaatcctctttagagtttttgcaaaaaccattcaccactttctcctccctgttttcctttcacttttcaataccacattctagtgacatgttaatactatgcactgttgatgtcttactgctctcatgccttcccaagtctattgtataggaagggaagagaagggactaagctttgttgagcacctagagatccagtctctgaggaatcaagtcatgtaatacccacaaaaatcatccagtaggtatattactattttacacatgagcatttagaaagatttagggtgtttctcgcaaactatcagttaattattatctgggtctggcttttgctaccttcttattagattctcagagagctaattcacctccaactctgggggtgttgccctgctgttacctaacacgaactgaccacattaataacatcacacaatgtaatttacaaaactgaaatttaataggttatatttaattgttaacaattaaattattagaagtggtagaattagatttagattttctgcctctaaatctagcagtcttctctgatgacttctaaaatgtgatcaagtggatataatacaacagaaaaacattttttccttttcatcatttctgacaatgtagctagaaacgaactgggctatccttttgacacactaatgtttggccactttcttgattttccctgcaaggattctatgtttttctgtgtccattgtgttctagaaaagatggggttgtggtaactacttacaattttagagaaagagagaaatgaggagtgatttggatgatgtgctttttgtcctggtctaaaaccaataggagaagaatcatcctgtaatcctgtcaggaaattttctctttggtagactgcttttataatatatcatggctcagaaagcctggaattctactactggcctataaaatataaagaattgggacaactgttctgttcaattgagaccgtcactgctatacctatgggaacttcctaattgatacatgttcaaaatagtttggaattgagaaaaagaaaacaccagctatttttgaaataatgagacactttcttagctattatacaccaactgaaacctgtgccactgcctagagtattataattcctgcatgaacaaaattggcccaaataattatccaatgcttaaggcaacataaataaaagttcttacacttctaggtttccagttagtaaaagatgtgcagtgatgggagagaaagagaaaaacacatttggcagtgatcaggttaaaaaaaataaataaattcatgctcagccttgccatttagcaaaatagtgaagttgttaaagtttctgaaactctttaaccccactcaacagctctcctttcaacatacaaatgactagtagatgctttttcttggtctcttgttttatatattttgcattcagagggttgtaaactaaaggacagtattaaccatcgattagggtattgcccagttaaggtgactgccacatcagaagaatttgcatataaattaatgcttttgaaagcattaaagacttaaatgagaactctactggtacatatagagtcatttctttagatggaaattaggctgtgcagagtgagggatgatcttgtcaactatatggaggtggtagcttgtcaccacatagggagtgggtagctcaatgacaggcattcagaacttttaaccttaggtaaaactatcatgactggatcagaactttcaacctggtttaaaatggtaacaccttttgttttatttcattgtatttaccaccttagaaagaaagaacacatttgttctcattcttgttattttttggcaattgcctatttatgtttaatgtggatgaaaaggggattgactttccactcactgattatttgagtgccactttaatgggccaccagagttttctgtaaaaggaaaacatgaacattatagttgggagtttggtaagaagagaaagaatgaaagaagaaagaagggcaggaacgtaggaggatagagtaacatgacactggggtcaccaggtggggcccagaaagcaggctgctggtaccggtccaatagaaaggtgtctatccttctacatgaccagttagtggacctgtataaggggtatgtgaaggacactttgaatattcaggagccctacaagagggaattttctgccagttgattgggcagcttcaatacaaaagagaaattcccatgttcagtagacagggttgacaccagtgtatactcgtcccaatgcagataagaactctgcctcatctgaaccagctcctcacctgttatctaccccataggtgggatgcttggctggatcccatggctattcctgggctccatctgaccacagttcatgttacatatgaagatgcttgttaatgcacaagaggattgctcttcaggtaccaggtagaaggtggtattaatataccaggctagtcacctttcatttatttagcaaatatgttaggaaactttccatgtgccaagcaccctgatatattattggtgatagatgaagcactgtgtgttcctacctcaagcactgtttaactgggaggaattaattacagcttttatgttcagtgccaaaatggaaattaggccaaagggccacgaaagtttctccctgggacacagcagagggaaggggatccattcttcttgggaagaggcaaaaagggaaatcatagattgcaacatattttttaatttttttttattatactttaagttctagggtacatgtgcacaaagtgcaggtttgttacatatgtatacatgtgccgtgtaggtgtgctgcacccattaactcatcatttacattaggtatatctcctaatgctatccctcccctctcccccaaccccatgacaggccccggtatgtgatgttccccttcctgtgtccaagtgttctcattgttcagttcccacctatgagtgagaacatgcggtgtttggttttttgtccttgcgatagtttgctgagaatgatggtttccaacttcatccatgtccctacaaaggacatgaactcatccttttttatggatgcatagtattccatggtgtatatgtgccacattttcttaatccagtctataattgatggacatttgggttggttccaagtctttgctattgtgaatagtgcctcaattaacatatgtgtgcatgtgtctttatagtagcatgatttataatctttggggtatatacctagtaatgggatcactgggtcaaatggtatttctagttctagatccctgaggaatcgccacactgtcttccacaatggttgaattaatttacactcccaccaatggtgtaaaagtattcctatttctccacatcctctccagcacctgttgtttcctgactttttaatgattgccattctaactggtgtgagatggtatctcattgtgattttgacttgcatttctctgatggccagtgatgatgagcattttttcatgtgtctgttggctgcataaatatcttcttttgagaagtgtctgttcatgtccttcacccactttgtgatggggttgttttttttcttgtaaatttgtttgagttctttgtagattctggatattagccttttgtcagatgagtagattgcaaaaattttctcttattctgcaggttgcctgttcactctgacagtagtttattttgctgtgcagaagctctttagtttaatgagatcccatttgtcaattttggcttttgttgccattgcttttggtgttttagacatgaagtccttgcccatgcctatgtcctgaatggtattgcctacgttgtcttctagggtttttatggttttaggtctaacatttaagtctttaatccatcttgaattaatttttgtataagacgtaaggaagggatccagtttcagctttctacatatgcctagccagttttcccagcaccatttattaaatagggactcctttccccatttcttgtttttgtcaggtttgtcaaagatcagatagttgtggatgtgtggtattatttctgagggctctgttctgttccattggtctatatctctgttttgataccagtatcatgctgttttggttactgtagccttgtagtatagtttgaagtcaggtagcgtgatgcctccacctttgttcttttggcttaggattgacatggcaatgaagactcttttttgaactttaaagtagtttttttccaattctgtgaagaaagtcattggtagcttgatggggatggcattgaatctataaattaccttaagcagtatggccattttcacgatatcgattcttcctatccatgagcatggaatgttcttccatttgtttttgtcttcttttatttcgttgagcagtggtttgtagttctccttgaagacatccttcacatcccttgtaagttggattcctaggtattttattctctttgaagcaatggtgaatgggagttcactcatgatttggctctctgtttgtctgttattgttgcataagaatgcttgtgatttttgcacactgattttgtatcctgagactttgctgaagttgcttatcagcttaaggagattttgggctgagacgatggggttttctagatatacagtcatgtcatctgcaaacagagacaatttgactccctcttttcctaattgaatagcctttatttatttctcctgcctgattgccctggccagaacttccaacactatgttgaatagaagtggtgagagagggcatccctgtcttgtgccagttttcaaagggaatgcttccagtttttgcccattcagtacgatattggctgtgggtttgtcatagatagctcttattcttttgagatacgtcccatcaatgcctaatttattgagagtttttagcatgaagggctgttgaattttgtcaaaggccttttctgcatctattgagataatcatgtggtttttgtctttggttctgtttttatgctggattacgtttattgatttgtgtatgttgaaccagccttgcatcccagggatgaagcccacttgatcatggtggataagtttttgatgtgctactggatttagtttgccagtattttattgaggatttttgcatcgatgttcatcagggatattggtctaaaattctcttttttttattggatcacaacatatttgaactagctctggaaggataaaatagagcattaggcagaaaaggagcaaaagtaatctaagacagagcgggcagtattctcaaatcttagtggcatgaacatgcttaaggaattggagagtctggctgaacacaagacatgggagaagagagcagaaactggtgtggaaagagaagcaggggctagattaagaaacgtctttataatgtatcttatgggcataaaggagctatcaaagcagtttaggaagaaaaatgtcatgatgagaattgtgttttagtgatatgaagctggtattagtatgctggatgacttagcagacagattatactcagaaagtatatcagatgtttctcctgggaaagccaggaaaaggaaaaataggtgtgcagacagaaaataaaagacaagccaaggtctagcaaaagattaggggtgaagggtgtcatggaatccagaagcaaagaggcaaaggaatgaggtgacaagtaaataaaaataggccatttggtatgaaaactagagaggagttgactttttagaggtataattccaatggaacattgaggtgaaatgtgtcttcgtgtcttccaactcgatatccactttcaccacccttctttacttgcctcaagcctcaaaaagctgacctgcatatttcatcaatgttttcccttattgtctggcttttattgggtttttccaaaggggaatgccaagaagaatagaaggaggaaggagacaacagtcaggatatctgtttcccagcttctccctgtaaggtcactttgggttggtatggtcctggaatcaccatgcttctaaggtgtcctgtctatgtctttttccttctgggttccagtaagtacttcattttcttatcttcttgggcctagtggtggctctcatggcttgtataatacttaccctgggttattgcaccatctcttgtaaatattatctttgtaaataatattttcttaaatcattctaacttgagatgatgcgtttcttattggcactcaggcaaatagggtggaggaagtgattttaggagttaattgaatgtaagagagtagagacaacacatacaggccactcacggaagatatttagttatgtaaagacgcaggttgtaagttgaatggggaccataaaggaaagaaagtatttcagatggagagagatgactatatttatatgttgagtcaaggatactcctttttctttaagttggcaggttaattagaatcaaatcatctatgtaggaggcctctcatacaccctaaattttggcaaattgtcacttttaattctattctttcttaattgccacatatgggaggtagaaaatgggagtctcaatgcttgttttgaacttagaacccagagaatgaatctagcattaccagtcctaattgctaagcagaatgataaaagtcactttataatcaccgtgaaaccatgaaatggcaatgaagaaagctgccacatgattaagcgaggcagaaaccagagtagagttaatcctagccagaagattagtcacagaaagggaatgaacaagagaaggaggcatcagtgggcatgataagggataataattacatctgtagattgaacaccacagaattttgacatcatttagtgacattcacatcttagagagctgctgcagtgggcaagtcattgtattttttccccaaaatttagccttttgcttcaggtacttgccttctttgagaatgtactcgattaagagagaagcaatcaaggctctataacataatgtctcaaggcatttagaatactttttcacccaatgaacagtgcaagcaataagtgctatgagttcacacagagagaaaggaccactgaataacagacatgtacaaatgacttatctatatatgcaaatccattgaacaatccattgagtgtgagaaggaggcaatgtcctcattttgtatataaaattcattaaagtcttatggtatccattgctttgaagactcccacaacttgtatacagactcagaaaactgtgaacagctttatgttttttttttttttaaccagccaaccccattaattacctaagagtgctacatgctgagcacaatatcaggtacaatatagccagccttgaaagtccatggtgttttttattttgctgatatttctaaaatgcttcaaataactgtgatacacaaagaaataaccataggcttgagcttggaaggtgttaacagagtgatttcaaaataaaaggtttttctccatataagtgatttttacctccaatcctcccaaagaaaaaataagcatagagcatcataatgtgataattataacacattacttagtattagtcctcaatttttgatgacatccctgaagctcagatatttattggaaaagttagggcagaaattctgaatagaaagaaaggcaaactaaatgtaaatggtatgaattgctgtacaggcctgagggtatctagcatactcaggtctcttattttttcaaataaactgctcaatctctcacctgcttaacatcaagaatttcagtgtctaattccttttctatttaattgtaacagaatcctagggagtttttcattctataggagtttctgcaccattgaaaccaggttgccactgtttctcactgctatagtgtgacagctgatgactggtaacttacaggctgatggtcaggtcagcccactcttctgatgtcgttactgcttgttgaggttctgcagaaaccacagtagtttttgaaagagaaggatcccctagcctccagggcaagtgtcatcattcctcaggttcccaggatcatagctcttaataatcatccatttaaatttatacagctagccccagcctcaaagtattggatctggactcatgcctctgtctgcaccctccaacatctggaaaaatcatccatttttccttctactgaccacctctcccaggctatggtacattttttttttaatccccacaaatcaatggatcttgttatattcctctctatgaacaattggctagtgtaggatttgctcaaacaaaacctactatttaagggtggcatctctcaataatttaaaaaaaattatacgtagattataatataaaatgtagcatttctctagcattagaagaggggaaaaaagaaaataacaaaatctaaaaaagacaaacaaaaatgaattctttagcagtgcatcctctggcagggcacctgatcatataatatcttataatttctataattgtactaattgctttaaaatattgttttgtttaaaaggttccacttcccagggtacaaaaaataaaatcagagtggtggatacttaaggtgacccatctactgacaggcatatgttgggacttcatcttgatgtatgaggtcacagccatgttcctcatcatgtttctgatgtgctctctcctaatagtgggtggggcataaaagaagtccatcccacagtccttgaagagtttgcattaatgggagagaaggaaaattctatacttatacatatagaagagttggatactaatataagatagcacatagcatagtaataaattaaatgcaagcatctaaggtattgagagaacttctcagaggagttccattcaacaatacttattaatagtaataaaagtgtaactgactgacagacttttgccttcaaaacctctttaaagtacaaagcacttggctacactgtgcagattggctcactcaatgccaactccaactcctctttagtgtatctccctatcttttagaagctggaaaggcaaaaaaatttcagcagccttctgtgtatgacctaaattccaaaagcaaagccaccacctgagacagggaaagagtaatgtgacaatgtgaaggggcagcatggagactgactctttggataatgcagaatggcacaggtgtcatcataaagtggaagtgactgtgggttttgttacaagagtcctgttttactaaaagccttttctcttgcctctatcatctagcttactagaaattctgaaatgaacccttgtctgcctagtatagctgcaggagactatggcatctgcaactaagaaattcagaaaggtataatagtatcagaatgacttcaggtgagacagatgaaggacatggatgttggagttgtctgtctgacctactaggttgaaggtagggtagactagtcagcagtagagattggaatgctggtaatctgtagcatctactgatggaagaattattaaattattgccttttgttactgggaaagatgcacctattaaaggtaatggctatgcttaagtaggccatgttgataggtgtgaagaatataatgacaataggccaggctgttgcttccaactgaactgaagagcacaaagcaagaaagtaatggggtcatgttttaaaatcctgattcaagtcctgaaaaaagaactggagcgtttctatgagtgccctcaaaagaatcttgtattcctttgggtttatgtaactaaacatcaaatccagagactgattctgagttgatgaaataaaatagagagaatttagagtcttgccaggccctgactaaacacataagggtattggctgaaaaaaagttaagcctaaaaattcttaggtatttgaggtgacttagttgattttgagtattctgaacctccaaactttactgactgtctcagacaacactagcagctactccccaccacccatacagggctgatgagattcttcctgttttatttgaagaccttgtaatcagtgcttttgcaagagaacagctatactccccatatcccaccctaccatctatatgatctcaaacatacctcagtttgactcacagaaccaaaaagagattcaagtccaggaggagaagctgtttgctaatttgtattagcaaatatttaggacttgtttactgaaaactaaatataacagtgtcttatgttaagtgaagttaagatatcagaaattccttagttctgtataataaatgcaaagagcttaaaaaggtggcatggtcttatcaaatgccagtggctcacctgtacttaaacatgtacacaaagatgagaatgaaaatgtccacttcctatgatattgaggagcatcaaatatagtattagttctgattctctgatagaactttgactgatccaatgggtcaacaagtcatcatatgtgctatttgaactgctatcatgaacttgtaaaccacagagctgcgtgtgctcagtaggacaccaacatcaataggaaataagataaacaggattgggcctaagcatgttcaaaaggtctcaacatgttacataatcagattactaatactcccaatgtgcccagttctgtgggttcactgtcactttttctagccaaactgtgacttcataaagagttcctctagtatcaattgactgaggaaaaacaagtaagctttatttatagatgactcaatctaatatgttgacatcagccaaaagtgtattgtctcactcagggatactcctgaataacaatagctatgataatacatctattgggcaaaatgtaaaaactaaatatgatgatcactttgtttgaaaaaagagatgactgaggctttagatatacatcaattccatgggtaggagtcgatcatggtttggaaagatggttagaaacttggaattaaagaaatatcagaagattattaacaaggcagttttggtgatcgattcacgaatgaatttc

SEQ ID NO: 12361 - DNA, 69874 bp, Human
  misc_feature (1)...(69874): n = A,T,C or G
ctccttggcctcccaaagtgctggaattacagacctgagatgtaaaactatatagtcagacactaaaatatgcagcagaacgtatggctgcaaagcagtgcacggtggtggggtaggtggtgcactctcagagccaaaggagtgaatgagagaatagaatatattttgcttagaaacccaaataaataattttctgcatggttagcccccccttttttttttttggagacagggtctccctctattgcataggctggagtgcagtggtgtgaacacccgctcactgcagtctcaacctcctggtctcaagcaatcctcccacctcagcctcccaggtagctgggagcacaggtcatgtgccaccccgcttggccaattttatttttaatttttattttttgagacagagtcttgttctgttgcccaggtggagttcagtggcatgatctcggctcactgcaacgtctgcctcctgggttcacgtgattctcctgtctccgcctcccgagtagctgggactacaggcgtctgccaccatgcccggctattttttgtatttttagtagagacggggtttcacgttgttggtcaggctggtctcaaactcctgacctcaggtgatccacccgccttggcctcccaaagtgctgggattacaggtgtgagccaccgcggctggtcaaaattttttttttttggtactttttttgtagaggcggggtttcgacacgttgcccaggctggtcttgaactcctgagctcaagctatccatccacctgcctcggcctcccatagtgctgggactacaggcgggagcacagcacctagccccttccttttcttgtctctgtgaatgaggtttggagccgagacactgaagtatagataattgcaaaaaggtatgtttttgggagatggggcattcctttcttatctctgcaacttgcatctcccagacgctcctgaggagggagggaaagccagggagccccagagctctccgggatccagggaggaaaccatggctggtggcagccagttctgtgttcagaatgtgcttgctgtcaagagtgcaggcctggaattccagcctggccacaggccaaggagggaatggacccatcctgcgcatggtgtggggatgagaagcagagcccaccacgggtctcattcccagacccatccggtaactgtcagtttcagtaactgtgaagtctggggcttttggggtggggggctgcaggttaagtcctggggagagctagagctaccttaggaccctccccttgaatgttccaggcagcaacccccctctcttatttcttcccccaccaaaagaatgcaggccactaggagtgagtgaccagcgcctgcgagttagagctattttgggcaggagagcaggcgtcggattccagtgttccaggcagggggaggggacgagggttaggcctgaggcgctttccgactccccagcctgctgtgggcgaggctctaggagatgagctagcttcccgctcctcctgtccctggcctcagtctcccatccgtgtaagggccgggcagcaaggctttcatcctttgcaattgagagaacgcttcctgattgttctcatggcttagaaataccccttgatttgcattcgaaggaaataaggagggctgaacgcagtcgacgggtggccagttgctgggccagttcgcagtcctgactgtcccttgattagtcttagaggcccaaaggcctgaagttgggcggggagcccctcccccacactactggttctgaaggctccgagtgaccgggaccgaccgccggggtgtgtcccgggacggacttccctggccgtgggggcgaggcttccataatggggcgtgacttttagggcgggggagtggctagccaatgagcagagaggtgcgggccggggcggggcttgcgcgcgggtgcggcgcgctgcggagcggccgacgcaggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggtgagtgcaccgcccgccctatccgctgtgcctggctgcttgggcccccatccctgctgccggctgagccttccgcggaacacctgctgctgctcgctgttcggcccggggcggggacacggccgcggacgtccttgtgggtgaggaggcggtgccgcccgggcggagccgcccctttgctctgggtcccgcaggcaaaggctcggagcgttcggctgcaaggcccgggccgcgcgccgcggcgatgggccaggccttagctcggcccgcgctcccgggaacgtggagcctgcgccttggccgcggtcgtgagccgcctgcgggccgcctccctggcttccaataggggttgtggcccagttgggccggattccgactgtggggagtcgagccccgctagaggcagggaagggcaccgctgccgccactgctctgtcagagctgctcagagccttggtgggttccgtcatccttacttgagctcctttggaagcttgtttacttactaccttttcactttgtatttggcagacctggttcacctgcgagtgtatttggatagtgtctccacagaaaatgtcgtctcggcttggaatctttttgccataaattctaagttagtttcctacaaactcaactggtaacttaaaatgcatcctttaatctctataacttgaaaagttcttatttttgtaaatcgagttgcttcagaattagttttaatggtgacgatgaagttttgactggttgaggcaagagcctgggacagcaccttcatagcgcagagtctaacttaagattctagcctgctgcttccctaaataagcgagtagaagtgactcctggcatagaagccagactccgtgaagggaaggtggtgtttataggacataattccagataaagagctggatgtgctttcaggtgttttgcaaagtctggtgtagatggggtattgcagttttatcaggttctatgcttagttaagttcagagacattattttggaatgttcctgttctaaaaaagaattcaaccgtactacattttggaggcataaaaatccatagtttgagtatggagaagtttagttgaacttttgtgggttttttttgctgtgaactaaggaagaagagctcatggcctgtgtcctgtattttggagaaatcagatttcagtagggagttggatccatcatgtgaagaccctatgggatataaaagcttgtgctgacatgtgcttttgttaaaagaggcacagtgcaaatcctcactgttcttaaaaattgattttgcaaaatgcatttattcatttgaacaaatattttgattcactacctgccaaattctgtggtagatcctagggacccatgtaaaagagtctgcttctgcccttaaggaattcagtttagggggcagtggggaccggggaacccatgattaatagtgtctgcccgctaagcgtgctcacatagtagcctgaggagagagggaattcctgagctgtggttttcagggccagcaggaattagtgggggacatcaaggcctggacacagggaaccacatgtacatgagcacctaaaatagtgcttgggagtcctccagcttggcaggtgcgagctctgggcctgccttgtgctcaggagttccaactttgtatgcggggtgcaggagtctggggagccttttaatcagtagagtggtgtgacccagacctgtgtttagaaagatattgctggtggagtggcaggaagagggagggggtcaggacctctggcagttaagtcagctaacagaggagaggtggggagggagaaggagccatcagaaaagagagactgaaaaggtagtacagaggggatgtcctgccatgatgggggaggagctacattctggaatgcatgggccagaagaccaagcataaccaaggatttaaattccttgttgactacctggtatagtgacctacagagttgcttgtgtctggttagtgttgaggatggtgggatttggagggaccacttagggaccacttagactgccgtcgatgcataggaaaggaggcctggcatttgattattaaaaactttatcgccgggcacggtggctcccacctgtaatcccagcagtttgggaggccgaggcgggcggatcacgaggtcaggagatcgagatcatcctggctaacacggtgaaaccccctctctactaaaaatacaaaaaattagccgggcgtggtggtgggcacctgtagtcccagctactcaggaggctgaggcaggagaatggcgtgaacccgggaggcggagcttgcagtgagttgagatagagccactgcactccagcctgggccacagatcgagactccgtctcaaaaaaaaaacaaaaaaggaaatcccagcgctttgggaggccaaggcgggaggatcacttacctgaggtcaggagttcgaacccagcctagccaagatggcgaaaccccatctctactaaaaaaaatacaaaaattagctgggtgtggtagcacgtgcctgtagtcctagctacttgggaggctgagacatgagaatcgccttaaccccggaggcagaggttgcagtgagccaaaatcacaacactgcactctagcctgggccatagagcaagactttcaaaaaaaaaagaaaaaaagaaaaaaagaaataggccgagtgcagtggctcatgcctataatcctaggactttgggaggctgaggtgggtggactgcctgagctcaggagttcgagaccagcctgggtcacatggtgaaaccccatctctactaaaatacaaaaaattagccaggcgtggcagcatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgaaaccccgtctctactaaaaatacaaaaaaaaaaaaaattagccgggcgtagtgttaggcgcctgtagtcccagctactctgggaggccgaggcaggagaatggcgtgaacctggaaggcagagcttgcagtgagctgagatagtgccattgcactccagcctgggcgacagagtgagactctgcctcaaaaaaaaaaaaaaaaaaagtgaattgtgatttacagttttgtagaagcacatttatcaatgtcaagtaaggcagatttgtactgatttttatttttaagtattgtgcacgttttctgtagtcccttttctgtgacttgcatggatttgtgatttttatagccatgtggagacctagtctcagtgttccctgcccttggggacatgaggagccacagattcattcttgctgaggcagtcatggcccttggataccctaagtataggggagtgtgccagttgtggggagctcaaggatgaatgaagcacttggaaggatatgtcgtattcagggaaacagtagccagtgcccagcttgattcccctgttttggcatttactcttcatttctatagatgttgtttttgtatatgaggtatgagaatctacaaacaagcacctcttatagagttctttctcctaatcggtacacagttttctgtatctataggttccacatctgtggattcctccaactatggattgaaaatatttgggaaaaaaggatggttgcgtccgtatgaaacatgaataaacttttatcatcgtcatcatttcctaaatgttagaacaactattttcataccatttacattgtattatgtgttataagtaatccagggatgtttaaagtatacaggaagatgtttaagggatccagggctgtgcaggacgtgccttgttaacaaaatgtttacaagcagtatacttggtaaaagtcatcgctattctctagtctcaataaactggggacacagtgcattgcggaaaaccacagggacctctgctcttgaaagcggggtattgtccaaggtttctccccatgtgatagtctgaaatatagcctcgtggaatgagaaagacctgaccttcccccagcccgacacctgtaaagggtctatgctgaggtggattagtaaaagaggaaagccgcttgcagttgagatagaggaaggccactgtctcctgcctgcccttgggaactgaatgtctccgtgtaaaacctgattgtacatttgttcaattctgagataggagaaaaactgccctatggggggaggcgagacatgtttgcagcaatgctgccttgttattctttactccactgagatgtttgggtggagagaaacataaatctggcttatgtgtacgtccatccagtcacagtaccttcccttaaacttaattatgacgtagattctattgcttacatgtttttgtccttattatgatgcaaatattacaccattttatataagggacttgagcacttgtggattttgatatcctggaaccaatccctcatggataccgagggaagagtttgtaaatgtattaaaacaaagtagtggaattggaatcaaattcttttgattttgtaggtatctgtgtttagccttttcactgtgctgtgaagatttcccccccaggcatcctaggggttgatgggagatttacttaagattcccaaggctgtctagggcagaagtgaaccagttctgccttggttgtcataaacacctctgttaattagctcagttgttctccagggatagattgattctctagctagcttttgccaagaaaaatgatccagtcaataatggaattccaaataagatttcctttttatttggctattaatcagaacctgggataacatccattttctgggccctgattttactatggaatatttccataaaacatgcatgtgattactgtaaatgtcctgtaaacactcctgcttgggctggtaggtcatctttttttttttttttttcttttgagacagttttagtcttgttgcccaggctggagtgcagtggcgtgatctcagctcactgcaacctctgcctcccagattcaagtgattctcctgccacagcctcccaagtagctggaatgatacaccatgcgccaccacacctggctaatttttgtatttttagtagagatggggattcttcatgttggtcaggctggtctcaaactgcgacctcagatgatctgcctgcctcggccttctaaagtgctgggattacaggcgtgagccaccatgcctggactgtaggtcacctctgtgtccagtctgccagaggtcagggatacgttgccgtctaggattttttatattggagaccagtctgatgagtagcccttgagcagggactggattctaagtcttggagaaaatgagtaagttctacctcttatgtgaggtatgattgaagaaattgtgttttctttgttttttgagaggcagggtcttgccctgttgcctacctggagtgtggtggcataatcatagctcacttcagtcttgacctcctagggtcaagcaatcctcccacctcagcctcctgagtagctgggactactagcacgtgccactgtgcccagctaatttttaaatttttttgtagcgatgtggtcttggctatgttgcccaggctggatcctcctgcctcagcctcccaaagtgttgggattacaggcgtgagccaccacacccggcccagaagtgtcttatatttttagacttttgagcagtgttggaacgattgaattgcctgagtggagaaatttggtaggaagagagtagaagagaggctctttattaaagacctaaaaatagaattcattaaagtcacaaatagataacagtaggattcctgtctaactctctcctgctttgggtttgtgctaccagctgttgcgtttgcttacctagaaaatagaataatattttgtcagaagggtcaacagtatggtcctaaaacattgtgtttgcaagtctgaggatgtgctttttccaattttaaaagtagttagaaagtgaccagattctttcatgtaggggagaaatcttagcaggagacgttggttcttctgcttgtagtgccagccctaacctgacaggtcctgtggggacccctgtctcttcagagccctgagcctttttcccttctagttggactttgctgactagagagggatatcctatgtaggccacctgattacctgatttaatcagatggtacctctgttattttggagaagagagtctccttttgattctaatagctgaagataaaaatggctccgtatgctttcttcctgtggagggctctgctgccctgagctgcctgtgccctttacatctgtgtgagggggtggaggaatgtcctggcctcctcacttccatcctgctatgggcttccaggaagaatggggtccattgtgggctgtacccaaaggcacagtcctctgcctcagtgtcaggcttactgtggtctctgtgcccagtttgctgtggtcactgggtgccaaggggttgggagctcaagaagccattgctgcttttttttttttttttgagacggagtcttgctcttgtcacccagcctggagtgcaatggcacgatctctgctcactgcaacctccgcctcccaggttcaagcaattctcctgcctcagcctcccgagtagctgggattacagatgcgcgccaccacattgggctaatttttgtatttttattgttattattttattttattttatttgagacggagtctcgctctgtcgcccaggctggagtgcagtagcttaatctcggctcactgcaagctccgcctcccgggttcatgccattctcctgcctcagcctccggagtagctgggactacaggcatctgccaccacgcctggctaatttttttgtatttttagtagagatggggtttcaccgtggtcttgatctcctgacctcgtgatctgcccgcctcaggctcccaaagtgctgggattacaggcgtgagccaccgcacccggccaaggacggagtgttgttctgtcgcccaggctggagtgcagtggtgcgatcttggctcactgcaaccttttggagacaaaaggcctttgttgtgtctggcctttatctttgttgtaatgaccctgaaaccgtggcctgagtctttgaggtggaagttgccctagaaatgtcatgtaatataccagaatttatcaagcctttctctagtactgggacacttaacatgtgcctgtggtacttttgtttgttttgctattatttcacatttaatttcatttttgtaaataaataattttgaagccaaattcagatttttcatctttatgtctacttaggttgcttagacctaatgtggtagatcaggttttgtttttgttttctttcttttttttttttttttttttttgagacaaggtctcactctgtcacccaagctagagtgcagtggcatgatcatggctcactgcagtctgaattcctgggcttaagcaatcctcctgcctcagccttctgcaaagctggaactacaggcatgtgccaccatgccagcctatttttttttccttttgtagatacatggtcttgttatgttgcccaggctagtctcaaactcctagcctcaggtgatcctctcatctcaaccttccaaagtggtgggattacaggtgtgaaccaccatgcccagcctgttttcttgttttgaatccaagctttctgagggttgtcctttaggaggagaatgtaaggaattccagagtcagggaggcatgggctgtgctctgggagaggcctggggaggcactgctctggaactgcctgtaggagtggtgtcagactgccagcagaagccagggtggtgaggggagggctgaatgttctgcaagagagatttataccactattttctttttcttttatttatttatttatttatttatttatttatttatttatttattttttgagacggagtcttgctctgtcgcccagactggagtgcagtggtactatctcggctcactgcaagctccgcctcccaggttcacgccattctcctgcctcagcctccctggtagctgggactataggcgcatgccaccacgcccggctaattttttgtatttttagtagagacagggtttcaccgtgttagccaggatggtctcgatctcctgaccttgtgatcctcccgcctcagtatcccgaagtgctgggattacaggcgtgagccaccgcgcccggccctttttcttttttttgagacagagtctcactctggagtgtagtggcatgatctcggctcactgcaagctccacctcgtgggttcaagtgattctcctaactcagcctcccaagtagctgggattacaggtgtgcatcaccacgcctggctaatttttatatttttagtagagacagggtttcaccctgttggccaggctggtctcgaactcctgacctcgggtgatctgcccacctcagcctcccaaagtgttgggattacaggcgtgagacactgcgctcagccggatatgaatattcttgacggtgtcttctgggtatatacctaagagtgaactgttagatatatagtatttgattttttttgtttgttttgttttgctttgtttttgagattcagtctcgctctgttgcccaggctggagtgcagtggtgtgatcttggctcactggatcctctgcctcccaggttgaagtgattttcctgtctcagcctaaccagtagctgggattacaggcgtgtgccatgcctggctaatttttgtatttttagtagtaatggggtttctctgtgttgcccagactgatctcgaactcctggattgctcaagcaatccacctgccttggcctcccaaagtgctgggattacaggtatgagccaccgtgcccggcctgatgttttaattattgagaattttgtattttttgtagagatggggttcttcctctttgcctaggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttggtaatatgaatttagaaaatgttaatgttttccagaacagtgaaactacaatataaaggttagacttgagaaccaaagttactctctagcttccctcttctgcccttcatgtgctcagcacttgtatctgtgttctcactacccctgagccctgagttcttctggggttggcccaggaggtgccttggttcagagagatacctgggaggaaaccacatggaatcaacaacagtactacatatttgttattatttggagtaattagccccatacattcttttttttttttttttttttgtttgagatgggatcttgctctgtcacccaggctggagtgcagtggcgtgatctcggctcactgcaacctccgcctcccgggttcaagcgattctcctgcctcggcctccccattagctgggactacaacaggctcccgccaccatacacggctaattttttgtgtttttcatagagacggggtttcaccatgttagccaggatggtctcgatctcctgacctcgtgatctgcccgcctcggcttcccaaagtgctgggaattcagacgtgagccaccacgcccggccagccccataaattcttgatagcaattttcctgaggtactcaagttttactagaaaaacatagcatcatgttttgattcattagttgtctagatgctcaccctcctgtattatcattctggctaactattaagtaccattactcccagattgaatttatgacacctgctgcccaccatgcccattaatcaaacaataagggcagggcaaactgctgtctcatgttgtttcaaactgccccacctccttcctcttccatcttatgttattaatgaaagagtttgacaatacttaaatgttagtgaaaataagagaaaagtcgtttgtatctttaggtgagggtgtaaattgaaggacattttgccaaatctaacaattccaatgtacatatcctttgacccagcaattccacatctaggattatatccttagatatgttctaagaagaatgcaaggatgagtgtgagaacaccctggagagcaagatatgcaagatacttagacatttagatgtgccacacacaataggtgtgaatgagaagaaggatctacccactggggctgaggtctctcagttctgctaaattagaaaaaggaacggttatttatttttttttttttgatagggattctcattctgtctcccatgctggagtgcagtggcgcggtcttggctcactgaaacctttgcttcccagggtcaagcgattcccctgcctcagcttcctgagtagctgggattacaggtgcgtgccactatgaccatctaattttttatatttttaatagagacggggtttcaccatgttggccaggctggccttgaactcctgaccttatgatctgcttgccaggtgtgagccactgtgcccggcaaaaaaggaacagttttgaagaatttgatttcatttgaactttaagaatgaaattaaaagagatgtgcttgtttatgtgtttagagatatacattcaatgtgtcatttgtggagagctactgaagaaactcagtctgctcacctgaggacctgggaaggagacctgcttttcatttgtgtcctagtgtggtgttggaatttattttacctccatgtgaattaccttttttttttttttgagacacagttttgctcttgttgcccaggctggagtgcaatggcgtgatcttggctcaccgcaacctctgcctcccggattcaagcgattctgcctcagcctcccgaatagctgggattacaggcatgtgccaccacgcctggctaattttgtattttcagtagaaaaggggtttctccatgttggtcgggctggtctcgaactcccgacctcaggtgatctgcccacctctgcctccagtagtgctgggattacaggtgtgagccaccgtgcctggcccttgaattacttttattgcattaagtcaaaggggaggaccagatagttgatgacatcattgtgagatagactgggaaccaatagtagggaatcggatactgggaaacactggatgcagcgtgcccacattttgcccttagctctggggacctcttaacttggtaatgatctgatttgggttttttttcctctaggagggaaggttcctgggaagggaagatagaatctatttttaatcttaagaaaacatagctcaatgtagtaattttgggccctagtgtgacattttcttccattataacccaagtcacttttaaaacaaaatcctttttttgtatattttgtgtttgtaatgtttctagaggaaaatgcttttaaagtatcctcacttcccttcgtaaacttgggagggcttgggacctggtggggtatgtgttttgaatcatgctgtctgggggattagtgcctggaatccagattcctactggacaaagcgctggggtttgaggtaagtggggtggggtagggggagggttatatagctgtcacagattacagagcttacctgctgactgcttcacaattgttggtacatacacctgctttggcatggacgtcctgagagggggcttggaccatgacccgtgttcctttctcttaccacttgtttttttccattttggctgggcgcggtggcttacgcctgtaatcccagcactttgggaggccgaggcagacggatcacgaggtcaggagatcgagactatcctggctaacacggtgaaaccccgtctctactaaaaatagaaaaaattactgaggtgtggtggcaggtacctgtagtcccagctacttgggcggctgaggcaggagaatgatgtggacccgggaggtggagcttgcagtgagccgagatcgcgccactgccctctagcctgggcgacagagtgagactctgtctcaaaaaaaaaaaagttttttttttttatataactttaaatttacagaaaaattgcaagaataattcaagaaactcccaaatactccatctagagtcaccatttgtttgcattttgctgtgtttgctctgtcattctcttttctatctatacctttttttctgaaccatctatgagtaattgacagaaatcatgcctctttattcctaatttttttattcttttattttttttttttgggacagggtcttgctctgtcacctaggttggagtgcagtgatgagatcttggcttattgccacctccgcctcccaagcttgagcgatcttcctgccttagcctcccgagtagctgagactgcaggtgcaggctaccatgctggcctaattttgtatttttttgtagagatggggtttcaccatgttgcccaggctggtctcaaactcatcagtgcaagctatctgcccttctcagcctcccaaagtgctgggattacagacatgagccacaacctggcctactcctaaattctttttttttttttttttttttttgagacggagtctcactctgttgtcttggttggagtgcagtggcacgatcttggctcactgcaacttctgcctcccaggttcaagcgattttcctgccacaatctccctgagtagctgggactacaggcgcgcactactacgcctggctaatttttgtactttagtagagacaggtttcgccatgttggccaggctggtctcgaactcctgacccaggtggtccgcctgcctcagccttccaaagtacaggcgtgagccaccacgcctggcatttttttctatttttaatagagatggggtcccactatgttgccggggctggtctcaaactcctgggtttaagtgatcctcctgcctcagcctcccgaaatgctgggattacaggtatgagccaccgctcccagccaagttgtttttttttttttttgagacagagtctcattctttcgcccaggttggaatgcagtggcgtgtttttggctcactgcagcctctgcctcctgggtcaagcagttctcctgcctcagcctcccaagtagcagggatcataggcacctgccactatgtcctgctattttttttttcttttttttgagacggagtcttgctatgttgcccaggctggagtgcagtggcgcgatcttgctcactgcaagctctgcctcccgggttcacgccattctcctgcctcagcctcccaagtagctgggactgcaggcgtccgccaacacgcctggctaattttttgtatttttagtagagatgtggtttcactgtgttagtcaggatggtctcgatctcctgacctcgtgatccgcccgcgtcggcctcccaaagtgctaggattacaggcgtgagccaccgcgcccggcctgtcctgctatttttgtatttttagtagagacggggtttcgccacattggccagtctggtctcaaactcctgacctcaagtgatcctcccgccttggcctcccagagtactgggattacaggcgtgagctgcctcgcctggccccaagtctattcttttttnnnnnnnnnnnnnnnnnnnnnnnnnnnnnnnnnnnnnnnnnnnnnnnnnnnnnnnnnnnnnnnnnnnnnnnnnnnctggagtgcagtggtgagatctcgggctccctgcgacctctgcctcccgggttcaagcaattcttctgcctcagcctcctgaataactgggattataggcatgggccaccaagcccagctaatttttgtatttttagtagagacagggtttcaccatgttggtcaggctgttctcgaactcctggccttgtgatcttcctgccttggcctcctaaagtgctgggattacaggcgtgagccaccgtaccccgcctggctccaagtctattcttaagaccacagaacttttgatttaagattcactggacagatacataacaatacataaaataaatgttttatttacaaaataagacctttaagtagttagctgccagttgaaataatgatttggactggatgtggtggtttatgcctgtaatcccagcattttaggaggctgaggtgggagaattgcttgagcctaggaatttgagaccagcctgggcaacgtggtaaggccccatctctacaaaagataaaaaattagccaagtgtggtggtgccatgtttgtaatcccagctatttgggaggctgaggtaggaggatcaattgagcctgggagggtgaggctgcagtgagccatcatcgtgtcattgcactccagcccaggtaacagagtgagaccctgcatctttaaaggaaaatttaaaaagagataaatgcaggagatcttccatcttatcaaaagggtgctgttataatttatatatttttaagtactggatggggaggtggagtagcagctccaaggtacttttcagtggtggccttaatctgctgatgcatggaaggtgtgttcttcttccagatagccctgggatctcctgaatttccaggttgggctactcaggcatggattgactcctacagttcaggcggatggagatcccaccaacccacagcttaattcttcagatgctttatcttcatttctcatgtatcttcagttggcttctaatgtgagcacataaatgccctgcagaatttctttcccatctttgtgcaaatcattatttttattccttttttttttttttttttttttttgagacgacagggtcttgctcagtcacccaggcgggagtgcagtggcatgatcatggctcactgcaacctcaacctcccaggctcaagcgatcctcccacctcagtagctgagtagctcagattataggcatgcgtcaccacactcagccaattttttcatattttgtagagacagagtctccctgtgttgcccaggctgatttcaaactcctgggctcgagcaatccatcaaccttagcctaccaaagtgctaggattacaggcatgaaccactgtgccttgcctgcttttcatttttaatccttgggttctaaaatgcaagaattaatttccaaataattagtatggaatggaatcccactttttcctgtgtgctgagagaatgatcaaagatcacagaaaagagatggagacagaagaagctgagagcaagggcatctttaaggatttcttcagtcttgttaatctgggtgtaaattctgtgtggctgacagcctctgaggatcccttgaagttttgaggaggaggaaagcgcttgagagtaatgggtttacttgattttactttgtatagaagagcctgaactggacatatctccaggtatgtgctgtggtctttaacaagcagcccaacatcctttgctggggaaggccagcaatgtgggagctagtggggcctagcccaggagccttgcgttcaccaggtcactgggaactggtgctttctgatgcacctctatgcaagcctgattctgaagtcagatgtggtgggcatccctgtccatagtgttggcctggcccaccatttcactggtcatagaatggctgtagctttgcagagcagggattgcgagaatggaagaatgtcttttggctcttctgctctagcttttggaagtacgtcagagaagtttgtgattttttagaatttgtagctgtggcaaggctgaagcaggtaaaagggccaattagaaccatctgtgggagggaaggaattctgttagcaggaaggaaaacctgagcaaagggagtgggtggtagttttgtcttgttcttttataaacacagtgtgttgatatggcagttcctggcatgggtgaaatatttttgatggttgagcattaagaatgtagccaaaaacaagaatgtggctaaaagcaagtcaccactttaaacactgaagattgaagcatttgcctagataaatattctgcagtgaatatgccagaattcccacatacctgtttggctcctgaggcattgtgcttagggtcccaggcctttattacagggctgctggcagggtcaagggctgggttgcctggagcttccctgacatttcgcctcactcctctgttttggagtctaattggccaattaggtcagaaaggccaccagccagcacactttttctaaatttaattcatcattgctagattagcatattaattttgagctatggcacttatttttaatctttcgtagtgtaatggaaaaaataccagaaagctcagcattgaacttcaaagtgtgaaatcaagtgatcattgcctttatgcttggtgaattattattattatttttttttttttggagacagagtcttgcactgtcatccaggctggagtgcagtggcgtgatcttggctcactgcaacctccgcctcacaggttcaaacgattctcctgcctcagcttcccgagtagctgggactacaggtgcctgccaccacgcccagctaatttttgtatttttagtagagacggggtttcaccatgttagccaggatggtctcgatctcttgaccttgtgatccacccgcctcagcctcccaaagtgctgggattacaggtgtgagccaccggcgcttggctgcttggggaattatttaggggatttagtggaatttcctttcctgtactctgtgggcatctgctgagtacctgcttggtgccaggcatctactgggagagaaagcagcagagtcaatgctgtcaagacccctgcagtggacctcttctcccccttttctctcaagggaaccattggcatccagccttgacccccagtagacactgatcatccagcccccacagggtagccccactgtacctttgtactgagttggtgaggggatgggatagccagggggagtttggggaagtcagaaggcaactttcagtttctattagagtaagcacttggaaaatgtctgtttataatgtattagtataaatacttggtttgttaccacttgtgtttcctgatttagtaatgtatataaatcttaattgaatatttttgtgtgaaacttggaaagactgcatctatagcaaataaagcctcacacctagcacagggtaggtagttggtaaacatgtgctgaagtgttaattgttgggctgtcttcagagaattgtagtttgctttaattgcattttttgatgcaacgcgggtgcaagggtgtggtaattcattcccacttggattctgctgaggctggccacccacctctcagacttattcccccaccacctctccacctcctactctagctgctgcagccaaatggacagttagggccgggcacagtggctcatggctgtaatcccagcactttgggaggctgaggcgagcggatcacaatgtcaggagttcgagaccagcctggccaatacggtgaaaccctgtctgtactacaaatacaaaaattagctgggcgtggtggcaggcacctgtaaccccagctactcaggaggctgaggcaggagaattgcttgaacccggaaggcagagtttgcagtgagccgagatcgtgccacttgcactccagcctgggcgacagagcgagactccgtctcaaaaaaacaaaaacaaaaacaaaaaaacagaaaaaaaaaaaccccaaatggatggtttggcctggtccttatctttggcctcagtttatccttttctgtcttcagtgtcttacctgggcactggtgattaaagtactggaccatgtcatcacggggatatgcccctaaaagcctcctaaagtattttcttctgaagtctaattggtgtaactaagtaatgttttctaaaatattgtggcaaaatatacataacataaagatggtgtatttatttatttattttgctttgtcacccaggctggagcacagtggtggagtcatggctcatggcagcctcaaccttcccaggctcaagcagtcctcccacctcaggccaagtagctgggactacaggtccatgcctacgtacttggccaattttttaaatttttaactttttttttttttttttttttgaggatggagtctcactctgtcgcccagcactggagtgcagtggcgcgatctcggctcaccacaacctccacctcccaggttcaagcaattctgctgccttagcctcctgagtagctgggattacaggcgtgtgccactgcgcctggctaatttttttttgtatttttagtagagacagggtttcaccatattggccaggctggtcttgaactcctgaccttgtgatccgcctgccttggcctcccagagtgctgggattacaggcatgagccactgtgcccggcctaaatttttttttctttttttttttggcacaatctcggctcactgcaacctctacctcccaagttcaagcagttctcctgtgtcagcctcctgagtagctgggactacaggcatgcaccacaacacccagctaatttttgtatttttagtagagatggggtttcaccatgttggccaggatggtctccatctcttgatctcgtgatccacccacctcggcctcccaaagtgttgggattataggtgtgagccactatgcctggcctaaatttttttttgtagagatgggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaattaaaaaatgagccaggcatggtgctgtgaaccagtagtcccagttgtgggaggctgaggcagaaggatcacttgagcccaggagtttgaggttacagtgagctattactgtaccactgtactccaccctgggggatagattgagagactgtctctcaaaaaaaaaataaaaataaccccaaacccacctttttaaattgtgaaaaacacaatataaaacttaactatcttcaaagtcaagtatactgttcggtaataaataatgtttaacgcagtgtatggacttcagtggaatgtagaaggaattctttcagtgagccccattacgtaccatgttaaaatctactcagattaaaagccatggttcagtggagaatgactgttctgggttttgaaccttgcttttcttccctttccctagaacatgtctgcacctgggtggatttatacctaggttttaaacctttgcttctgtctttgttggaaaaaaccaaaccaccgccagcagaagccactgccctttgtttatctgtgataagtgagaatttgtaagaattttccaagtgagagaagtgttcaaagtagcttttatgtttgatagaatgtgtagtgcttgcctctcaggggtggtattttttctcccacgtatttttacctttaaatctcttgctgtatatgtgaccctggctccctttggttggtcctccagctccctgatggtcctggggctccctccatatcactggtggtatttccacattgcctgcagtttaggtaggaacctgtcccatgtcagggaaaccctatctgtcccctgaactgagcacttttaattttagggtgataccttgaatcttcaccagtcacttgacttcagacctttctcatctgacgccaaggagtcaaaaaggcctgtttttaactagaagcagagacatttgccatttttttttttaatatttggagctcaaataaacaatgacttcacaccactgttttccactgtgttgagtacatcctgttggccatgatattgagcagttttaaactggttaacctttcagaaactttatattaatgttggactgacagttaatatttaacttgtcaaagtgatttttgctagattgaacctgaagtggttaatatttctgctttttatgttttccaaaaccatttaaaataggaacatggtattttattattttaatctggtttcaaaatgaatatcccattttctttattattattattattaattaattttttttttttgagataggttcttgctgtgtcacccaggctggagtgcagtgttgtaatctcactgcaatctcaccatcctgggttcaagcagttcattcacctcagcctcccaagtagctgtgattacaggcatgcgccaccatgcctggctgaactttgtacttttttgtagaaacagggttttgccacgttgcccaggctggtcttgaagtcctcagctcaagcaatctgcccacctcggcctcccagagtactgggattctaggtgtgtgccactgcacctggccattccttaaatgttttaatgactgtggcaaatgatagcaatttaacagcttaactactatttttaggtagcgtagctatttgggagtaggggctcctaggagtggtgggatgggctacctctgccaaattttgtgtggttaataatgggttgagtctcccaacttttcttttattcttgggaagcaaaaactaatagagagctgttctttcagagtttttaggttaagatgtgtgaaagtttcagagccgggtacagtggcctgtgcctgtagtctcctatttgggaggccgaggcaggaggatcactggggagttcaaggctggtgagctataattgtttctgtgaatagccactgcacactagcctgggcaacatagtgagaccctgtcttaaaactaaaaacagaggtacttaaaaaaatatatatctgaaagtttcattcactgtgagtttttctatggatgaggaaacattaagtttatggcaaattgagttggtgccccatgtgcatttgttcttcacatctgttgagtggaaagcatttattaactgagttccctgtgtgcgtgggcactcatagctctggggaggcagcctgagtggaacagagccgcctgttccataaggctgtctggacagaatggggtcataagggcctggctcctcatgggcatctcccctttcctcccaccaagcaacatcctttggttgcatcttcctgggggatggtattggtggtggtgatgggaggggccagtgggatccttacctgctgaaccttacccttggatgcctggtgtccttgccagttactgtataatgtttttgatttcctagttatatccctgatgactgatctgataaactttaaatatacctgcctctagggtagctttaatatattttggctacaaaggtcactaccttttaggtattattgataacttgacattttacttcttcttctttttttttttttttgagacagaatcttgctctgtcgcccagtctggagtgcactggtgtgatcttggctcactgtagcctccgcttcccgggttcaagcaattttcctgtctcagccctcccgagtagctgggattataggtgtccgccaccatgcccgactaatttttgtatttttagtagagatggggtttcaccatgttggccgggctggtcttgaactcctgacctcgtgatctgcccgcctcagcctccaaagtgctggtattacaggcgtgagccactgcacctacctggcctgacattttacttctgcccatcacttgagagtcccacatatcacaactgggaggaagggagtgcctggtcattggcagatgcgagccacttactggccctaccccaactagctctggttcttctggctgagggtgtttatctgcagtgagtctcagggtctggggtctggggcagtgctgagagcttagactcagttgtgggtactgcactgggtgctggcacagaggaataaggttcccattcccactactcgaaaaagagcttctgtagctcctgtcagccagtggtgaatccagctaagacatgttcttgggctgccttgagcacttcctactctcttttagaggatataatgtgaatgagtgtgaggtgttaaattgggtagctgtgtcaggaagactaggtggctgtggccagaatcttgccagaatctttctgtggttcccaagcactcttttctcccacaagttctggccaccaagctgtatgtgaccacgactgagtatttacctctgtttggaccttggtctctgaaccacgaggaggaggatctctgtagcgtctctatctgaatgactgagtgtatgagtatgagactgtgtaaaaaaaacttccagagggacattctgatacaagtatatggatgcagcctatcagattcctagcacaggcagacatgacccttgcttataggaagccagcatcagaaagacaaaagggtgttttattaccaagttgcaaaaaatttttctccttagagcatggaaaaccaacacatagtagttggagttgtgccctgaacatcgcctgcctgctaaatgcagagcacttagtcatgcccatgaaacagacaccccatgtcgtcatgtgtccgcagatagcagacagcttaagttcctggtagggcagggtgtgtctcataactgactgtttttaaataagctgagaattttaaaattgagaatgagattggaatagtgaaagatcagctggatctaataagtgaagtaaagactaaagatgatgggaagaacctgaaaaaaaggtcctgtgtctccccattcattcattaggtgtatggtgtatgtctggcactggatgagtgctgggcacatattagtgattgcaacagatgtatccctgctctcccacaacttatagtcttgtgggggtgttggttgagctgagccatttactaaattagaattaaaatgcgtctgggcatggtggctcatacctgtaatcccagcactttgggaggccgaggtgggcagatcacccgaggtcaggagttcaagaccagcctggccaacatggcgaaactctgtctccactaaaaaatacaaaaattagccaagcgtggtggcaggtgcttgtagtcccagctacttgggaggctgaggcagggagaattgcttgaacccgggaggcagaggttgcagtgagccgagatcatgccactgtactccagcccgggtgacagagtgagactccctctccaaaaaaaaaaaaaaggattaaaatgcataagaaaggaaaaggccagtaaagaaaacactatgcaacagtaaagaaaactgtaggccaagcacagtggctcacgcctgttcccaacactttgggaggccaaggcaggaggattgcttgagcccatgagtttgaaaccagcctgggtaatatagtctgtatctcttcaacaaaatttacaaattagcctggtgtggtggcgcacacctgtagttccagctacttgagaggctgataggaggttttcttgagcccagaggttgaggctgcagtgagctgtgattacaccatttccagcctgggtgaccaaaaaaccaaaacaaaaactacacagaaaagagttgaagaaaaaccttcaacttggagcactttatagagatctgaggagaagaccctcaccagagtactgggactgctggttgttgagaaggagttcctggtggaggacccctcagacatcactggaagttaaatggttcttggaactgatgcccatagggctcctccatctatgtacatggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggattacaggtgcctgccaccacacccggctaatttttgtatttgtatttgtttgtgtatatgtatgtatgtgttgtttttgagacagggtcttgctctgtcacccaggctagagtgcagtggtgcagtctccgctcactgcaacctctgcctaccaggttcaagggattctcctgcctcagcctcctaagtagctgcgacttcaggcgtgcaccaccacgcctggctaattttttgtatttgtagtagagacggggtttcaccatgttggccaggctggtcttgaactcctgacgtcaggtgatctgcctgccttggcctcccaaagtgctagggttacaggcgtgagccaccatgcctggcatgtatttttagtagagacaagatttcaccatgctggccaggctggtcttgaactcctgacttcaagtgaacctcctgtctcagcctcccaaagtgctgggattacaggcatgagccactgcacccgcccgccaggcctcaaagtatttttctaagcctcattgttacagttgccacatgaatgtatctctatatatacatgtatacattttttttctttgaatcattttgaagtgagttgcagagtgtttgacacttcatccctaagtacttcaaaatacaattcataagattgaggatgattccctatagagtcttactaccatcatatcacctaagaaaaataacagtaaatcccatttccagtttacatgcaaaattcctcaattacccctttgggagctggactcatgggtttttttaaaaagtaaatccagaatccagtcaagagatacacattgtctgggcaagattgcttacctttctaatcctgggagactgaggtgagaggatcacttgaggccaagagtttgaggccagcctgggcagcatagtgggacactgtctgtacaaaagatttttaaaaactagctgagtggagtggtgtgcacctgaagtcccagctatttacttgagcccaggagttcaaggttacattgagctatgaacatgacactgtactctatcctgggccacagagcaagaaccttctctgtccccactcccctacccctagaaagatacacacatcaagtctggttgctgtctctaaatcgagaacagtcatcttatgtttagggatgtcagcatttggagagaccaggccagttgtttggcagaagatcccacattctagatttgtgtgattttctttgcatagctcccatatttcctgtaaattggaagttaggtctaaagcagtgccacccaacagaaatataacatgagccacatatgtcacttaaattttcctggtagccacatgaagaaaagcagattaaattaatttcaatcatatattttacttaatattttattgtttttttttgaggtcgagtctcactctgtcacccaggctggagtgcagtggtgcaatctcggctcactgcaacctccacctcccgggttcaagtgattctcttgcctcagcttcctcagtagctgggattacaggcacccaccaccatgcccggctaattttcatatttttagtagagatgggattttaccatgttggccaggctggtttcaaactccttacctcaagtcatccacccaccctagtctcccaagatgccaggatcataggcgtgagccacggtgcccgtcttgtttaatacatttctttattatttattctttgttaatacttattgtttacttaatatattttattgaatgtatctgactgtattcaaaatattactaatacatatcatttcagtttgcaatcaatattttaaaagtattaatgaggcattttacattcattttttatgaagttttcaaaatccagtgtatattttatatttaatggatcagctacatttccagtgctaaggagttgcacgaaactgttggtttctgtataagagaccatgggggtaagaggcttgatccaactcggggtagatgtttttgacagtaactcctggaggatagtatgtgactgaaccactggaattgctcaagtctaaacctgcttttctttttttttcaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtgagactggatataaagcataaatgaggaagagttctcatcttccattttagttttggtggcttttccttttcaagtctaagcttcaccaattctgagctcagttcttccagtacccccttagaagagggacagccactgatgttcataagagaatccctatatactcagaatagcatcctaaactgtattcttgttcctattctgagggcatcaccatgtaatagcctttactctggaagttctactgaacactgatttagggatttgttggaaaggtctgtcacgtgtatagggaaaggttacctttaataaaacacagagttaaaccccaaaaaataggacttttatgctttgaacttactttttaaaataagatataaataaatataggagttctgctctgatttgctgatgtatgttggctaatgtaattgatcacttaagaaccaaaattagtacccaaacttcagccttgccccatatcctttggagaagccatccagagaacaatggaatctgaggcccgtgtagagaagagtgtcttggttgacccaggatagaaatcaggtgaaataggaagcttttgtgtgatgaagcaccatctctctgtctgagtttgtggaaccatggaatttcccctagatcttaaatgagtttgtttcatggacaggtgggtgggatgtacccctcaagttatgaacatcttctagagcagaagtcagcacacttcacccaagctggagtgcactggcatgatcatgtctcactgtagccttgacctcccaggctcaagtgatcctcccacctcagcctcccaagtagctgggactataagcacatatcagcacacctggctaatttttgtactttttgtagagatagggttttgtcatgttgctcaagctagtcttgaactcctgagctcaagccatcttcctgccttggcctcccaaagtgctgggattgcaggcatgcaccactgcaccaagctccaggcagtaaatattttaggctttgcaggccatatggtttctgtcagaactcctcgactctgcctgtgtagtgttaaagtagcctttacaatatataaatcaatgggcaataaaactttacggtggatactttttcttttttaattttttacacttatagtcccattctgacttgaaacagatttttgaatttcatatgtcaagaaagaaatattcttttacaatttttttttttgaggcagggtcttgctctgttgttcaggctggagtgcagtggtacagccatggctctctgcagccttaacctcccaggcttaagccttcttccctcttcagcctcccaagtagctgggactacaggtgtgcaccaccacacccagctaatttatttatttatttatttttgagacagagtttcgctcttgtcgcccaggctggagtgcaatggcacaatcttggctcactgcaacctccgcctcctgggttcaagtgattctcctgcctcagcctcctcagtagctaggattacaggcgcacgtcaccacgcccagctaatttttaaattttaatttattttaattaattaattaattttgagatgaagtctctctctgtcacccaagctggaatgcaatgacacaatctcagctcactgcaacctccatctcccagattcaagtgattctcctgcctcagcctcccaagtagctgggattacaggtgcgcaccaccatgcccggctaatttttgtatttttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacatttagtgctctggctttctgttggtgtgtttaaaccaccaaaacagtggtttaactcaaccagcttgttttactcaacattttttggccaggaattcagagataaggaaccttatctctgtttcacatggtactaggtagagtggctcacctggggctggggaattcacttctaagttggctcattcatggctggcaagttgatgctgcctgttgacagggagcttagctggggctgttggtcagtgtccttgattcctcttcatgtagacctctccatgggctgcttaggtgtcctcaaagcacgatagatggattttaagattaggtatttcgagaaataggaaaggaagctgcccaatctcttaaggcccagaacttgcccaacaacacttccattttactccattggtcaaagcacatatagactctgatgggtgtttaccagcttgcccccgtgacccgtaagccccagccttctagattagaaatggccacaagttctatgccactctttccttgcagaggtgagtctgtgcccttttccctgaatctgggtggacctccccttcagcctgctcccttcttgtgttcgcctccttttccctgttggtcaccttctttttaagccgtggcttgttctcagagtgaccttgtggtctctggggcaaccgtatttctgaagatcttggcccatgtagcagctcacatgtagcagttcacagagctcttcctagtttgcagagtgtttgcataaagtttccttgtcatctttgtaatatcccagcaagctagatgctaatctgaccattagatacagagtggtggctctggaaggtacatttcttgctcagcttcagatttaatcctgaatatccataccctgcattggttgcctttgttccagtagccattggaatgttttacgtggattaatcttggccagaagtgccttgaactgatacagcaaactagatatttgttgtatttggcagagagatgtttaacaggcttatttaccaagggggtgaagagattttactgagaaaacaggattttatctgagcatatttatctgtggaaagcagaccatttagtagctgatgagcttgtagaaaaacagatgaagatgtgtgactcttcgttccagtcttaaccaccgggattatatgggttggggagtcagaaggtcagaaagcctgatcttgttcctagagctttggtttctgcatctgtaaagcaggatttagaaagtctttatattaaaggaatttttttcttattataataatgatgcataaatgtacattgtggaaaatatagaaagggaaaaaaaatctgtggtttctaccattcagagtgaagtcctctaccgttttctatgctcatcaagagatggtcatgccacatacacacacagacgtcttaacatattagacagacctaggatcatagtggatatattttttaaccttttttttttgagacagagtctcactttgttgcccaggctggagtgcagtggcacagtcccggctcactgcaacctccacctcccgggttcaaatgattctcctgcctccgtctcccgagtagctgggactacaggcatgcgctaccacacctggctaatttttgtgtttttttggggggatggagtttcgctcttgtcgcccaggatggagtacaatggcgtgatcttggcctactgcaacctccgcctcccgggttcaagcgattctcctgcctcagcctcctgagtagctgggactataggcttgaaccaccactcctggcatatgtgtgtgtgtgtgtgtgtgtgtgtgtgtgtacacatacatagacacacacacacatatatatatattttttgagatggaatcttgctctttcgtccaggctggaatgcagtggcgtgatctcagctcagtgcaacctccgcctcctgggttcaggctattcttctgcctcagcctcctgaatagctgggactacaggcatgcgccaccacacccggctagggtttcaccatattggccagactggtctcaaactcctgacctcgtgatccgcccaccttggcctcccaaagtgctggggttacaggggtgagccaccttgcccagcccacgttttgtatttttagtagagatggggtttcaccatgttggccaggctggtatcaaactcctgacctcaggtgatctgcctgcctcggcctcccaacgtgctgggattacaggaatgagccactgtcccgggcctattttttttttttttttaacatttttcattcactgtagcttgagtatttttttacctgtagtcattaaatgttatgtgggaatgtaacttttaatggctgcctaatattcttgtgttgttttttttttttttttgagacagggtcttgctctgttgcccaggctggagtgcagtggcactatcatggctcactgcagcctccacctcctagcttaagcaatcctctcacctcagccttccaagtaactgggactataggtgtgggccaccacacccaggtaatttttaaatttttttgtagagatgggtctcactttgttgcccaggccggtcttgaactcctaggctcaagtgatcctactgcctcagcctcccaaagtgctaggattacagacatgagcatcacgcccagcctgcccactattcttgagtgtgtgaggaacatttcagatattggtcctaaggatgcttgttgaggcgaccccagtcatcttgggcccactggtactgcccttcatccaagctactgcttgcttacttcttcctaggctccccctgcctttgttcttgacctctcaatttgttctccatattgagtcaagagatgtctttatctttctaaagcttaaatctattcaaaatccctttttactgagctgcaccaagaatcgaaccccatatgatctggcctgtgacctcctctcccacatctttttctttgtatactttgtcccagccacactggtccttttctgcccagtgaacacacctagcttagggtccaccccaagcttttgattctttcttcttttgtcatgggtacagccatatctttcaggctcaacttggacatcatctgttggagccctttccttccaccctggtaaaagcagctttcccacaaaactctgtgtcatcttcttcttagcagatttctgtatttgaaattcttgttttttgttagtcatgtttgccttccatcacatagtaggccctcaaatgtttgtaggctggcaaagggaatgaggactcatttagcacctgcaaacctgttttggattgtcaaagcctgccttgctgtatgcagggagaaatgctagcctgtgctggggcagcaagagactaagttcacctgctgccccacagtgtactatggtcttgccgtgttttgaggcctcaggccctgtgacacacacactttcaaatgacttcttgttgtattttcacattggaaagtggccccaccctgtccctctaacacttgactgtgtgtttattgatccattattagtacaaactcactgtttcctaatattcaatagtttattgctcatcttaattattgtggtgttcaaattgtcccagatttgaccattgggagcccctttaagttggttcctgtattcttgtgatatgcccctgtcaatcattaagtgcttccttactttctgggataagatgctccaggcctgtcttgtattcaccctccctcagccatttcttcaaggagcctgattcctttttgtggtgaatgttattgggggttcagatctgggtgctaggtgagttcattgccactgggatttccttgcttctttgagccgttcagcagatagtgtggctccatttttagatgacaaagtggtagctaagtgacttatctcggagcacatagcttgtagggacagagttagtttgtagggagcacccaagaggcttttttttttttttttttttattgagacggagtctcgctctgtcgcccaggctggagtgcagtggtgctatctcggctcactgcaacctccgtctcccaggttcatgccattctcctgcctcagcctcctgagtagctgggactacaggtgcctgctaccatgcccggctaattttttgtatttttagtagagacggggtttcactgtgttagccaggatggtctcgatctcctgaccttgtggtccgcccgcctcggcctcccaaagtgctgggattacaggagagagccaccgcacccagcccccaagaggcttcttgagcctgtagtatataaggtcttatcttcaggtaactgacctgtgtttattttgtgtgtcagcatgctttggaattataatttaatgctttgttctagtcagttttagaagacttccctcgtagttgtctgttaccgtgcctctgacctctgacactgcagggctgtggaagagagagacacactgggtatgccttgacatggatggtgtcacatgtgatgagacgggtttgtacaacctgccatgcatgtgggcatctttgagccagagcagaagctgacctatcattgggcccaaaactgattgctaagtaaatggctggtttacagttctggcttttggaatgaaggctgcaggaccacaggtttggaagatcagggccaaccttgatgaaagtgaaaggagagtctgagtgaaaggtgatgtctggctggtaagctatcattgttccctgtgtagggttctagatacttggcataggacctgtttcgaagtagatgcctaattaaaggcttgctatgtgataaagcattaacagaggtggagcaacaacggtaagacatgtgggacagtggtgggttgcagagctccatgtggggaatttgagaagttgttgggagcacatggagttgggctcctcagcagagaaaggccagtgcccacatgtggcagggttgtcaatttgagtgaaagtaaatggagagagaagtgggtccgtaaggggcttttcaaaggctttcttccccaagtatcagaggaagaagaagctggtgaagaactgaggtaggaggtactgagcctggcctgcttcctcctaagccccatgtgggatgtccagatgagggttggtctatttgggcagggctgagttgccaaatgaagactcaggtggaacgtgatctgcatggtctgtcccaagacctggtgagattagatggcatagttgtcatacttgctgattggttaggggatatgcatgggggttgacggtagaataatccagtgtttatagcacacttagatgctggtctgttgaagggctagaaaattaagttctcattctaagtgagctgtgttgactgcctgaaaagcctggcctgacctgtgtgggcttctggttactttatttcaggaggttgtgctgcctggtgtcagtctgttgatatacccaacaaagcgcctgaagcaaatgcttcgctacattttatattggtgtatactttacacgtcagtctgcagggtcaggagaataaagaagggacctgcctgcgcagagggtatagccccaagatcctggctcttctgctctgccccacacctgacactccttcatgttctgacagctcttgtccagtctcagcctggccagcacttgttgcttaaccaatgctgttctccagttctgccttgagaattgatattctgttattgaccccagcttaactcacacatggactgctttgaccagacgtgtgagaaggggctatgggctccctcaaggtcctcatggccagcatagcttttttgagagacctgtgccatggggcccctgtctcctctcttgtggccttaggaaaccctaaagcagatagtcttgatgtttgctcccttgaatcagactggatgcctgtatacaaagctcagcccagctcttgactgtccttggctctcacagctacttttggagctgagaggaccctttctccttatcagggtctgtggggatgggtcccacagaagccaacctggccttcactcagtggatcctggcctgtcctgggctggcaacagtatgagccacccttgtctcccttgggtttggtgctggatccctgcaggcacctctcctctgacttgagtgtgggactggctgagaaatgtgattatatgccaggagatgttctaacctctcctcgaaggtggtcagggagagacatctttacatttcatgaaatgcccaggctgcccctcagatgtctcattttggtagagcctgcaaggatggcttttcatccctgcttccctttagccttcttgcctgcagacaatgtggaccttccctcagcccaagatgttggcaggctgggagcagcccttcctgggactgtgctctcagctgctggcacgggcccccaattgttcccctgagaacaatgggcactctctttggctaggaaggggagttcatgaaaggagcatttctttggatgcttgagagctttgtggcagccccgcctgtgtgagatgagctgcagtttcttcctgccttgagtgggtgttccgcatttctgaatggaccccttgtgaacaaagcacaccgggaaatgcgggttggcgatggaaggcatccttgggggtgggctgtcagaatggcatttgcccagattcatcaactcaaatacttagtgaaaatataggcttctatgtttaaaaaaatcactgacaaagactgaaagagaacatgacaaagtaaaatagatgatgtcagggctccagattgaaggactgattctgaggattttattagtggctctaactatgttaagctgccctttacttttttggggaaaaagactaatttttgcttttagatgagaacagtgaacatgagataaaatgctttgtagctcagaccagaagggcattgactgggctgaacagtgtgttcagtattgatcctgtggcgttggtgtttgtggcaggggccaggttctgctttgaggtttgcatgtctaacagcaggaccaatgatgatcccttgtgggtgtgactctgctaaggccgcatgtacttaacttccctcatgattttttacctcaggtggggacaaaggcctggccctctgaccttaagctagaggctcttcctgttggtctgtgccatctccctgcagcacagccatgtgactgcccatgttcctcattagcagaaggccacagagcagatttatctcattgtcttagtccatggcacagacacaggataaccctgagtgtgagtcagcaccaaggctgatactccatcagagggtccatctcctgcttccctgagcagaggacacacagtcagcttgcaatgaggaggccttgactgcctcatgtgggagtgcctccagggtgttgtctatggtacccagccatagatggctgcaggttggcccagctctgcagcctgactagggatgagggagctgaaaggtcgggaattgatgaccaggtctgaaggaaagcagggactttgccaacgcaggcctctgcaggtccagcattgggatgtcacggggcagcagtctgtatcactttgaaatggatctgttgggggacacggggaagggcccagcccacaccttaagggctgacatgtccagaggtattgatggaaggtgccaccaccaaggcccaaagttccctccaaaagatttgtagtgagaaggaatgctcaccaaatcagtttctcgattatgttattcttaggatccctctttactggccatcatcagctgtgaaagtgctcgtacatctgtctagagtctttgcttgccatttctaagtcctgcaactcctgcatggataagacatcatcttgtgggccctgaatgatacagcttgtgttttcttggtttcataagccaattataattatttggccctagagagagcctaattcttcagttttgtttttcagctatgcataactgactcagactatgggtggaaacctgcttttatgagaactaagtaatagaagctcctccagccatttgctctttcttcaggtgtggaatggtactggcttggggtgagagactttgcttgagtttcatggtgtttttttttgttttgtttttttgtttgtttttgttgttgttgttttttgagacagagtctcgctctttgcccaggctggagtgcagtggcgcgatctcggctcactgcaagctccgcctcctgggttcacgccattttcctgcctcagcctcccaagtagctgggactacaggcacccgccaccacacctggctaattttttttgtatttttagtagagacggggtttcaccgtgttagccaggatggtctcgatctcctgacctcgtgatccacccgcctcagcctcccaaagtgctgggattacaggcgtgagccactgcgcccggccgtctttgtttttttgagacaggtcttgctctgtcacccaggccaaggtgcggtggcgcaatcatagctcactgcagccttgacttccccaggctcaagcaggcttcccacctcagcctcctgagtagctgggaccaccacgcccagctaatttttcttttttgtaaagacgacgttttgccgtgttgcccaggctgatggtgtttagtgcctacaggtgctgtatctttatcaaagtcagtgtttgatggtctattgtgtgcagagggcatcagtaaagcagctggagggagtgtcccagagactgaggagtgaccaaaatgttcaaatttggcagttccctggtcattggtcatggtgatttattgtgggcatcacagttttagacctttgtttttttttttgagatggagtctcgctctgtcgcccaggctggagtgcggtggcacgatcttggctcactgcaatctccacctcccgggttcaagcaattctcctgcttcagcctcctaagtagctgggattacaggtgcgcaccaacatgcccggctaattttctttttactttattttatttttttttgagacaaagtctcactcttgtcccccaggctggagtgcaatggtgtgatctcggctcactgcaacttccgcctcccgggttcaagcaattctcctgcctcagcctcccaagtagctgggattacaggtgcctgccaccacacccagctaatttttttgtatttttagtagagatggggtttcaccatgttggccaggctggtcttgaactcctgacctcaggtgatccgctcacctcagcctcccaaactgctgggattacaggcgtgagccactgcgcctggcttttttttgtatttttagtagagatgggctttcaccatgttggccaggctgctcttgaactcctgacctcgtgatccacccgcttcggctcccgaagtgctgcgattgcaggcttgagccaccacgcccgcccccctcccaccccttttttttttttttaagactgcatcatggtatgttgcccaggctgggctcaactcctggcctcaagtgatcctcccgcctcagcctcctgagtagctggggttataggtgtgagccaccatgcccagctcagtctttggaactttttgtggatctgcccaggttttgtggttttgattcttaatgttttgggatgcactttgtgggtcaggatttcagaagctggttataggcttttcaagatctttttttccttaatgctagacttactttctatctcagaagcacatcgtctctaagggttgccgaaaccagaaagttttctggcctttttggtggcctgtgagctacagcctgtgatctccttaaatcaggctttcttgggcagtttctgcctcctgcagatgtgcctagtaactgtctgaaggcttctttcaagacagcaactgtaaggtcagcaggccttgcctctcccagctccaaggcagtgttggtgtttggtgttggctggtagagagacctgaaatgctggaggagttccacggtgggaccagcttgtcaccccaaactcatgtgcctctgtgcctctgctgctaaggacctcagagccccaattcctgcctcttttctgcccttcctggcctggcagcccttagaggattagttgtgggtggctgtggtatagtaggcagaaatctttataccaggcaaaccaaggactctaaggatagtcaaaatcccatgtgtaaatgtgccaggatctagtgcacccattttattaattatagagacaaagtctcactatgttgcccaggctggtcttgaacttctggcctcaaacaatcctctcgccttggcctcctagagtgctgggattacaggtgtgagccactgtgcctggcctagtccacctgttttaggttgaagaggtgaaagcaggtctttgggttctcacctgcagcaggtcccccacttcccccatgccccttagtgttttcatctacttctggtagacaagtgttgacaggcaactctctgagcttccccagcctcagctttgtttctctatatgattttggctccctcattgcctgttgcctccccacttaccttagatgctttgagcttctgttttgtggtatgaacagggagacaggaccccactgtgcactgggtccaaggtcagttgggaaggagaactagggagaggagcctggacatgccctgggcccctttgtgcagtagcctcaaattacttactggttcttctcagagcccatgggagccataggaaccattattggcagagtccatcatgtgcctggcactataatcatatgaggttgggattgtttccctgattttacagatgacactggggccaaggttgggtcaagcgccagccagcctggagctgggattcgcagtgaaagatgggccttctcatggagtagaagaatgaggattgttatccccattgttatggggatgagtcctggcttgtcattgggctgcatctgtgagaaggaactttcatatcctgtttcacccttaggatctgagaagaagagaagtgatccagagcctataagttttgaaagctgaggaggtatccagagttcccgtggactgagggcctcctgctttgttagggtagagcaggtgctttatcccctagcacctccgggatgagctaagccctgagctgagtccctttgggagggtggggctcctagtggaatcctttggggactgtggacactgccaaaccttcaggcatgttcagactttccaggtaggggctttccccaaatggccttgaaaatgcagaagtgccagtgtgcctgtgacttggccaggttccttgtggaaattaggtttgttttgcttcctgtagcccttctattaaaatgaatcatggctgggcacggtggctcacacctgtaatcccaacactttggcaggctgaggcaggaggatcactgaagcctaggagttcaagaccaatctggacaacataggaagacccatctctacaaaaaagtaaatattggccaggcctggttgtacacacctggctcaagtagtcccagctattcaagaggctgaggtgggatgatcacttcagcccaggagtttgaggttgcagtgagctgtgattgcaccactgcactccagtctggtgacagtgagtgagaccctggctcaaaaaaatgtatatttaagggctgggcatggtggcccacacctgtaatcccaggattttgggaggctgaggcaggaggattgcttgagcccagaagtttaaagccagtctgggcaatataatgagaccctgtctctacacacccacacacacaaaatacccgggcacgtgcctatgtcccagctacttgggaggctgaggtgggaggattgcttgagcctgggaggttgaggctgcaatgtgccatgatcacactactgaattccagcctaggcaacagagtgagacccttatatatacatatacatatatgtatataaagaatcattgccactcaaagtgctgcttgggcctgatgtcaccagtaccactcaaagtgctgcttgggcctgatgtcaccagtaccactcaaagtgctgcttgggcctgatgtcaccagtaccaagactggagatgcaggggttttagaacattcaggttagtactttttcttcctgagtagtacccatgatcgtggagtgactgcctgcttcagggctgtagatctagacacctgtcctgcagccaggtagtggccgggacttcaggaccctggggagccaaaatttgcagaggggaaagcaggtgactaggttggagagacttggctcttatattagtctgttcttgtggtgctataaagaaatacctgagactggtaatttatagagaaaagagttttaattggctcatggttctgcaggctatacagggaatatagtggcttctgcttctggggatgcctcaggaagcttccaatcatagtggaaagcaaagggagagctggcgcttcacacggctggccggaacaggaggaaggctgggggaggtgctacacacttttttttttttttttgagacggaatctcgctctgtcgcccaggctggagtgccgtggcgtgatctcggctcactgcaggctccgccccccgggttcactgccattctcctgcctcagcctcccgagtagctgggactacaggcgcccgccacctcgccccgctaattttttttatttttagtagagacggggtttcaccatgttagccaggatggtcttgatctcctgacctcgtgatccgcctgcctcagcctcccaaagtgctgggattacaggcgtgagccaccgcgctcggcctttttttttttgagatggagtttcactcatctgcccaggctggagtgaagtggtgcaatctcggctcacttcaacctccgccctctgggttcaagcgactctcctgcctcagcctctcgagtagctgggattataggcgcctgccagcatgcccagctaattttcgtatttttagtagagacagggtttcaccatgttgaccaggctggtcttgaactcctgaactcaagtgatccacccacctcagcctcccaaagtactaggattataggcgtgagcctctgctcccggcctacacacttttaaacaaccagatcttgtgagaactctgtcatgagaacagcactaggggggtggtactaaacgatccatgagaaatcacccccatgatccagtcccctcccccagaccccacctccaacactagggataataatttgacatgagatttgggcagtgacacagatgtgaaccatataagctctgtttttctgacatgacttgccccaaagacatgggtaaactttacatggctgcaaagccatgggtagacaatagtaaaagaatttggtcacgtgcagtggctcacaactgtaatcccagcactttgggaggctgaggcagccagatcactggaggccaggagtttgagaccagcctgggcaacatggcgaaatcccatctctaaaaaaagaaaaagaaaaaaaaaattagccgggcatagtggcagtcacctgtggtcccagctactcaggaggctgaagctggagaaacatttgaacccaggaagcagaggttacagtgaactgagatcgtgccactgcactccagcccaggtgacagagtgagactctgtctcaaaaaataaataaataaataaaattaaataaattgtgaaagaatttgttctcagtagtcaaaataaagctcatttctcatctcccatctcccaatttgaaattgagcattataacttgctttggtgaaacctgacgttttctttagtgtttattgtttgttacataatattaacatgtttttaagttacttggcatagttaaaataagtgtatggctttcaaggatggcttcgctgtgggagccttcctatagaatggcctgagtttgttctgtaggaactgcctgatagcagaactttggctgttggggtcagcagaataggaagtgagccaggctgggaagccttgagaaggcagggcccttctctattttctgttaaaaagtgcccttgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaggcgtggtggcgggcgcctgtagtcccagctacttgggaggctgaggcaggagaatggcgtgatcccgggaggcggagcttgcagtgagccgagatcacgcccctgcactccagcctgggtgatagagtgagacgctgtctaaaaaaaaaaagtgcccttgtatagttgaagacagacttggagaggcaacaggttgctgacttatcaacactgatggagcgcctagccactcaggaatgtcccatggttctagccagccatttggctcccttcttctagtccctctcaaccttgttcagtctcctctgcagttggcttctccttagttggctttacccagacctctattccaggccttccctgtcacctttcttcatcctccctctgccatgtgagctcgtgtcctactggtggccattgggatggagtagagttaggaaataaccctcaggtgaccaaaaaccggggtccacaccctaattcacctactctccacctctcaggacccctacttctatcccactcctgtaaaacatctcatgggccttacttatttgcttcatggtggttttttgtttgtttgtttttgcaaaacaagagcattcaacctttattttatgtgtttatatacggatgtggcagttttatttaatataaatgaactgaaaaatgtaaagcttagatttttcagccaaaacatttgaaatagtgtgatttttttttttttttttttttttttttgggacagagtctcactctgtcattcaggctggagtgcagtggtgtggtctccgctcactgcagcctctgtctcctgggttcaagccattcttgtgcatcagcctcccgactagctgggactacaggtgtgcaccaccatgcctggctaatttttgtgtttttagtagagacgggattttgccatgttggccaggctggtctcaaactcctgacttcaagtgatccacccgcctcaacctcccaaagtgctgggattacaggcatgagccaccacgcccagccaataagtgtgatttttatggttaaaaaatatttttaaagaaaaatatatttagcatttttcatgaatttgaagacacccatgtttacagatgttttaacatttctgatgtttgatggtgagtgacagggtgggagattcttaattagatgatggcacatcttagagttgatgcaatgtggtatcacaaaagaaacactatttgctaacccttaatgagtggctcagagagcaattaggaaatgataaccctgataataataacgccttttttttttttttttctgagatggagtctcactctgtcacccaggctgggttgcagtggcgtgatctcagttcactgcaacctccgcttcccaggttcaagcaattcttatgccttagcctcctgagtagctgggactacaggtgcctgccaccacatccgactaatttttgtacttttagtagagatggggtttcgccgtgttggccaggctggtctcgaactcctgacctcaggtgatctgcccaccttggcctcccaaagtgctgggattacaggggtgagccaccatgcctggcccaataataataattcctaacaatgtcagtaatctcatggttaaaaaaaattttttttttgaaatagagatgggggtctcactgtgttggccagggtggtctctaatgcctgctggcctcaagcaatcctcccgccttggcctcccaaagtactgggattataggtatgagctaccatgcccagctttctcatacatttttgctgggtgtaggaaacctgtttaaattagtttaaaggggggaaattatctagtttctgataaggctgctgcctggacacctgggtacaagcctggggtctcctttccaaatcactcaagtactttgttttttggcaggaggaagcccagggaaccagaggcactggggaatccagcagtcagtggctttagctttcctgccacagggagggggaagcattttagggtccccctattgataagcagtggtcatgaagggcagtcctaagctgagtctggcagtgtgatgtactgtgttttggccaatttgtctctggtacttgttataggacaatggagatgagagtgccttcaggccaaccagagaatggggggtgtcacttttcttgcattggggcaggagtaggtgtttcccaaaagtgaaaggagccacagatggggctggggcaagagctaagtcatattttcctcttgtcagctgttggtggaggtttctatggtggcatttccttgggtgctctgagtatgaccagttatatctctgtggaaagggacttccacaacaaaagaagtctgggagatgctgttgagttggaataaggtgatgagctccttaggcctgcttctgtgcctggtctctccaagggcagaagaggtctctgtgtatttcctgtacttgattgactgtagaacctctctcttttagagagaccagagctccttgggattcctttagtaagcactattctagaatagttgattctagtctctgctccctgggtaccacagtttgtcttgagatttgagaagcagggtaaatgaaaacattagatacaactaactctctttgctacacaaatgtgccccactacacttgaatgtaacgtgatgttgtaatgtgagtccttcagagcgttgagccttcccttgtacccagacctgtgtgcatctccactttggggcaggaatggtcctccaggccaggcatgtgacctgagcaaagatgtggtgtctgcagagggccggggagaagtctgaggcaagggtggaaaggaatgctgagggctggaatgtgacttgattcttcaggtagaatgggcaagtaggtggcagggcgtgtcactgttataaaatccacaacagtcgtgagctccatggcatcagttcttgggaatgagacatgtgcttgagtgccagcactgctgtctccccactgtgtggccttgggtgagatatttgcctcccaagttagcccatctcatagccctagtcttgtgacaggtaaataaactcagttgtgtctctctaggggagaggaatcagcttccccagcaggcattctgaattataccttaaacctgtcacacaattcaggttaactgttgtgatcatattcaggttatgcagtgacaatagtatttttaatttatgcttgtgtctcttctaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccgtgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgccgttgcatctgggcatctgtttccctggcatctggagaggttcctggacatgaggggttgggggctcatgtgacggggaagaggagactcagccaggtccacttggggttggcccagtggcctccatgtaagccttaccatttctgtgctgggagggctgggtgtgcactccagaaactctgccaacatgtaatgcccccttcacccctcttctgcctgtgaatcagctaagacaagtctcctacatcctcagttcctcctctgtaaggggtgggggatagcagagaaaccagtgagactggctgggaaggaggatggtgggaaagtgtcacgggttttctgccccagagtgtgtcagcccctgtacctcctgggtagggttccttcaggccaggtctctgtgaagatggggacctagggatacctctggctgcagctctaccccacctcctgcctgcattatcttgtgggcttgggactggctagtctcccaggtagtctcaaggcaggtttgtgttggccttggggtgggaacaatggtttctggccaggctgctctgccttggttggcctgtaggttctgggggttggggggtgaccttcagtccctggcttgggatggacagtccagctgggtaggctgatcatgactcagtgcccaggaaggggcagatgggttgtcctaggacactgctcggagtgtgggcggcaggagatgcagcagctgtgtttcaaggggcaaaggggcagaatcgagtgattggtcacagaacaactggtgcctcttctgggctcaactctgccatccctggctccttaccatgacccctgctcctctgctcaaagacccacagaggctggtccgatattgcagataagagctgattcccagggtgggggggttgttgaaggtccaacaactacttggagttaggacctgaatgtgcaccatgctaagtgccaggaaaggctgtccccagcacacacttcactccctaggcctagcagcaggggcccaggaaatgaccccgtcgttattctcttgacctcaggaacttttgcttaacatctaacctgaagccactgggtaatgagtggactcactgttctgaattcaagtaagggaatacttggtcttggcagagaacattaaggccagaaggacctctggcctcagctctgccctgcctcttttgggggatggggtagtatccgctgtttagcccagcagacccttgacccctggcactcctgccagatccctgttccttgatttggatgaggactgctcaggtcttttaagctggggttagagggtcgtagacaggagagtaggaaagaaggaacatcagacctacaggaatctgccttcccacattcctctgacttggaatgactctggcctggcttggagacagtgctggtctctagaaaatgctagaggaatctgcattttctcttgtcataaaggcactgccttaggcctagatctttgagctagtcttgggataagggctgttagctggaaaatcttgtggtgtgtctaggccagcctggcctctagaatactaccaccagtttgggaccgggcgcggtggctcacgcctgtaatcccaagcactttgggaggccgaggcaggcggatcacgaggtccggagatgagaccatcctggccaacatggtgaaaccgtctctactaaaaaatataaaaaagttagctgagcgtggtggtgggcgcttgtagtcccagctactcgggaggctgaggcaagagaatggcatgaatcacggaggtggagcttgcagtgagctgagattgcaccactgcagtgcactccagcctgggcaacagagcgaaacgctgagactctgtctaaaaaaaaaaagaaaaaaagaaaagaataccaccagtcttgggggggctggaggctccacactacttacctcattgtagcccacagcctcgcctcccccttgttgcccacaggttga

SEQ ID NO: 12362 - DNA, 85912 bp, Human
gccctgatgcacagagttgcgcagcactgagttagacaacaaatagagaagccaaggtggcggtggtgagtttggagttcagtggaggggcagaaagagagaaattaagttgcagatgtggcacccataagcgtctgcaggtggtggtggtggtgagtctggagttcaggggaggagcagaaatagagaaatgaggttgcagatttggcacctgtaagcatctgcatgatagtcgtccacaggctgcatgtgactatctatgggaagtctagatagagaagaaggccaatgctgagccttgcgatactcaaatgtttataaatctagaagagggcgaactgccaagctgacagagtgagcagccagggtggccagagaactggagggtaaggcagtgatgtggcacctccggagcaaaggaggagggggacggccagctgcatcaagtgctgctaagagctcaaatagaatgaaagtagaaaatgaccattggatctggcagcacataggttataagtgacttccacaaaaggacctcccatggttgagggcagtgcagcagaacttgatgaaaaccagacaaactggactggagggagtgacaagagatgaggagctcagcctccctgaacagttttgttgtcaaagggaaaagtacagccaagcgaggggtggtgtttccttcgctaaagagattaggcctgtctgaatgcgaatccagcaaggcattgcggaagttaacagcagttgcaaaacactggggcaggcgggaagaacacgatccaaggcacgagagccaggggtcagccacggcaacaggaagatgatggtgaaaaccaaaagtttctgagagtggtctcaatttaggaagtttattttgccaaggttaaggacgtgcattgacacaacctcaggaggttctgatgacatgtgcccagggtggccaggaaacatcttggttttatacatttgagggagacatgagacatcaatcaatacgtaagatgtaggttggctctttaggaggtaaaatgtgaagtggaggcgtccgggtcataggtacatttaaaggttttctgattggcaactggttgagagttatcatctaaagacctggactcagtagaagggaatgtccgggttgcatgaaggagttgtggagaccaaggtgttatcatgcagatgaagccgggaatacactgcaaatgtttcttatcagagtcctctattagtcttagggtctccgtgcggatgtttgtgaggccatgtttgacttccgcttcccatcaaggcctgaactagtttttcaagataacttagaaggccacaggcggaggggagggtccatccgttggctgcagggcttagaattttatttttggttcataacgaggagggcagggacagaagccaccgtctctgctccccagcgctggccctcactcggaaagcaggctctcccctcgcatcgtcttttaacaaattcctgctctctcggcccccgtcgctgccatctgggctctcctttccgcgcttcattaggcgctgccgcggcaggggctgagggcctcaggggacggtcgcctccctgccgggacgccccggccctggcccgcactgtggggcgcagtcacccagccgtcgccgcgtagccaggagcccggctgagcgcgttcgctgcaggagccatcctcagctgggccctacttaactttccgcaactccagtccccgcagccagtcggggaccccgcctccctctccttccttctccctctcacttcttcaccccttcttttccctcccttcctcctcccctgcccgcgcccccgcccccgcccccggccacagcatccgacgtggcgcggccggctgcgcacgcaccgtatgcttggcttcgcggcccagcagggcgggcgggccgcggtgacgtcagtgcgcatgccgtcggtgggctcggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccggtactgactcttttcctctctctccacgcgcgggtgccgggggcgggctcgaacccgggggcgccgggcgggggctccgcggggagggccccggcgagcgctgagacgggttccgggccttgatgcccgcccgaggggcgcgggccgcggagaggtcgggcgcccaggcccgggacgagcccgccggagcttcggccccgcttgccggcggcggcgaagcgtttcttcctgaggagcgcgggcggccgcgtacctgtgcgattgcgcgcaggctccggtgccttgggcgaacccagttgcacaacttataacaaagttttggcggataatatttacttagaggatacagatgtctagaaagaaagtagcagaagcaatgaaaagtcagtggtgttaatatcatggtgatgattaattagaggctgccagcgtttcataccgactcaagaaccaaggagcggaaataatttttatcattaatcactcaatatgactttcaccgccagtttcttccacatccagattttttttttcccccaaagttgctttttctgattttgagcaaatcctaaacttctgagccaaggaagttaaagccaggaaagagcggtctttcttagaacatagggatctaagcagccttcatgcttctgccacctcctcctctctctgggcacagttcctgtttgcactttggattctgtccagacgggtctgtttccgtttctactctcctttccagtggcagtcggcccatatggagggacactggtgagaagatcaaaggccttgggtctcagaagccaagtcacttcaatgtatggatgcgtgaggttcttttaggtcttaatagcacgccttagtgtcataaactcagtcttgtaggaacagaagtctttgagaaacatggcttcttttggtggcacatttgcgccattttcttgacaataaagattcctggccaggcgcggtggctcatgcctgtaaccccagcagtttgggaggccaaggagggtggatcacttgaggtcaggagttcaagactagcctggataacatggtgaaaccccatctctactaaaagtagaaaaattagctgggcatggtggcgggcgcctgtaatcccagctattcaggaggccgaggcaggagaatggcttgaacccgggaggcagaagttgtagtgagccaagattgagccaaagcactccagccttggcgacaaagcgagcgagactccatctcaaaaaaaaaaaaaaaaaaaaaaaaagattcccattatccttctctgctgtcctccgctatagggcgggaattctctgcaccagcacaatgaataggagcggttctttaaatatgttgcagtccagagtaggcaatatttttcagtggtgacggaggctctctacaacaaaactaactggcactgggaaagaaaaatgtctaactgatgccagagaacttaagaggcatggggttttagaaaatcattccactgtgatggaaaatggttttgggggaatttgtgttgcattggttttaagaaaaaaagtacttcaaagggagttttttttttgatgggatttcttttaaggataactgacttccattccaccacagcgggtccctgtccactgtggggaggagcgccttgatttccaccccgggcagggctgcctccaggaactgcagcagccacctgctctggccctccactccccaggacatgggttacattaaagcgtatctgttggaatgatacagaaccaaagtacagtaattaaattgcatacagagacacacccataaagaagttttttgttttgttttttgaaacagagtctcactctgtcacctgggagtgcagtggcacgatcttggctcactgcaacctccgccttctaggttcaagagattctcctgcctcagcctcccgagtagctgggtttacaggtgcctgccaccacacctggctgatttttgtatttttagtagagaccggattttgccatgttggccaggctggtcttgaactcctgacttcaggtgatccacccacctcagccttccaaagtgcccatatggagatttttaaggtcagaggtataaactgtacatactcactccctgggagaaattccttgctggactctggttttctttgaattgcagagtaaacagctaggctttgtgaattacagagtaagtagtttatttacccctgaggagggaagaggcagcttatttgtgctagtgtagcagtgagcttgggttctaagtttgaagacatcacttcacgcttcactggggctcagtttttctcctttatgaaattcgaggtttgggcctcggggcaagtcacagggtggggctgtgtttgctgcagtgagtctcacgtcccgcttcagcatcagggtaccagcactgttcatcccccaggtaaactcctctagtaacttcagggcaacccctttagacttacggggtgagctcttgcgggtggctgtcaccatctgtcatctgtctccaagaccatagttagaggaggggcccaatagcagcactcctcaaatgccagcagcatccctcaaatgccaacagcacccctcaaatgccaacagcacccctcagatgccaacagcacccctcaaatgcgctttcctagatgttacagaggaccatgtgtgaaccttttctggcaggaagctctggtgttcttgtttagtctcgcattgccagagagtaggcagctctgaagggtagatagtttttaaaaaaaaaaaaaaaaggcggcccactacactaaaggataatcatcaaggatagccaagagcacagttcataaatcaaaatcactgccttaaaaatgttgagaatgctttcattaagtgcttaaattggataacagacttgtgcctcaatgctcaatcagaaataataaaattctcttacagtgactatcttaatgttcttttgtgtcttctctttgttgctgtctggcccatatctcctgtacattccccgcaatccccttgttttccttcgtgcactaaccttcgcctctctgcctgtcttcttgcttccagggctgggtcttcttgatctctttattcccggggtggcacaaaatactcaataagcactccagagtttccccagggcctcttctcacccctcactgcccccatagcaaaccgggcccacaccttcctcaactctgagctctctgtactgtgcgcagggatgcaggtggtcctcttggccggttcaggcagcagactggtggaaacactaatgaagtttgttgagtgtcacaatgtgctgacacacttctaagcgcttggcacgtttaactcatgaaatcaccagtcatcttaacattgagataccgaggacagtgccgtttaaaaacctgacccagagccgggtgtcgtggctcacgcctataatcccagcactttgggagacccaggtggggagagcacctgagctcaggagttcaagactagcctggccaacatggtgaaaccccgtctctaccaaaaatacaaaattagtcgggtgtgctggtgggtgcctgtaatctcagctactctgtaggctgaggcaggaaaatcgcttgaacctgggaggcagaggttgtggtgagccaggatcacaccactggactccagcctgggcaagaagagcgaatatttcgtctaaaaaaaaaaaacctgacccaattgtttggagtgtctgttgccaactcccctgagctagtgacctagtgggagcggccggaaaggctgttgccttttggaacttcagcagcccgacagacgactccatcactggccaggtgcctcctcccaaggtgggagacgaatgaggcagtttgtaaaggcttctgaagagtgttagagaaaggtgctgtgcaaatacaggtattgttatttacaagtgatggatggcactgcatcatgtcctggcaaatgtgctgtcgtctgcagtcctctgtagaagtaatccagccttaatgatttgagaccttaccactgctcttgactacaaaatatttgcagagaaatggggtgagactgcttgtttgatgagttattgcaaatgcagattagcagagttagaattagcgagattctttctgtttcatctaacagcagtcatagcattccacagcagaaaagaggacctaattataagcctcgctattactcatttctgccagtctttgtgagtctgtggcagtgagatgggtaaaatctctttgttaaatacattttgctggccctgttcccctccatttcccagtggagccaaaaccatgtgtcagtagagttctcataaatctgctacatgatagctttgaatgttactaatcttacatgtggttttctttgaaaagcagactctacatcccctctcaaagtgaattaaatggaaatataagcacgattatatttatttcaagccatgttactttttttagtaacttcagagtaacttagttctctcttacactaattgatacgtcagacatgagttaaggatgcctttcaaaagtctagtgtaattctccctgaattatctccctgcagaaagactttcagattatccattgctagaaacagaagactaatttgtcttctattaaccctgtggtcacagatttgctaagcatagtcccagtgtcaaccagtcaggaccagaaattgaatggtccaggtaagaggtctgcccttgttcccaacatgccaaggaaaacaagaccctttagttactatcttttttcagaagccttctgtcaaggtggcccatggtatttcacctcttccctagcctttttttgttgttcttgtctagacagggtctctctcaggcttgagtgcagtggcgtgatcttggctcactgcaaccttggcctcctgggctcaagagatcttctcgcctcagtgtgctgagtagctgggactacaggtgtgcaccaccacaaccagctaatttgtgtattttgtgtagacacaaggttttactatgttgtccagtcaggtctcaaactcctgggctcaagcgacctgcccaccttggcctcccaaagtgttgggactccaggcatgagccaccgcacccagccttccctagccatttttggttatctgtgacttctaacgtctttgtgagtgtccttttcattttggccagtgccctgtgcattcttacttggttttgtgactgcttttcccttcccagcttcagaagttttttttgtttctatagagaatgttcacttttgtataaagtactatattaggtatagagaatggtacttcctgttgtaacaaacaacctaaattctcagtggccaaactaatccaggtttatttctctcctgggtggggtcttcttaacaaagagcaattcagaggcccagacaccccttgctgtataacactagcttttcattgtgtggctgctgctgaggggacaagtgtaggtcgccgtgctggggtccgtatggtgtggcccacaagtggtatgcatcatcacatcagtttcctatggctgctgtaccaaatcacaataaacttagtggttctaaacaacacagttttattatgttacagttctagaggtgagaagtccaagatgggtctcactgggctaaaatcaaagtatccacagggcaactggttccttctggaggatcggggagaatcccattttcttgccttttccagcttctagaggctgcccactttccttggctcgtggcgccttcctccacaagccaaggaaagcttcttcaaaggcagcaatgaccagtcacatcctcacatcacacactcagagccctgactcttccgcctccctctttcacattcagagacccttgagattacatgggcccacctgggtaatccagaataatctcctcaccttcagtctatgattctaagcacagaatagcagtttcccttcttcttcctcagcttacagtcagctgatgagcaaccttaattccatctacaaccctcatttcccctggccgtgtagcccagcacactcacaggttccagagtggggggacgtgatgacatgatgctgcccaccaaagtcacttttccccatactattgggcaggacccagtttgatgcccccaatccaactacggggaagctgggagtgagactggcaaacacctgactagtcctagcctcaaccaattcccaatgacagcttttccaaagcacttccaggcagccgatcctactttcccctaaactttttgaatcagcctccctgcactcaaggatatacatgtagctgctccatgtacctcccagcttgaaaggggcccagtcagctgtccggcaaggtgcccatcctggcccagtcagtactcattttgtcctttgggtcagaaactatgtcaaggatggaacacacactgctgtggaagatggagtgtttggcccaggggggtcccactatgtctctgaacttcattctttaacagggttgctccgtgtaatttaagagccttctcaccttcacagtctatgattctgagcgcagaatagcagtatgaagccaacgagagtgcaaattcaggaaagtatctggggctccagctcattttttagcacaaaccattacttctaccttatctatgcacacctgaaagctcctgtaagggctccacttggtctgggggcaaggttctcattggggtcttctataacttatgtctgttattgggccagactgtcagtacccactctctgcatacgttcttaccgcctctcacccctttatcctctccactttttagggttcccaccttcaggtgcatgggcttccatagatgtgagtctccacttgccagtgattctcctctctcctggtggagtcatttttcttaactaagataggccatagtcccttgccctgttcgcattgggaagttctacccacctaatctcaccagcccctttgcttacctgccactacattgctctacctgagatcctttggtttaatcataacctgcagcactggttgttttctgttttgttttgttccttccactggaacagtcctcagaacctttcgtcacttcttttaggtagaagagcttccctttgaataacatttccatagctcttctcaggcaagaacaaaggtagcatatacttgtgagtcatactccagtacctgcagtggatgcttttgggacatttgtgtgagttaacagcccttcctagctccctgctggaaattgctccctggttcatggaactcttccagtatttcccctttcttcttcccgcagtagcattttctagtttgctatttggcactagcagatagcaagccaccagtgactgcatcttacagccaggcatcctgacacctgaggacggatgcttggcccagggtcccacatagtcatttgcctccttggtgtttgcttacctcccagatgtgaccgtaggtaaagcttcctccactccccttcccacttgggcaggcagctgctctgtggagagcttttcatttcaagctcaccttcccttatctaggtagtgtaataacctggccctgtctgtaggccgttcctttgagttactctcagaagccatggtgctctgcttcctggaaggaatctgatcaaggaaaggcttacctacgattaagggtggaacccagtttgccgcttgccagctgtgcgatttggggccgctggcttccccttctccctgcctcaggatctactccgtggggctgctgtgcagtgaaagatgcgtggactccaagtggttagagcggtgcctgccacagagtggtgatgaggagcagaagttggatctgtgattctcccaaagcttcctcaggtggtgatgtaatgacggaggtcctggtggtggtcagcaccacgatgggcaggtgctttacagggcatggccttcattccccagcaacccgtagggcagcgctctttaaggaactgctgtgaagagagggtgaagagctggaaaagcaccaacgatttgaggactccagaggcctctcttgagtactaaatgctaacttaaaaacccatttaataagactagctaacagttgagcacatcctgtgtgccaggtcctgttggaggcatttcatgtgtcctaactcatgtaatcctcagctggccctgggagaggggaacattttcactctttcttcataggtggcagaccctgaggcacagagagcttcagcaacttgcccacacacagccacacacacaagcacatacgtatgcacacatgtgcacacacttatgcacaggcacatgcacacacacacacacacaggcagaactgggatttgatcccaaggttctggctccagcatctgtgttcttatcctctgcacagcacttctgctaagaggaagcttattttttacatttgaagctctcatttgaataacaaccaccacgacaaaaatctaaggtttttctgtttctcctaaaaatactgatttgcaaataattctgcaaagatttctgcaaaagtaattcttcttttgtagttttacaaatgaagagttctagagacagtgatacaacaatcacaataaatatgtgctgtcatattttttggcagtattgtaagttaaaatgaatctgtctcagctttgagttattattgttattattgccactttttattgctacattaatcaccaaacataactgagagggattaatgaagttaattgtttttagaaactaaattaaatgcaaatgctaatgctgggtgactgagccttgacactgtgtgcttatttcagcagaggagcggacaggctgccctgcaggagcttcagaagacttgatcatttcaaatgtcaccttaacattcatcattagttttctttatagttagttgcacagctctttttatttttactttatgaacacatctgtgagttacagtttaaaagttttatgtgtgccaagttggaaagattcagagatcatttttaaatgggcatctgtattgttggtttggcctgccttaacaaaataccacagactgggtggcttaaaccatagacatttatttctcccagcttgggaggctgaagtccaagatcaaggtgttggcagctctgctttctcctgagacctctctcctgggcttgcagatggcactttcttgctgtttccttgcaggccatttctttgtgtgtgcacaacccggtgtctctttctcttatagagacaccatttctattatattagagccctacctcaattcctcattttaacttaattgtcttttaagaccctctctccaaatacaattacaatttaagggtatgtcagttaggacttcaacctatgaattttggggggacactattcagcccgtaatagcatctttcatcaatttctgatgagcatgggaaagaggtgggatagagcagggagggaaatgaatttttaaaaaatatttagtgggacagttcttctaagctcttccttgagcccgaaacattcataactctgagatcctgtgtttcaagagagtggaaaatgaccctaaggtgtaggtagataattgtattttcagtctccatttctgattgggaggccaactacgtaggctgggaaatctttttaatcttagattaaaaagctgcctgcaaatggtaggtcttttctgttttgtctttggctttttgcttttttaaaagaatttgaccttgaagtgaaaggaattcctggaaacccaaaacgaagaaggaactgaaattcagacctttagcatgagaggtgggcccacaggaggcagggagtagccaaggttggatgctcagaggccacacccctggggaaaggtggaagagggaaacctgcccagtggccctaggagggccaggaagccggactgtgtcaggctgggctccacatggggacagaggtctccttgagaatttgtaaacaaaggcttgcttttacatgagttcagttcgtatttgtactgtttggcaatttgtcttctgagaaatctgccttgaaaaggattttcagacacctatactcctggcctgacaaaaacacgtgtagcatctccccagagggttgctgtctgcatcacaggccccatgagatccttactggtaaagcccagtgaagacagattcctcctccaagtctcccaggacaagagcaagaatccacaggcaaaaacagacagcaggattagactccagaggacttcagaaaatcaaataattggatatacaactaaaatgattaaatatataaaggaattgaacgcacaagaaaagaataagaccccatcaaatacctggtgaatttgagacaaaagctgtaggaatgaaaaatagagtgattaaaaatcaattgatgggatatagagcagatttttgagaggattactgaacaggattctgtttccttctgccccaagtagaatgtcctctccgttgagaagaggtgcgggcagcagggagattttagttctaaacccaagccagaggaaatagtcgtcattttccttgctctcttttgcccttttctaacagccagctgctggggcagtgctggtcctgggagcaaacgtcaccatctccctccagtcgggctggccaagtctcccagggaaattgaagaccagtacacctgaagcatgtaagccccaggctgcctctcccattctccttcccgttcatcagcagcataaagaaagttggcctgggttttcgtgactcggcagggtccactcagtttaaaatgccagaggacatggtgtggcaagttgactgtatcgtgatgttagccgtcttgtggcagagactcagagacttgaagggtaaagctcagtaaggcccacatccagagcctggggggccaatgactacaaggaaaatgaccctgctttctagccagcaccccactctcccgaacgcctctctcttcttaatagtctgaggaggtttatctcctttctgcagatgaagcagggaatctttgagaatctgagacactagtctgagaccacatagctgagggcgtggaggaacgtgccgaccccaaacacatgctggtggctaccatgcgaggctggctttttggatttagggccagccagcatttccaaattctgttcatggaacactgtagccctgatggaggataactggtattatagccaaaaaaaaaaaaaaaaaaaaagttgtgtggtcagataggctggggagagctggcaagctgtatgcctcctgtaagtcttcctcatgcaggtagcacactaagggccaagaaggtctctcttggggaaacctatttaattttgttcaacctggcatttcccactcttaatagatgctagattacccgaccccttacaacacagtattaacatattagccataaaggaattgcacatcaaaccacaataagagaccacttcacacccactaggatggctataattaaaaagacacacaatagtaagtgtcgggaacatgtggagaattggaacccacacactggtgggaatgtgaaatagtgtggaggctttggaagacagcttggtggttttcagaaggataaattcagaggcaccatgtggcctggcagttccatttctcggtatatactcaaggaaatgaaaacatatgtccatacaaaaacttacgtgtaagttcttcacagctgcattgttcataatagccaaaaaagtagaaacaacgcaaatgtctaattgatgagtggagagatacaatgtgatacatccatgcaatagaatatttgacaagaagaggaatgagatacttacacgtgctgtaacatggatgaaccttgaaaacacgctaagtgcaaggagccagtcaccaaaggccacatagtttataattccacttatatcacatgtccgaaataagcaagtccaggtgactggcttccaggagctgggaggggtggaatggagggtaactgttcatggctgtggggtttctgtttggggtgatgaaaatctcctaaaattgattatggcaatggttgtacaattctgaatgcactcaaaaccatcgaattatacagtttaaatgaatgaattgtattctacatgaattacatatctataaagctgttttttaaaactaagttaacatctgccagcggtagggtttcacagcacagtttgggcaaagctgcagtagaagttttgttgccacttgcctggactctgtgaaggcacagtagctgtcccatgtcacccatcaccatatcaccccatcaaaaacatcttcgatatttgagaaagtaaatttcacaggggagggttgaggtgagctcttgtgttgagactgtggagaactgaaagcagcagccactctctttgtgtagtttgtgccctcgttacactgctgctctgacaaaatacttgaaaggtgaccagatagaaaaacaagagccttggaaagtttctgagtggatctgtagtaagagattatgttgagtgctgtatcattttgaatttaccccgacaaccctgaccttccctagttaatcattttcattgccagattctccagactgacttgtggccactgagcaaccaaaacctttccagctggtccccctgatccacaggcagccccatttccacattaatcccacactctctgttttcatttcagtgaaagctggtggaatgcgaattgtgcagaaacacccacatacaggagacaccaaagaagagaaagacaaggatgaccaggaatgggaaagccccaggtgggatgatgctagcgactcttgagcatgttttccaaaaaccctattcggttaaacattaacatttgttctctgttctatgattctgataactcctgggctatgtggggccctgttctgtgtatttttcccttcctaatcagggaggagggggctttgttttcagtcaggggagaaaatagagcccctagaggtcctctttcctgagcagttgccacgcgcccaccctgttccccaccccacacccagggctggtgccccgtctgtctgcacagttagagacctacctccacctgcccaggtgcctgggtttagccagtgtgcctcccttcctggaagccagggcaagccaagccaagcaggagcagcttcctgtggctcattggttttctgatggtggacacagctgccagccaccctcttcccaaggctggaccaccagagtggacgaagtaggcaaattcttgcacctgtgagtcttttgtactccaggtttctgttgtcattccagagaaacaaatactaacaatttctgggcagtagtttgcaacttaggcttccatactgaaatcacatggagacccttgagaattgccgcactagttgaacctcaggggtggacctggctgtctgtgtagctggggcaagaacttctgatttcagaatggttgaagcatttcctccctcggatcatcagccagatctagaattacaaggccatgcccttatgagtgactgggtgtccttatatgatacctctgctgccaaccctcctggggcctgcacaggggtctccttgcagacccctcctcccctgctcaacacctattttccttaaaggttcagatttccagttgggttcagggaccttgaaaggaatccatttctctcgactttgcaatacgcaaacaggcaccactaacacacctctgcgggagctcgtccacgtagaagaaagcactaagctctctacttatacagcctgtctccagatgatgtctcagtcagaagaggagagggtgtggaaggggaaagaggctgtggaaagaagctaaccttgattcctgtggattaggcccatgcttttatttcatttcattccagcagtcctgaatagtaggtggtattctccccagtttatgtacaaggaaacagaaccccaaagaggatatcagcttgcccatatcatgcaccgtgctaggtaacgtagcaggaagttcaacccagttctcatggagtgctcagcgggctaggcttccaaatggatagttgccaagagtaggcacccacatgaggaagtggtgcatgttcttggtaaccctgcctgtctgcttctaagtggccttccccattgagtattgtctataaaacctgatacagtatgagttacggagcggccacgtgagggaagaacagcattttgggtgacatttctgagtgattattagtgattattgtccattttaaatcatgagattagcagtgtaaagattcagtcccagttctggtttaaaagaaggcagtttaaagaaaatgctagaattgtccgggcacggtgtctcacgccagtaatcccagcactttgggaggccgaggtgggtggatcacttgaggtcaggggtgcgagaccagcctggccaacatggggaaaccccgtctctactaaaaacacaaaaatcagtcaggtgtggtggcatgtgcctgtaatcccagctactcaggaggctgaggcaggagaaccccctgaactcaggaggcggaggttgcattgagccaagatcatgccactgcactccagcctgggcaacagaacaaaactcttgtctcaaaaaaaaaaaaacaaaaaaaaaacgctagaattatttttctcacttactgtattcacaaagctatgtttggaacgtaacagcatcagcaactctcctgtaagttcacaattgtatatctgtaggacttgcggcccgacgtattttagaatggagaaatttgggagtctaggaggatattactgcttttaggagaataaaaccttgcatataccacatagtaccccctaggagaataaaaccttgcatataccacatagtacccccagtggggtctcaggcagtatattgtaatctatatgtgatgttcaaaccgaattagataatttttttaaatttagggactagtgtcacttcaggttaagttttgcctccgtacaagttatgaggaagccttccattttctgagcattcttgagttgggaatcgaggctaagagtgtgtaagcctgtagtaatttccctctaggaaacctggggtgtcattgcccttcttcataaccatctgtttccccaaggaagaaagagggcaagagatatcgccttgcctggaaaaaaagttcctggaaagttaatgaaacactgcttttcttggtgagtttaagtggaataaggtacagatagctagttccctacctaacacagtgtcaatacaatgagagatagtaatttattagcaagtttagaaataaggacagaacagcccactagttttctttctgttgatttttttcatgagttgacatgcagcttttctagaagatgatcaatttaaataaatatgccagaggatgaacagttgaagaggaaagatcgagcaccccagcgctgtagattgtagcatcttatttaccttaaagatttgttctctatctctagagaaccagatattttgaagcaggccgactgcagggtatggtttgcaaagcacatgagcaaggcttttgttgttgttgttccctgcagccaaattgctaggatacattcctgatgagtgtgttagcacttgtcctcttgactttggcttggctgtttactgctgtgggttaaacaactcgacacagcatttacagaacggggtaagcctgtgtacactctttagctattgatgtaagttgccaaaacagctttttctaacacactccacgaggcctggtactctgtgtaatagtttacttttaccaccatgcactcccactccccatttctctggtggactgattgaataatcataatcaatcatcatcatcactcattcttacagagtgcaatgagctcggctctgttctaactgctctgttcatattaattcatttgatctgtgctactgctcagtttgttatcatccctatctcagagctgtttattattggctattactcccattctgaattactactccctcttcaagagctctgagagtgaagtgacttttccgagggcacacggtgggtaagtggcagtgccagcattccagtgctggtggcagcttctggattccttacgctgctccacgaggctttgcttagccattgggctcttgttttgtgctgggcacctgctaagtgcttcacgttgaatttagtgctcaccgcacctataagttggtattactgtgtccattatagagacgaagaaagcaaagcttagggaggtttccaacccaatgatatgtagtcggtcattggcctggccaggattcagccttgagtctgtcttggtttggaagcccttgcccctgatatgtcacgtaagtccctggatccacatagattgcaatcctgatctctctgtaaatgaaacttactgattctggggttgcccataaccttgtctgcgctcctcaaacccataatcctacccttttgcagcctcaccgtcagtaggtggtctaattatcactttacaataaggtttcaggggactaggctggttttacttcaggtatggaaaagcctacttacttgcagaatgtataaaacacttaattatcctcttggaaatgtcttatagcatgtgactttcctatccacattaccctgatcctaaagttttatattctttaattttgatcccagtgttgttcagatatgaaaatgagtacctaacaccaaatgccagtttccttcttagctatagatgtacatttgcaaaactttcttttccttgccagacattcaagactagttttaaatttactgactcatctctggtggcttccttccccattaattggaaaatcaagtactgattacagagaaaagggacaagtggaagattaaagatgttactgtgttgacaggaaaaaaaaagccctgcaacttttactagttatttttcttgcaattgtttatgcaactcttattccctttaatcttgtagctttccacagacttaaacgtaatttcttatgctaccaagttgttttgagatgctgtgttaaaaaaaatatagccaaaatgtgaaaatgctgccaaagaatttccgtcaacctgagttctagttactggtggttcttcatgtccaggaagagtaatagtcttcattattattagctaatactttcctgcgtggctgcttgattccatctcgagccgacccaattaaggaaactggtggtttccaagccttttgtcgagtgtcataagataaagtagccagtttcattatgtaaaggagagactgcagacatagaatggactttaggagtcagggttcactagagaaaacagtttaatgtcaaacatttgctgacattctgccatgatctgggcttggtacaagatattaaaaaggaatggataacaggaggggtaaaccagaaaagaacgggtttggtcactgacaagtggtggatggaaaaggggtggaaagaaggaagaaacagaaatggggaataaggaacaattcttccctgagcttgactttttgcatggttctgacctagaaccatggcactgtttcacacacctgacaagtaagccaacaattcacatcaaccaagaggtgggagggacccagaatggcatacaagcactgatggattgaagggagtgggaaatgcaattgcttgatataaccatatttaagggagtagggagttacctaattaactttggaaaacaacatttttaagtggatactataaggctaaagacaataaaaaactatgcataaatggtgtacttcagttagtaaacaggcttcttaaggggcatggtttagcaattctgaaattgccttatgtgaatactaggattcaacaaacaaagagccgagttcctcactgtcagagaaagaggttacaaataggaaagggagaagattgaaatgaacttggtgctgttggatgggaactagaagtatctgtatgaacatatggttctgaatggatagatggatggatggatggatggatggatggtagatacaaacatacctatacagatatacagaaatgaatatggatgagagggttagtgtcatacctgtatttcctagctttgttcactgagagggcctaaagaactgacgcccatgcagccataagcatccctagggcccagactgtggtgtctaaacaccattccccagtcagaggaaccacggttccttggagaagtagttgattccaggccaggacaggaaaaatactagatgagcctggaatatactgtagtgccagaacataaggaagttctccagaaaggtttggggcagggcagaatgttatagaagcccacctgaagaatctccttatggccttagctggaataatttgcaacaaagtgatagtattagatttttttgtttttgtttttgagatggagtttcactcttgttgcccatgctggagtgcagtggtatgatctcagctcactgcaacctctgtcttccggtttcaagtgattctcctgccccagcctcccgagtagctgggattacaggcacctgccaccacgtctggctaatttttttagtagagacggggtttcaccatgttggctaggctggtcttgaactcctgaccttgtgattggcccgtcttagcctgccaaagtgctgggattacaggcatgagccaccgcacccggccgatagtgttagattttaacccatacggtaaaataaatatccatgagtccatactgacataaataattgaattaacaagccaggagaacggatagctcttttttgtagaagaactccagttacttaatgtataagaaaggaggtaactagaatatcaccaggaggcaaacagcacagtaattgttatagacaagatccactgatggatgtcagaattaatgggtaaaagtttgaggaaaaacacgatatttacgtagtcaacaggatatttgcgtagtctcaaagtatcttccccaatatatctattaattacaaaacaaaatgaaaagagtgtctttaccgtggaagccatgagaagcacattgtgtacagtatgaaaacgggaagaaggcagagcaccaccttcagcctcagctgggaaaatgcaggttgattgtcacaaaaaatactacaaaaagccttcgctgctctgcctgtgtctgtgaatgaccacgaaggtgctacgtgtgtttgattttggggttacaaataaattttagcaagtaggcacgtttacaaaaatggaataaataaatagtaatgatggactgaacttattatctcgccctttatagaaaagctttgccaaccctcattttaacttagtctgccttcagaaactagtctactacttcataaacaacttaagaaacttacaacagtatacttctaattaccactctacccactttgtgttttgtcatatactttacttctaccaatactataaaaaataatgtgctggtgattacttatctcctggccctccaagaaaaaattttaaaagcccgatttgtagcatttgctaattttatggtgtgaatactcctaccacagccccccaccgcacctgcttttttttgagacagggtctcactctgccacccaggctggattgcagtagcataatcctggcttactgcagcctcagcctcctgggctcaagcagtcctcccacctctgcctcgcaagtagctaggactagaggtgtacaccaccacgctcagcaaatttttaaatttttttgtagagaccaggtctcaccacattgcccaggctggtctcaaactcttgagctcaagcaatcctcctacctcagcctcccatagtgctgggattacaggcgtgaaccaccacacccagctacagccaattttaaactaacaacatgacatcactaaacatagacttgtgaagacatgtgaacagtcagctctacatgccagtgtaagtcagctccaacacaccactggctacaacttccacttacattgttattgtttttaatagtagccttttaaagatgtttaaagaaagatagatatgaaatatcttttaaagattcattatgcacatctaatgttcattctgtctggtgtcctttatttcttcccactgggtttctgtctgttttattctctttctgaaaatatttgtgatagtaaatgtctgctggagatgaattcttccaggttttgtctttctgaaaatgtctttgttttgcttttacttttgaaagatgttttcactatatattgaattcctagttaaaaattttttctttcaatgtgttaaacacggcattccatttttttctggcttccattgtgtacagcgagaagtcagccataattcttgtcatttttctctgtatgtaatgtttctgtttacctatggttactttcaagattttctctttatttctgtttttcaacagtgtgtttgtgatgcaccaagtttggttgtctttgtatgtatcttacttgggattcactgagcattttttatctatggtttggtgtcatcagcttggaaaaattgttggccattgtcttttcaaaaatatccttgcttcatttttctcttctttttttgagactctagttgtacccatagtgaacatttgatatgttcacaggcctcggatgctctgtttttctcctctctgccgccgactcttttttcctctcctatttcagtgtagatggtttcttttgaacctgactcctttctcttgtgcccagtgtggcaataagtccagtgaaagaattcatctttgatatcctgtttttcatttccacttccatttggcttttaaaaatgtatagcttccatttctctgctgaaatttcctgtcttttcacagatatttatcacagttattttaaatcttcatctgatgagtccaacatccaggcttggtccctcattctgttaactgtttgtttctttacagtgggtcacatcacttcttcgagggtcttttaatttttaagtaaagtaaaacctggtgtgtaaaagaatgacagagacagaaataacactagaagctgaagtaaataatatttacatcagtccagaaaacagcatgccttttctgttcaaacccattcgtgtgtgtgtgtgtgtgtgtgtgtgtgtgtgtgagttaatttagtatttatagttgaaccgggcctgggctgtattgctgcttaagttagattcaagacctcacaaatatcaaattaattgaaggtaggattataaccttcccacttgtagtggcttaggatatgaatgcctggaaggtgtgtctattttcctgccctgccattggacttcagcaggctctgtgtgtgtgctgagccttgtgggcgagagcctttcagttccctcatccctttccaaccaagatggacctcttcttggtcctgggtgaggcctagagtgccagtgggaatcataatatttgcctcatgtgattataattcactggtcaattagacaacatataaaaacacctcaaccatctcagtcacgtattaagtgatagctgttattacatctgtggtgattttttaaaactttttgttttgaaataatttcagacatacagaaaaattgccaaaaaaaaaaagtactaaaaaaatcccatctacccctcaccatattcctcatatggtaaaatttcaccacacttgctgctcctcccatttctttctttctttttttttttttttttttttttttgattcagagtcttgctctgtcacccaggctggaatgcagtagtgcgatctcggctctctgcaagctccacctcccaggttcatgccattctcctgcctcagcctccccagcagctgggactacaggcacatgccaccacgttcggctaattttttgtatttttagtagtgacagagtttcagcgtgttagccaggatggtctcgatctcctgaccttgtgatccaccctcctcagcctcccaaagtgctgggattacaggcatgagccactgcacccagccctgctcctcccatttcttaacgctcacatatatctaaatctacatctgtctgtttatacgaactttcttctgaagagctcttttactctggaatgctttagtgtgtgtttactaaaagcaagtactgtataattatcaaaatcaggaaactaacattgaaacagtagtgttatctaatctacagactcttcagacttggcccattttcccactactgccacaaatttcagtccaggattataccttcatttagtgatatatctttagtcgcctttaatctagaacagttatccagctttttaaaatctttcatgaccttgacatgtttgaagagtataggtcatttattttgtaggattttcctcagttcaatttttctgatgtgccttcatgattggattcaggtcctgctttcagggcaggggctgcacagaagcgaggtcttgtccttcttgatgcattggatcaggaggtacacgacactccccatctcatggccggtgatgccagctttgattgttcagttaagatggcatctgccaagtttctccactatcaatttactattttaccctttgtaattcatacatatctcatgggggaatactttgcaactctatgagtattgtgtttctcatcaaacttttgcctgctactttcagcattcactgatgatgcttgcctgaaacagtaactactgcagatatactgtatttgtttcccagggctgccttaacaaaatgccacaacctgggtggctttaaataacacatttgtcatctcagttctggaggccagaatgctgaaagcaaggtgttggcaggttggttgcttctgagagctgtgggaagcatgtgttccatgctgctcccctagcttctggtggtttctgcaatctctggcatcccctggcttgtagatgcatcactccagtcctgtgcctttacatggtttctccctgtgtctctacatcatctttcctctttgtgtgtctttgtgtccaaatttccccttttcataaggacactggtcatattggattaggacccatcctgatgacttcattttaactggattaataaagatcccacttccaaataagctcacattctgaagtactgggagttaggatttcagcatgccttttttggaggacacaagtcaacccgtagcagatgccaaatggtgatctatagcaatttttaatggttctctcagtcaagttcattgctaagataataaatagaaaatttaaaacttcagttaaaagatggcccagcaatgtgccagcttaaatctcaggcctgtatgcctgggaatttttatctttagccatgatctgcatgtttgaactttaagccgtttggtgaaccaatttcaacattacccttaagttctaatgtcaccttttatatccaggctagttgccagctgccttttaagaggggcgtgtccctgttctctaccatgtgtgtggagatttcagtagaccagggatgctgagcaccggccagctctcagctccagttttttttgttgttgttgttgttttgtttttgttttttttttttttttgagacagagtcttgctctgtcgcccaggctggagtgcagtggcatgatctcagctcactgcaagctctacctcccaggttcaagtgattctcctgcctcagcctcccgagtagctgggattacaggctacatgccaccatgcccagctaattattgtatttttagtagagacaggatatcactatgttggccaggctgctctcaaactcctgacctcaggtgatcgcctgcctcagcctcccaaagtgttgggattacaggcgtgagccaccgtacctggctcagctccaatattgtgagtgccctgtgctggcagacagggcccaccacttgccagcagcagctgacccaggtgctggagtgccacgggccacagagccctgcactggccaaaggcagagccgcaacatggcccaggcactgagtgacatgtagtgtctgtttgagggggtaactggttgtcactgcttatggactgagaggcctcttccagggagaagctgtaaggaaggtacagcaagaccctcagaataaaaagcaggcctgatttcatggcagcataaaatagtaacaaatagcccatctgccctgggaaggagaatcaggaagattcccgttgctgttgggcagttcttcctgtcaggtttgtcagactgagactcagagaccaagtttgtaggcaaaatggggcattgctgaagtgtcaccgtttatgtgccagcaagggagtggtaaaaggaagcgttttgcctgtggcaacttgggcggcagaaagttgacagaacaagcacaagccctcaaaccccctgacggcagccgagtctgctggcagcatccgctgcgtgtgaagccccatgcaggatgacatctgtgcaagcgaggctgcccagggagggttggcgtctggcagcctctccagaggctgcaggctgtcctaatggcagcttcgagatctgccattaggacaaagccattctcatctccacccaggttagagtgggcagaacttccaggcaggctggctgcctctccaccaagaagcagcacattagttttcctagtgctcccataacacagttgcacaaactgggtggtttaaaaacagaaatgtttcgtctcacagttgtggaggccagaagcttgagatcaaggtgttggcaggaccacactccctctgcaggcgctggggaaggtctgtcgcaggcctgtctcgcagcttctgatagtgcttggctggtggcagcctcactctgctgcctttgcctgacgttctccctgtgtgcctgtctgtgaccaaacttcccctttttataaagacacctgtcctattgcattaggggcctacccttctccagtatgacctcttcttaactaattacatctgcaacaaccctgtttgtagataaggtcatgcccttaagtactggagcctaggatctcaacctctgtttctgggggaaacgtaaattcaacccacaacaagcaagcagcaccttgtgctactaggcgtcagctggcagtacctggctctgttggcattccaacagcaatgacagcacgataatttattaactatgatgcttacatggcaaatgattctctcttcccctatgccagtgtttactgttgctcaggctgagcactgcagcagcccattttcctgaccaagggcatgctgtgtacagtggtgtggccccaaatttgatcacacactccatcaattaagaaaaatgttttctgcatgcatccccagcatatgagtattcattttaaaagtatacatgtgcactgcattaccactatataagttatgaaacatatacaaaatgaatggtaagatatttgataaagatgaaatcagcagtattttaaatgtcttgctatttctagtgacttggtactatcattagctcatctcaaggtccagatacccttgagatgggatttctcgttaatgattcaggatgtaaatctaaatttctaatgggcttccaggcaatttcaggttttgttggggagagctgcttcttgtcacatgtgactaggttgttggtatttgtaacatggagaccaatgacgacaggcaggagcgcttccctttgcttatgttcacttgtgcttgtattgagattaacttcggcctccagaggttattttttcaggaattttttttaagctacttgtccattttgtaaaagttagcttaaattcactctaaattcatcatctgagcacagtttgaggcacttgggatatattgaggatgatactagagaattgaactcattaccccgttaaccagatggagtcatgggtatgttgcaagacactgaaagcagatgaagggcatggaggcctttgggtggcggccccacggcttccctgggagctctcaggaccaggaggccggtgagggacagtctgcctgggggccacatagtaaatagtggcaaagcttaattcattttgtttctttagataaaaaataaatgtaaatagaatatatcttcatgtttagctcattttcccagctaaataattgccttcttaagcacatgggactgccttaatcatggattaattcatcatggcccaataccacttttgttgttgtatataatagaaattaaacatttctcccaacacctgtggatatgtgtattttagcatgatcagtagaaatgacgctgtgagtattttaaggagttttgctcagagtcgccctaggaacacagggtaatagcactgtcaggattcccagtgaatctagcctgattcctcctgtcctggaggtggatgccagagaaaggcttgaggctggcaggcagtgaatcaaagcctcgccacagagcggcacagcatatgggtacccatatgtccgagatcctggctgaactccttagatttggggataagaaagaaagtgcgggcggccaggctttcctctagggccagtggcttctggtaataggctttgagacagtatttgtacaactctggctacataacggatgtggaaaccaggtgtgatttatgagcttccgaatggccccttcctgctctctctccctccacaggtcccagcctccttctaagattgccacactcctatctacaccggcaggactgttttgatctgatggaaggagggaagaaaggaaatggggctatcagttctcccttccaggctctgctctgtgtgtctgcactgcagtcatcctcttggaacggaggctcctttgtttttatggtgtgacttgaaaggttgcactatttatcaggagtgttttcttactacataaacatatgaactgaatttaaatcaactctccagtgcttggattttatagaatgaaatatgtaataataaccacatgaaagtaagagcccttattgagtttattacattaaaatgactaggcctgaagtttttaagtactttttatctagataagccctgttgacttcaattgtctcagaaggcatagcactcagaaaacacttgctgaatcagtaataattatcttggactttgattctctaaagataaaatagtcaattaacttgattacttcttattttccagttggtgaaaaaaggtgaatgcagtagtagccatgttggggaagaaaattctttatcctcacatgttctgttgggccttcccttctctctcggcagatgtttactttgattttttatagtgcacatcccctaaggcaggactgtagtcattactgtggaattaatacgggctggagtatcaagggtggtgttctacccaagggattctcatagaatcagcagatttagagttggacacaacctgaggatcacttaatccaggtgctcctaaatggaggccttgagaggtgagatgtcagattttgctaaagatccagaaggatctagataccaaaagtgaaacatatattgggtagcaatccacaaagttttttgtgttaaaaattagccctcgtcctcttctgggcatatacccaaaagaattgaaagcagcagggtcaccaagagatatctgtactcctgtgttcatagcagcactgttcacagtagccaggaggtggaagcaactcacgtgcccatcaacagatgaatggagaaacaaaatgtagggtatacacacacacacacacacacacacacacacacacacacacacacacacacacgcaggaatattattcaaccttaaaaaggggaaatcctgtcatatgccacgtcatgggggaacctggaggtcattatgcctagtgaaagaaaccagctaccaaaggaaaagtactgcatgattctatgtatatgcagtatctaaagtagtcagactcatagaaagttagaatggtgcttaccagggactgggggaaagggaaatgtggattagtgtttaatgtgtacagagtatcagatttgcaagatgacaaagatctggagatctgtttctcaacaatgtaaatatacttaacactactaagctgtacacttaaaatggttaagatggtaagttttgtgataagtgttttaaccataataaaaatatttttaaaacaaaaaacaaggcccttgctgctgtggtaagcagtttgatggaccctcaaaaagctaaacagcatttccatgtgacctggcaattcccttcctaggtatacactcaagagaactgaaaacaagtgctcaagcagaaacttgtacatgaatgttcatcccatcattattcacaatagccaaaaaattgaaacagcccaaatgctcatcagccaatgagtggagaaacaaaacatggtaagtcatacaaagaatgaagtgctgattaacgatacagtcatggaggaactttaaaaacattgtgctacataaaagaaaccagacaccaggccacatattcaacaaggccatttatatgaaatatccagaataagcaaatgcatagacacaggcagcagatgactgattgccaggggctgaggagaaaaaggggaatggtgagtgacagcttaatgggtatcgattgcttttgaggatgatgaaagttctggaattagatggtggtggtgggttgcataacatagtgaatgtattaaaagccactaaattgtataatttaaggtggttaaaatggattttatgttctatgaatgttacctcaataagaaggaagtccttaggcatgaaaattgggaaccatggctaggttcagcctgcacattgtcatcactgagaaagcggaagctcactgtggtgacaggactttctggaggtccatggctgaactcctcagggacatcaggactcttcagggttggggagagaggcatctcatgcagccaggctgcaggcccaggcagcaaggacacattgactccttgaagaagtctcaggatggggttgaccacaggagaggtgggtgcctggggcttttccagggccacctctctgccctcctcctagagcagctgcctccacaggctggcagagggttggccatagtagatccatgcttcacacccagacaagtggcattgagaggaagaaacaggcatcttctctttcatctctttttaggagcaagtaaagcttcgccagaagccccctagcaaactcattggccagaatcaggtgacctgcctatccctaagtcagacattgctaagattgccttagatatgtggtttacagtggcatggaggttgggaagtcaggcacaaagaccagcaccacaggcagtgtggccgggcagaagccaggctagggaggtctcctggagtagtggggatgagcaggtggcccaggtctttacagaaaaggaatgaagtgcagggagcactgctgagccagatgttaggacctggagcctgggcagtgaggttcaggaaccctcacacagggctcgggatccaaagccaatgcagctggtagcaagagatcagaatccaggtccagggtctgaggtaaaactggcaccagccaaagccatggagagattcctccctttcctccacccgcagggctctcagtagagaaagattctccccaccagggctctcaatagagaaagattccccccaccagggctctcagtacagaaagattcccccccactagggctctcaatagagaaagattccccccaccagggctctcagtacagaaagattccccctcactagggctctcagtagagaaagattccccctcactagggctctcagtagagaaagattccccccaccagggctctcagtccagaaagattcccccccactagggctctcaatagagaaagattccctccaccagggctctcagtacagaaagattcccccccaccagggctctcaatagagaaagattccccccaccatggctctcagtacagaaagattccccctcactagggctctcagtagagaaagattccccctcactagggctctcagtagagaaagattccccccaccagggctctcagtagagaaagatttcccccccaccagggctctcaatagagaaggattccccccaccagggctctcaatagagaaggattccccctaccagggctctcagtagagaaagattccccccaccagggctctcagtacagaaagattccccctcactagggctctcaatagagaaagattcccccccaccagggctctcagtagagaaagattcccccctaccagggctctcaatagagaaagattccccccgacccgggctctcagtacagaaagattccccctgacccgggctctcagtacagaaagattccccctaccagggctctcaatagagaaagattccccccgacccggtctctcagtacagaaagattgccccaaccagggttctcagtagagaaaaattcttctcgaccagggctctcagtagagaaagattcccccccaccggggctctcagtcccccactcttgtagtagatttgtataggacagggtttcgtgtcctcataattttttcagcagcagcccttagctgttttccctggcacgcacatctgagcatccactcgctgcacgtgggcatttgcttattcccctgatgtctgtaagtgcctcgtctgtgccaggtactctacacagtggggacacattagtgagcaaaacaaaatccctcttctcacagggcagccatgccactgggaacaacagatgataagcacatggacagctgaagatgagctgtggcaagtagacttagcaatgctgcaaagaaagcacagaaggcaaggggcagtgaagggtctttatctcctgagaaaaccgcctgtgaggacagcctgattgaattttcgtaaccaccattaatggtagccaaggccttctgcagaatgcatgtggaaagaggaaatgaagacagatgctagggtagctgtcccaggacacagctgtgcaggcagggtcctcgtgggcccacaagtgcatgctggagctcgccaggcaggctctggcagttcctggatgtctgagcacttctgcttcactgttaacttggggtcgccgtaaggatgaattttctgttaaggggaactggagtagcatctctgtggacatggcttcaggatgtatgggcaagcctgaggctaaggatcctgcaaactaggcacgatcaagagtgtttggtgtgctagtcagaatgtggttggctgtagttgctctggcattctaggtagggacaaccgaagaaagaacactggaaaataggggacatctttggtattccaagaatttgacaaaacctctaactagatcactttgaatttatctaagtcaggaataaagaagattataaatgacatctgttgagcattcctttgtagcagtttcagagtgataatgaaatttagggcaatcttggccaatctaaattaagagaagtaattgctgtttactttttgggggagcatcgtgggaggtaggaaatgaaggggagggaagctaagatgatggagtagaaatacacatgttctgatatgggtgcctattttcaaagatggtggtggggtataaagtttgtttgattataagagcatgaattcattgcatttatctaacattcctacctacagaacagcagagcatgacctctgtagctaaggttaactttcagctatacctggcttcagtggaaagtgggcatgagggaattgttttgacatttttgaaacctacactctttgtgggaaaagggttgttgataccctgcaatattaaataagttccgtgggttgagaaaaaaactaggacaattaacaacatggatgttgtcaattaacatgctgtttaattaacatgagaaagttgatactctttgaacctaaaagagcacatagaatttcgataggtggaaatatggtgaatctgtactggttgggggaacagcatcaatgttcattttgaaaaaagcagaataaatgatgtcattgattctggggatggggctgactggccctctccccctgcctcttcctctccgcatctctccccccaattcattcacactttgacacaagggtgccacgtaggggtatctctccagaccttcttcgtgggttagcccctcagccccctgtccagtgctgtggtcgtgatcgaaagttgtatctaaggcaagacatgtttttcctagtgtgtgattaatttgaacccaggagtttggtgattgtatctgtttacttggacttactggaaggtcaagttttctcaagaacattaacaaatcagtaaaattatcaattagtagcactgctttaatttcttaaactcagaattgacttgtccatacatccgtttatatttaatttccctgaagctctgaaaatagggcaaaagaacatagtcttggtccatcagaggtcttcttttttgtctttttggcctatcctttgggctcagtctaaatctttcccccaggattttaagtaactccacacttaaggtttctaaaaagtagcagtgatagctgaaaacctaatacagactgaaaatgaatgggaagttcatataaatcagtcataaacacatcaaattcccagtgaattcaaaagaagatgaacaaataattctcaaaagaataaatatttgtaaacaaatattagtaaataaatacaaaaaaatagcatttcactttctgatatccaggaaaaaaaagtaagttacaaccgccttcatgttcttttctttgcctgttaatcatagacagtcagccttctgtatctgtgggttctgcatccaagggttcaacccacggcagagtcacccaactgtgaactgaaaatattcaggaaaaaaatggatgattgcatctgtactgaacaggtacagacttttttttcttgtcactgttccccaaacaatacaggataacagctatttacatagcatttacatcgtatcaggaattgtaagtaactggagatgatttaaagtatatgggaggatgtgtgaaggttatatgcacatactacactattttatatcagggatgtgagcatctgtgggattgtggtatccacaggggtgctggaaccactctcccatggatgccaagggatgactgcatagattggatatctcaatttatactcccagaaacatagcagattgcctacatacagcacaccattttcgtccctcaaactctgctcccctttccatcttgttactaggctctcataacttggatattgagttgtccaagccagaaccagggaatcaacatgtatttctccctctccccagtcccccccatctaaaccctcagaatgaagtcgggcccttgagcatcaggagcaaggcagcaggccccatccccaccaccctctcacggccgactgtcagggcttcctgcctggcactcagaaccagccaatccaaacgtcaagtctcagcttggaagccagccccaggaaccctttcctgacagccctgccttcatcagggtgtgctgacccctgtgcgttcccacaggcacctgggacttcccctctcatgacactgtggttccattgtgggtggttctcagactacaagctcccccggggcagtggccaggtactgttgcctgctgtgtgccagccacccattctcctgacacatgggcacattgagagacagttcctatggacatgtcatgtttctgcacagtccaggtcctctgagcaaagacatttacagccaagttaataatgttcgtataaggagacattttaggacaatacagcttacagaagtttcccttccacttccctaaaacagttgcttacattccaggatcaagctaagtctctgtctctccctctcgacagtggagagggaaggtcaccagcagccctgtacaaggtcagcgttccctaattctggggcttctcttctgtgatgattccactacatgcataagtgacacttggccctcaccatgtcacatcactgtggggactggcacttagcaaactagtgctaagatgtcgttctttctgctctctctgactcagaggtcttgcaccttctgttgtgaacactcatactcacacacacacacacttttccacacacatgcacacacagtggcaggctgacgtattagctgacaagtgacataaaacctcaggcccttcacaattttggatgtaacgagggtaagcttggagggtgatatgactcgcctgttgtccctcagctaagctgaagtggcaggggctgaagagcagtcagaaccccgcctcctgggccggggccggcaccttcaccgtcacacctctgcctcctctgtgtgaccaaggagcctcccaaacttgaatgcacttgcagatcacctgagaatctggtcagaatgcagattctgcctcagcagggctggggtgggcctgagactatttctcatgagctcccagagttagtggtgctgcttgttccccaccacgctgtgagcagcacttatctgagacacacacaccatcccagtctctgcaatgcaagtgaagcctacacatttcagaaatgtatgaacactgtgttaaagggagaaaatggttcatgaacagtttattctttcactgtgggtgagtaatgataacttcctaattggccaccatatttataaggactccagaggggaggcggaagagagtataaatgacaactgtccaacaggcagaattgaacatttttttccatgggacttgaatctattttgaaagcatctgtcatgtgtcctgttgactttatgattatgtctcaacttaatcggtccttggggaatgagaagtttagaagattgtccccagtatgacttaagcaattcagcagtattcaggaagtctaatagccaaataacagcaaatacagctacctttagaccaggtgctttacatacttagtcttattagtcttcacatcctacaaggtaagtggtgggactctcttttgtggtcaggtatatctactgagaaagactaatggcatgcctaaggtcattaccaaagtaactgacaaataagatgtgaatccaaatgtgtgactccaaagacttccagtctcctgcccaccgtttctgctctgttaactagtcaccttttcccaaagagttgtggggaaattattgagaagaaagcctaaaatcctacttcaaatgtttaagttgagagacatcttttcagcactaggattgtattattagggactgctttccatcaagctcatttaagacagaggagtttcagtgattttccttctaccccaattgtcaactcaagctttgtggctttataagacaccacggcagtgttggagcagctctgcagcggcaccggcttctgcagaggctccctgcctccacctgaaggtcagcagctgccctggtgagtcttcggatcttgtgggcaggagcctcagaaccaggaacacaacaaccactcagaaacccctggcccagcgtgcaggagcccacacgcctcaggactggagacagcccgagctcaggacccggcataaccatgtcagaggctagcgattggagactttcaaggcgctgcaaataaaggaaattagactggaaaagtacaaacgagaggaagctggagccagggttaaaaccaatgactcacctctaccaaattcatgatgacgataagtggaaaaaaaataagcctgaaatgggaagggtggtgccaaatgggcccaaaacaaacacggctgaagaatggaaggtttgttttcactttgccagggattccaaatgtgatcagagatagaaacaaatgcagccctttcccagccttagcgaggccaagcccatggggtgttgggtcagaggggagcctgaaggggagaggggggaggaagaagctcaagtcagcacacagctgcagaacccccaccttctcctcctggggggagtagagagctacaccccctggcggctgttgggtttgtcagagcttgactctgtccagatggctgcgcacccgggttgagaggccctggggagcaccagcactcttccctccaagtcactggagccctcatccattagggacacagaaccagaaaggaggaatgtttcctctgcagctttagtttgaccccacctaggctgagtctttggtctgttagttcatgtgctggttatgactttttgaaaatcttggaccacatttatgactcttaagcaatttaggtacacatagtccacaagagccagcctcccctggtctacctgaaatgtgtgtaaagcatttaatctaggaaagccctaagctgatgggccctggggtgctggcctattgctcctgggtggcccctggtaaatcatgaacctttggtgcctgtttcctcatctgtagtgcaagatttgtgcatgtgtctctttctcttatgggacttttatagagaaaagaaaatgagggaaaaatatgaatatctgtaagctttgaaaagaactaaaagcacagcgtgaattaacagcagtcccatattcatggggtttctgttatagaggtggaaccttgctagactctggagaaaataagaaaggataagttagtcctcaagaaccttccagagatggattaatcctcactgaggccatctgcattcctttggtggcagagtagttcctgggtaggtatttataaatcatttcaggcttaaacaggattagaggtgctgtgcttttaaattgttttaatttagagtttttaccagaaattattgtataacattttgagggtagcacaaggaaatggattgcctttgctgtatggtgccttgaacacatcccacaggtttacttttttgctatatgtttttttctgcacccaaacaatgcaccgtttgtattttggcatttacttcaataatcttccaaatagacacccgcaagtacacttggatagcagacagtcccctaagatacagagcaagatgtgcgactctccttctgtatccttaggagctctgtcaacatagaaggtgtcacaactcagcattgtaatgaagacgaagataatggcatataataacatgtagggccaactcagaccagagatctttaatgaggtaggagtttggtttcacacattcttttgctttagtatctggcctggagcctgtgatagaatctctcctcagaaagggctatgtgttaattagtgactgtaacatgctgcctttttctttacttaaaatgctcaagaattgttttgtttcttgcctgggtcttcttaatgattgtttcttatgtgcctccatcccttctctgctatttctttccccaatatcccaatgaaatgagcttcacgagagtagttttgcttggatgacccaaaggagttaagtactatttccaaggttttgtagccactgaattgttcttacaaggcatcgtgctgcaaagcaaggactggcctagaagacctgagctgatcgctgtactaatagccagctgaggagctctgtgcaaatcaaattatatttacaggatagactatatatagggcgttgaattaattgccatggtttttatcattcttatgttctaattttttgacctgatgtgctattaatacagtatcttcccttttctatcagtgtgagtttgttattgtaaatggtgttttacagggactgaacatttagcttttcttttttagttgcttactcttttagaggagactgtgatggcaagagggaggagacatggcaaaatacataaggcatatctgtctatatttctttggcattgacatttcatcaagggacatgactctgaaagatggctgtcccttctaatggctggactttgcggctgtagtggccagaagcataaagacgtgtaaagaggatttttcggtacatcgaacactgaatgtctggctatgcagcttctgtgattgatattcggttctgtgggctccttccttcttaagtgcagtctgtaaaggatggtggggaatagtaatttcaagaaagatttggcatgagtatcagtcgttgggtggtgggtgtgagaagggcgttgctattggtgggtgaagtgttgtcacttagatgttgtcattttcccccatatagttttcattaaggtgacattgctgtggcatctgggtccaggcagggtatagcagccagcatctgaccacttgcagtcgtgaacatatatatatatgtatatatatgtgtgtatatatgtgtatatatgtatatatatgtatatatgtatatatatgtatgtatgtatatatatgcatgtatatgtatatatgtatatatatgcatgtatatgtatatgtatgcatatgtatgtgtatatatatagagagagagtttattaagtattaacttacacaattacaaggtcccacagtaggctgtctgcaagcttgaggagcaagaagagctaggtccgagcctcaaaactgaagaacttggagtccgatgttcgagggcaggaagcgtccagcatgggagaaagatgtaggctgggaggtgaggccagtctctcgcttcatgtttttctgcctgctttatatttgttgatggctgattagatggtgcccaccagattaagggtggatctgccttctccagcccactgactcaaatgttaatctcctttgacaacaccctcacagatgcacccaggatcaatattgcatccttcaatccaatcaagtcgacactcattattaaccaccacaagtccatcccttgtcaacttgaacccatacacatttcctgagatcatacataatcttcaaatacaataagatcataattacacctaacataatacaactatcctttgtactaccagaaacgcactgatccccaacccaaatactattacataagattagcaatacttaaatgctgatatgaagtcagtaaatcttatgtcacacaataaaggaaaaggaaatacaataaagatattttcttagtacaagtgtatacatgcacaaacatgtttttagcaaaagaaagaggaaatactcatgacaattacagtccccatttctggagccggaactggtcacatggtcgtagctggtattgatgactaccttcttctacccaatctgtattccctttgccttcagcaagcacctcagcaggttgtggttttttccctgcttcattcttgaggggtctgagccatttgtagtcctgcctgggttgggctgttgtagtttcccgtcgaccttaatcacaggcaatggtaagactaagagacaccctaatggatctcctgtattccatgcatactcttccttatctctgttgtggagttgtagactgatttcatctagagagtctgggtcaatcaccccagccaacactgtaactcccttcttaccctgttgacttaaggtaataagagcccaaagtgtccaggcaatcttaacttcaagtttaatggaatcattgttgtgtctcctggtagccgcgttcctccctttggaactaagacctctaggccagcagaacataatgttgtgggaacaggaagcaaaaattttgccagtggatcattaggggtgatggtgagtagtgccacttccacttccacctcttagttcctggacccgtgaatcctggctgtgggagaaacagtaacatatattggaggctgactgagagcatacacagccttttggagaactttgccccagccctacaaagtattgtcacctagttagtgttgtaattgtgacttcaaaaggccactccactgttctatcaatccagctgcttcaggatgatggagaacatggtaagaccagtgaattccatgagcatgagcccagtgtcagacttctttagtcataaagtgcgtgccttggtcagaggcaatactgtttggaataccatgacagtggataaggcattccgcgagtccacggctggtagtcttggcagaagcattgcatgcaggataggcaaacctatatccagagtaagtgtctattccagtgaggataaatttctgccatgatgccatcttccatgatggaaaaggtccattataatcaacttgtcactaggtagctggctgatcaccccgaggaatggtgccgtattgagggctcagtgttggtctctgctgctggcaaattgggcactcagcagtggctgtagccaagtcagccttggtgaatggaagtccatgttgctgagcccatgcgtaacctccatccctgccaccatggccactttgttcatgggcccattgggcgatgacatgtggctggggaaagaggctgagtggtgtccacagaacgggtcatcgcatccacttgattattaaaatcctcctctgctgaggtcacccattggtgagcactcacaggggatacaaatatcttcacagtttttgaccactgagagaagtccatccacatacctcttccccaaatttctttgtcaccaattttccaatcatgcttctttgaagtccctagccatccagggtgctttctgacccatcaagccataaagtgggtcatgcacagcagcattccatcatcaaatggaagtgatgtaagtatgactgggcttgaggaagtcctgaaggcacaagtaagttacatgaggaagtggctcaaatgcccatggtctccttggtcagaccatatggtcaaaggtattatgtataaagtcaataaacttgcttctcacaaacggtgaatcagaccgcttggaatgacctccctgaccatccagccaaaccattggctgcagcccatgaatcagtatgtaatcacacatttgattatttctccttccatgcaaagtacacaaccaggtgcactgctggaagttctgcccactgggaagatttcccttcactgcatccttcagggatgtcctagaaaggggctgtagtgctgcagctgtctacttttgggtggtgcctgcatattgtgcagaaccatctgtgaaccaggctctagtcttctcttcctctgccaactgatcatagggaactcctcatgaggccatcagtgcaggctgtgggagagaaggcagggtggcaggagtggagaccatgggcatttgagccacttcctcatgtaacttacttatgccttcaggacgtgctcaagcccagtcacatttatatcacttccattcgatgatggaatgctgctgtgcatgacccactttatggatagatgggtcagaaagcacccagttcatggtaggcagttcaggtcacatggtgacttcatgacccatagtcaaatgttcagtttccaccaaagcccagtaacaggccaagagctgtctctcaaaaggagagtagttatctgcagaagatggcagggccttgctccaaaatcctagtggcctctgctgtgattagcctatggggccctgctgtaggctccaaacagcacccctatctgccactgacaactccagcaccgttggatctgctgggtcatatggcccaagtgacagagcagcttgcatagcagcctggacctgttgcagagccctctcctgttctggaccccactcaaagctgacagcctttcgggtcacttgataaatggaccagagtaacacatcaaaatgaggaatgtgttgcctccaaaatccaaataggccccctaggcattgtgcctctttcttggttgcaggaggggccaaatgcagcaacttgtcctttaccttagaaggaatatcttgacaggctgtacaccactggacccttagaaattttactgaggtagaaggtatctgaattttagtcggattgatttttcattctctggcatgcaaatgttttcaccagtaagtccaatatgtttgctacttcctgctcactggatccaatcagcataaggtcatcaatgtaatggaccagtgtgatatcttgcagaagcaaaaagcaatcaaggtctctccgaataagattatgacacaaagccagagagttgatatacccctgaggtaggacagtaaatgtgtattgctggtcttgccagatgaaggcaaattgcttctggtgggccttatggacagaaatggagaaaaaggcatttgccaagtcaatggctgcataccaggtaccaggagatgtgttaatttgctcaagcaatgaaactacatctggcacagcagctgcacttagagtcaccactaggttaagcttatgataatccactgttattccccaagatccacctgtcttctgcacaggccaaatgggagagttgaacagggatgtcatgggagtcaccacccctgcgtctttcaagtccttgatggtggcactgactccgcagtccctccaggaatgcaatattgtttttgatttactattttcctagatagagacaactctaatggcttccatttggcctttcccaccataatagccctcacctcattagtcagggagtcaatgttggggttctgccacctgctaagtatgtttatgccaattatgcagcctggcactgggggattgaccacaggatgagtccagggacccgctggacccactgtaagtcagatctgagctaaagctccgttaatgacatgaccttcataagcccctactttaactgaggaccacaatgatgttttgagtcccctggaatcaacgtcagctcagagccagtgtccagtagtccctgaaatgtctgatcatttccctttccccaatccacagttactctggtaaaaagccagaggtcaccttggggaaagatgggagaaagatttgttgcataaattgttggtaatgtagtagggtccttcctcaaggggacccagcctccccttcattcaaggggttctgggtgtgtaaactgactcaagtctggaaattgattgaggagccgtgattctgtttttctaattcaaattagtcttttatccatttcacctagaagctttccgcttgtataaattaagtaggaatgcagtaagcttcctatcaatttcacttctaggaacactgtgattaattagccaatgccatagctctacactagtcagactattctgattgcctcattgcctctgccgttcattgtcgtagctgcacccaccttgcctttgatggtcgagtgctgccacttggcccctgccaccttggtatctaattagcaaacagaggtattggggtggattctgaggagaatcaacattatcttgcctggcaactgcctcagaagaggtcatcactgttccctcaggcagcgcagggtttatctcctcagacagaggtgcaaaggctggtggcagcatgggtcgggaaggggatgttgccactactgggaatagggaaattccttctggcaaaaatggttcatcagagtttacaaactcagtgtgcccagcttcatcagggtcctcccaaatgtccccattccaagttgcagggtcccattcttttccaatcaatgccctcactttaacagtagacacctggcgaggctgtgcacgaaccttttgtttcaggtcagccactcacatcataagggcttgtgtctgtttttccacaatttcagcgctttctctacaggaggtaagactctcactcagggcaatcttagcagatttgaggttcagtatctgcttctgaagcccggagacagaatccctgagttcatcattttctttcatcagtttgtccactgaacttgggagcaaccaacaagctgcattatgttccttggttctccacatatggtcaaaggtattatgtatagagtgagtgaactccttgcttctcacaagcggtgaatcaggagtgccaaatgcatttattttgcataagtctaaacagtttccgcctaggacttatcagtattctccatactattagaagcagagtccttagcattttggggtctaatcatattaagcaaccaactccagaaaccccaaaaccaatgaaagaactccatccttaatattctgttcctctacaaccactcctggtaccaaaatctgtattcctcagagttccctagagggacagaactaataggtagatacatacatataaaggggagtttattaagtattaacttacacgatcacaagttcccagaataggctgtctgcaagcttgaggagccaggagagccaggtccgagtctcaaaactgaagaacttggagtcctggagtccaatgtttgagggcaggaagcgtccagcatgggagaaagatgtaggctgggaggctaggctagtctcttgcttcatgtttttctgcctgctttatatttgctgatggctgattagatggtgcccacccaattaagggtgagtctgccttctccagcccactgactcaaatgttaatctcctttggcaacaccctcacagacagacacaccaggatcaatattgcatccttcaatccaatcaagttgacactcagtactaaccatcacagttagtataggggtggagggagagaaaaaatattattttttcttactacccacagatatctagacttcgaaggagtttactctgcacgatagatgtgttcctgaaaagttcattgaaagcacaatttctcttagtcgcattttatcttcttaccagcagtttcagggcttatccagcttcattctgcccgctgtttcttcaccgatggagctcaatgtctgtgtcccctgtcacgttctcatcactttgaaaatgggaaatgattggcaggcaaccctaggacaccacacttctaaaactggccacagctatcagctaaagggagcaatgccaatatgaggtgggcccacattgtgtgagatggaaattaatgaaagcagccctgggttgatactcacatcctctgctggagaaattaacagcagtgtttatctctgctaaatctaggcatggtgtattatcgagaggtttcctgtcaggtccaatttgggatcatcaaattaattgttacgtgtgacaagctgacatgcaaagaaagcaataaatacctcagtgccagctccttgttggaattccatggtgagttcccagggccagggggcatgaatgataaatgaggctaacggcctccctgcctacagcagcctgccctttctctccgtggcatcggaagactcacccctgttttccttgagaccttagttaactcactcacttcctaacaactgcgttaattcttcttagcatttttcttttgcttctgagaggtgctatgtacctagaaatgacccagcagcttcttcaaaagtacctttgctgggtcttcaggaactgcctggtaattgacccacaagacattgccagtttgcctgcgtttctcaagctcagaagattttgctgtaggaagcccccggcagctcaggcttctactccatgtccccaagggtggagtggtgcaaggtgtggccaggcactgtttagaactggagtgagtggcacctggaggtgggtggggcatcagcctgatgggttggaagttgctcctgttgctgtcctgggccctgtaatctggctgccattcctattacttcacaaatactccctagtgcaagtacagcagcatccttccaaggaccaaacccaagggacatcaggctactgtgtctttaacctctccaacattttacatttggggcctcctcctctcctccaaaaacaggaactcagcaactgtccatataactccctgcactttggacacaagcaaatttaagtcacatttgtggcacaactctggaagacacagagacccttatggcgtgcatatctgtatattcgtatgtgttagtccatttttgccctatagcagtgcaaatacctgggaatacctgagactgggtaatttataagaaaagaggttgaactggctcatggttctgcaggccgaacaggaaacatggcaacttgtgcttctggggaggcctcagggagcttccaatcaggcagaaggcaaagggggagcaggcgtctcacatggtgggagcaggagcaagagagcaagaggggaagtattacacacttttaaacaaccaggtctcacgagagctcactcacaactgtgaggacagtaccaggggggtggtactaaaccgttcatgagaaatccacccccatgatgcagtcgcctcccaccaggcccagcctccaacattagggattatgattccaccatgagatttggtgggacacagatccccatatcaccatgtatctgcatatctatgcttcctcacttttcaaatccttttgaatttttttctgtatatttttcctgactttgtttttatttgtattacctgttttcttgccgtaagaagtatgaggtacagttatcaaaatattactttaaattgtaattttttttaagatttaataacaaggtctcctgataggtctgatcactgccatcactttagagtagtgatgaatgtcaacggtaattctaggtatgtgcaacaacaggaatgtgatataaaactattaatatctgtgatttctattgatgaaaaaattacaggcactgctgatgctgctgagttcaccctgagaaggccggctaaatatcagtcagatgtcagtggagataaagatgtggggttggctggtttgttggttggttttcccccagcctagttcatgggtgtcctgaattttatttctgggcccattagattaagaatctttaccttatacctcctagatctgtgttacgtcaaaacatatatgtctactctcattttttattacatcagacaactttccaaaggtgtggatctcagcgtgactctcacggttctacaccccatatgccctttccatgtggaaagaacccacggcctagtttaagtgattccattgcaaggctgctttgctgcgagtcctaattacccttttcattgtcaaatattaagaggaaatacatgggcagcctgatgggatcttgactgctccctgacgttcagttctcagacctctgctttcttctgtttaccgtccattagagaacttgcatgttcccgcctttgtcatcacccgaatgaggaataaacacagcagcacttgcccagccccgcttccccgccagagcacaccaggcgtgcctgctggctggagggacggctccttgctggtccagctttacctcagcctctagtggacggagtgcacagggcttggggcaggagacttgggtttgagtaccagctttgggacctgttgcctgtgtgattgtggaaaacacttcagctctcaggggggcttcttagctggaaagtgggggtaaaacagtaacccctgtcagatgagaagatgccagccttgagcaagataaagcacgttatgaatggctgttggtggtggttctctgtttcactcttctgcctccctcattccctgctcctcctgggcttgaaaatcagtcattgtgatctcctcctctgctgcccagcccagtcctgctgtcgtgcctggaacgtaactcccacaaggaactgctctgactgccacagatcctagacttggttagccacagaacctcttattggtcaccttgtctcagtcttgccctagtcagttgaccttcgattccaatgttaggttgtcttgctgagattccagtttccccaccctgtaacctttgcttcctaggaatcgattatggagcctttggcttgggaaggttgcctgtggagttcatcctgagagggcatgttaaatatcagtcagatgtcaacagagataaagatgtaaggcagattggttggctggttggttggctggttggtcggctggttggttggttttccctcagcctagttcatgggtacatgtgtcgtatggaggcctgcactaatgagtagatgccttggggtccacctcaggcttctccctcccccacttcaataggagccccacctagatccatttgatatcttgaggttccattcagatttgatgttttaaaacaggatctactgctacagacagagaagttgataaccactgaaagagttcaatgtagtcattctgcaactgaataacagaagccctgagaagctaagggcattcccgccagcttcaaggctaatgtgtagacccacagggcttcccttgccctagtctagaactctctcccctgtgccatgttggtcctatgggttcctgccctttgtaaccggtcatttaaggccctgcccagtctcccccaccccatccagccctcctcacagacatcaatgtctaccttttccatgaatcaggacctgagaggccagaatctactcggcagaatacaccgtgctcagtcctcctccgcacctctcctgcccttcctatgtggaggggtctcccagtccctccataccctgaattgtgccggtccttccaggccccactgaagcggctttttcaaagccttaccttatgaccccagcccacaggagcttcccccatccgaattctttctgcacatgctgtgtgtgttgctgtgttagtttgctagggttgccttaacaaagtgccacagactgggtggatgaaacagcataagtttgctgtctcacagttctggaggttgaaagaccaaggtgtcagcagggttggttccttctgaggcctttctcattggcttgtagatggccgtcttctccctgtgtcctcaaacagtcttctctctctgcctgtctgtgtcctgctctccccttatagggacaccaatcatattgggtgagggtccactctaatgatgttgttttaacttaatcacctctttaaaggccctgtccccaagtagagtcacactcagagattctgggagttaggacttcaacataggaatgtgttgctgggaaggacgggggtgaaattcagccagaacagcctctcacttggcacacagtggttgcctgcctcaagtccttcctgccctgcctggtcctgcgtttgaggaaggattatgtagtatattactttgtacccacgcagtgcttgcaaatgctagacacatgtcatttttcaatgaaaaactaacttgctcttgagtcccaaacttgggtttaatgaagccagtgaatcagcagttcttgaggctctattcagagcactgtgtgagaaagagtaaacagacgtcccacccagagtaaggtggctgaggtctcatcaggaagatggggatagacagttggagggcagggtggtgagaagcaccgactccaggaaacacaggaagcgctgtcagagttcagaggatttttaatgccgatagagtaagagagcgtagaagttatggctctcacagagcataaacgctggaggtaggtgcacgtgtgtcctcagaggaccagtgtgggggcagtcattaggagaatcctgtaaacactgctccttcctcaaaccagggcagttacgccccggtgagaccacctttgtctccagtcccaccctgtctgaggctggccttcatagagggtggatgcagacatggatcgcctggcatcagggcaaagttcaaatgaaattctgatgaaggtaaaagccccaggccaccccgggtgagcggacttcagccaccaactgggagccatgcgctgctcttggccctgctgatcccgaggtctgctcacacctaccttccccttgctgtgtacagcagagcaaaacccttttctctcccctcatttcaaaacatgggagtgtggaccccatggccatatttatttcacgttgacaacttcagatgtttcaagagttcaagtcttagattcactgatgtttaattaaagacctcagttgttatttattagctgcactgccttttctctttgtctcttctgtcctcacacaacacactccagggtaaattcatttcagccacagtttctcacaccgtgcctctgcggacaacccctcagccctcaccacttcccctggctcagcttggtattgctaactgggcagcttgatgcagatgcctgagataccttcagttgtcccagacaattccatttgcccctccctttcatacctgcttctcactgactccacagtgtcccttaacacccggtgattgggactcaggcacaggtgcagggctgaaggacactcccagcctgcttgccctgtcacccgcagaagtcaaggcacgtcctgccttcagggcaccttctccagccaccctcccaggctctgtgcttcccaccagcccgtccattggtgtggaccctcgtgccttcctctgcaccctccagagcacacccatcatcccaccacacttccaggcccgatgccagaggcctcctgacctcactcagagcgctctgtggcctctaagccccatgaaaggcttctgtggccccctcatggttctgtccgtattggggctgtggacacgtttcccaggaggcctctcagtgcagtggggtgaacacagagaacaggagctaaacctgcctctgccagggccattctgtggcttgggtcagataactgcaactccctgagcctcagcttctcatcttggagatgggcctgtgatatccgtttacaggacttttcaggggatttggtgtgattgaggctgtgaaggcttccttatggcccctggccaaaagcaggccctcagaagggccctagccacctctccctgaggcttcggggctggattgttttgtagccgagggaaggggaggggtcgtttgctgaggaagtgatttttccctgttttgtttctgaaggtggaggtgacggaaactcccaggcagcccctttatgtgggcacttctccctcatcacagagcctggcaatcagcctcgagcagcgccagcatcacctggggctggttacacacagatcgctgggcctctgtgtttgaggaaggcttatgtagtatatagaaatgtgcattctgaccagtcccaggtgaatccataccgatgccctgggtcccaggacatcattgccctaaagaatacaagaagggctgcagtgcccagcactcttccctttgggggtattccctgggacatgttccaggtgggtaactgtcagcctctggtccattgcccgcattttcaatgcccttgtggagggtgggagccctgctgtgcagcagagttccaagcctgctccttggcttcctgtcatgtggtcagaggcaagcagcctctaggattctctcctggaaattcattatgcaccttagcttgtgacctggcctggagaccatgcctcggagaaagccacacagccctgtttaaccatttgccaaacccatctgaccacgaggcaaccctctgggcagtgcagtgggatgttttgaacacacccaagcaatgaggttggaattgaaaatcctttccaagctctccccagtggtgggattgatgtactgggctcccttacctacctcgttactctgggagtgtcctgcgtttgggtctggcacaccacaccatgcagtagtcacactgtgtgagctccacggctgcagcatcgcatagtcggacttttattcatcttctttccccagtaactcacctgggtttttataggaatgcatgtacacgtcctgaatagcaaacctaaaaacatttataatgcatacctcatacagtagaacttcagctatttgtgttaattatagtgaatggtagtcagatgtgctttttaaaaatccagattattaaatacaaagaaatatggtggtactttcatgatcaagccatggcacatgcttgtctattccagaggtgccaggtgaattcctcgtagaggagatgtgactgaaagcacaaaggaggattacttgtaatgaacgtatcaattatttgtagattgagggtcttttgattttaatattctttctactatcttgtttatgttgcctataacctttgacccaatgaacatgaacttcaaattagtgaaatccaacgaaataaggttttactctgtcagaaaaatcactcacccaacaacaggcacagctgtgctcctgtgctcctgcaccctagttagaggtgctgagaacatttcacagcatccagagccttatctgttgaccccaaacgcattcctatatgggcctgcagtgtaggagtccacctgcacaaccgcacaaggactttcccccattgcttacgatgacaaagaaaagtggaagtgtggaaactgttatcattaataacatggtttcagagtcgctgtgcttttcacactgtacgctatagcccgttggtgggtcatgaagtcagttgagtggatggagatcagcagggatgggaccatacagatcccatattacatgggattagtgcatcccaggatacaaggggcagaattgtttgtttagggagatatgtgcgtgtgtgtgtgtgtgtgtgtctgatatgtgtatatgtgtatgcctgtgtgcgtgtatgtgtctgcatgtgtgtgtgtatgtatgtctgtgcatgtgtgtatgtgcgtctgtgtgtatctgtgtgtgtatatgtgtgtgtctgtgtctgtgtgtctctatgtgtgtgtgtgcacttgtgcccactgcatcacaatgtaaaatgatccaggtttttattgtgggtcatactgaaaatgtaggaaagccatttgatagaaaatcttttaagcaattccagagtagagaagaattaataatttggtttaaaaattttcctcctcaaagtggtcatttcagtttatattctcccaagttatttctctgctctgacagcatatgccctttataatctgcctgttggtatatctgcctggagttgtaacaatgctcaagtttgtattgcccgtgaaattcctttgtacttaatattaaaggatgattcagctcttcagtgtagcatccaactcttaagaatttcaagcctaaataagaattagagccacttggaggtagcgacagcatggggtgaggcaccaaattaatgtgattcatggagaatttaatctaaaagagaactggatgatgagcagagccagtactcatccagtgccacccatccatcacaccatctttgcaccatagcacctgtgcatcacatgattcctatgccacgccacctgtgtgccataccacccacacaccacaccacccatgcatcacaccacctgtacatcacgccgcctgtgcaccacactgatcgcaaatcacaccacccgtgcatcacaccacctgtacatcacgccgcctgtgcaccacactgctcacaaatcacatcacactgcctgtgcaccacactgatcgcaaatcacaccacccctgcatcacagcacccatgcatcacaccacctatgcatcacactgcctgtgcaccacatagtttatgcaccacatcacccgtgcatcacaccaccagctctcctgccctcagctcagtgctggggccacattgttacggggttttgaatatgaatctttaaattactcaagtttgtgctgctgttgagaaaaggcagaatgcacccttgggcagttctcccattcccgaacccacccacatgtctgcctctcaacacttgctcagctgactaagctacacctttcagatatcagctgaaatctcactggccctccaaaccagtttaaacccctgctgtgtgctcctttagcaccttggccttccccttcatagcacttggcttaaatgtaaatgcccagttgagttttcattattcatttgacattgagccccagccacctcagacgttgcaaactggccgactgacttggggacagacccatggctttttttaaggccagtcccctctgacttctccatgtgggttttgaacttagcctgccatccttccctcttatagttgtgggaattcagatcaagaaaggaggaagcgcgtgaccaggttacctaattaggggaggacacaggatgttcgtgttgttcatgaagatggacctgaagcatgccgtgtgcatcgggtttttctgggcttttctggaatgctgagcccttttctcgagggcagtgctcccacctacagcataggatcaggtgcacacatctgttggcctcttcattaggtacaatttaatgtattaaatttggatactgtttctaggttagtaaaagtgtgtctttatcaaatccgatcatcatttttgtctcataaacaagagacaagaaattcttccaggtaaaatgtttctcaactgcctcgtcactgattagtaaagtgagtttgtcttaacaagtccatctctgtccgattttctgacaaaccaggtaacatttgaataaattctcaagattgtgcccaagccatataaggcattaatgcatttgaggtttggatttgaaagcatcagctgcagttaggagcccaggcttcggtgtcacacttgtgagtttggttcctagcttctcctcttactcactgtgtagccttaggcaggttattcaacctctctgtgcatgtgtccttatctgtaaactgtgattattaataatattacctaagctgactgttgtgaagattacatgagttaatgtgtctccagtacatagaatagttctgggcccagagtcagaaagaaatactagctattattagtagtatgttcattagtagttgatgtatcgccatcattttatagtcaagcacctagaactaaaagttatcctaacaccctgtaagtggatggctgtggttaatacagaatatttaggcaaaatgtgtttatgaagacacttctgcctgttcttgttgtgtactgctttccatgttgtgctgttggatgcaaatgccgatgtgagctaagctctctgcagtccagagggcggaggtgactgtggcttctttctcatctacctaaaatgatgcatatttgagaaatgctttgtttctggggctctcacatgattcaggggcagtaaatccccaaaggaatgtcactttttttatggctcatggaactaatgtctcaccaagcacacctggtccagcatacccacctaaccaaggatttcataatttgtggaatttttcaacacataggtatatcaaatcataacaaaagaaaatcagcactcaaaggtatgactgcaccttacatttaaatctgcttctctccccatgaaagatgatactgagtaggaaaggaaaactgcaggagggcagagagcatcttagaccaaagttgagttctcctttctctatgaaaaatgcccgttgtctgacaggtttcgcccagatagtacacaccatgagggcatgtggccctgcatggaactgcttctgtttcatcacaaatgacaaggcagctgaaaggctggggccaaatgcacagccttgttctcacacagcagtggagagagcccaggcttctgccacacagacttgtccttccagtgaccaaacagcacgtgacccagtggtggagaaaaggaggatggagaaatggattccctagcctgggcctcccactagatcactgtgacccctatttagcctccgaggtaaaactctttccaaaatgtgtaaaccaccttcacctctacataaaatatggaacacaattgcaactcagcctttaatacatgtgtcacgaccgtgtgtagtgtgggccgcggtgggctgatgctaatggaagttctgcccaaaaggcttcctgattcaaacgcatcaggaaatgggtgaaaggaagttaatctggtttccttaagatgactcagagccccattacactaaggggcatttcagtctctcagaggaggatacaggaagtagtgtttccagaatttagttgaccacaggctactcaaattgcattgcaggatgagagccaggcagaatgtattttgggccacaattctgaggttgtgcatccgacaggtgtaggaagaccagagctagccagaaagtttgaggacccacgtgcttgtcctggctccacttcctcccattccctcgaccacagggactgtctacctctaagctgctttctcacctgtatgaaaaggaggtcagtgatgcttgtgggctcctggccctgtacactgcgcaggaaagactgagggatcacaggcaacgggctctagaatcagtgaaaggccacacaaacagaagacaggtgttggtgctcagttctattaacccagaaaagaccaagatacaatttggggaaaattccctgattacatttgttctattctgctttgccaagggtttcacttaattgaatgaatccaattttactctatacagataagtgtatagagctgaccatggcatctccatgtaatccaggagtaatctttttacctcctgacagttttaccgtcttacctgtttctaatccatttccctttcttggcagcagactgggcgacagcacagagacacataggaagtggtgagcggaaagtgcccatgtctccaaggcaaatacacattccagagcactcagaaaactgcagagggctttatgttttcacactgaaactcatggtggcaaaaattgagctgatgtgaggatatttatggtccctaaatcctacttagtgtaatatccatacattttgctgtagaaaaattaatgggtttgaatatggggtgctgcccaagcccctccagaactgttcactatatatgatttttataacatattgcctttataaaacttgaaaaatcctgaattctgaaacctatgtagccccaagggctccaggtaaaagagatcagggactataaaggaaactctggggtacaaaggcacctgtggagatgaaggtcaccaggctggctggtatttgacaggcaggacgccctgttcccaggttcaggcaagaggttgcccagccctcgggatgctgctttctgccacagcatggtgctgtgaattctccccctcttcaccgctgctgtattttttgtgaagccatagagacaagccagtgcctggcccccagcaaggctggagaggcagtgaaggcacatccccacagccacgccctgcgctgtcctctacctggagtccttgggcagccagccaggggaaggctccctgtgccccccacacccaggctgctgtgtaaagaagcaattggcatgagccccaggacactagctactgccaaagccagcagtattttatgagccttaaaaaatcttgttgtaccagtccgttatgaattattgaattaacactgcatatttatagcaacttcttaatagtttaataatttattcatcccttatggatcctttggcatatttcttttaattgttagagtaaagagtttttttagagctaacttcactggactacttcctcaatgatgcttccagaatactaaaatagaatcctgcacagttgttccgaagcttaaagcacctgatgcgcagcaaagacctgcccacatgcgagtcggtgacaccccccctgcctgtgcacagggctgcaactactctgtagaagcccacagccagccaggcccagctctcagccccaactcagcacactagcatttcacagcctacacttggattacgtgtcttctgagacagtttaggaacctaagcatcattcatattgtttctaaagggaaaaacatcttactgtgtcccaacaagtaagctccctattttgggagcacccctgctttgtaagatgtgtcctactgcccagagtgagtcattcctcacagagccctgctcctaggtgcttggtgataaggggaatcaacagaaacaggctgtttcccagcattcacttgcagatgactaaacccagaaattgtggagtagccttaggtaaggagacgaaagttgaaaacttaagacccagattcttcaggcatttgagactctggctgaggaggcaaggcatgccagatcgtttatgctcagggtaagggtgcacatctgtctgcatgttactgtcccttttgcaagggtttttttggtcatgagtgacatcgcactttattaaaaagacatgctttcttaacaagatgagctacctttgatgcttagtctttctctggtttaggcaagagtcctgcaaagccatccagctgttgttggcagctgccaggagttgccataaagaaggtagatggagtttttcctgttgaattcgttaattcaggctcgtgaatgtggtcattgataacaccccatccctcttttccttaccgcctctagctaattgtgcttatcatttaagcttcagctcatggctctatcaccattctcaagtttgccttgaaaagatctgaagaagtacctgttagcctgagctccctctaaagagggagaaaagccaatcttccaggtcagtctggcaaaagctggaggaagggcccatttgcttggggactccagatatcaacccatggccagcagatccagctcagccagattgtcgggtcacaaaaataaatccactatctctaatcgctcttttgcctcttttgcaagcctttgaggcgggcagggcatgagagttactcattcctaagaaatgagcaacaaacagttccagctaagcaccctggttcattcactgcctggccacgaccacaaacttgtgctaagctgagggtcgctgaccggtgatgtcatttggtgctcaaagcatttgttgagtatgtgtgcgcaccagaccatgtgccaggcgctgggcacacaacaaattccaccatggtccttgaccttgaaggggagccatgcgtgcagaagcctaaagctgtgttgtgataagcctaaagccatgttgggaagttcttatggcaacacagctgggaaagtataagtcctgcccttggaggggaaggaaagtgatggaaagagaacatgagccagccttgaagttgctgtttatcagctggctcaagtatcaaggtggaaccaagcacaggcaatccgagcatttcttccatgaaaaatgaaacttaagtgtcccggaaaagttgaggatcataccagaattctgtgtctcagcttggagtgaccatgcagcatatttagtctgacatgctttgagagtgaaagaaagcactgctagtaataacaccaggaccaatgcctgaacccagaccgtcccagggaatcagggacataaccatcatcctagggataacttgaggcctaatttgctgccctgaatgaagttcattctccctctactggtcagagacgagatggcaggggattggttgcaccacccactgcccccccgccccccgtccccctcaacctttttatttatttatttattttaagaaactgatagaagacaaatacaatgtcatctgacattgcaatcattattggaaactacaatgcacagtatgtttgtacttacatccttgaaaaccattttagggctctcagccccgttactgaaccataaagatgctgggtttaaaaatattcaaattggttccttattgaggcaaatgctgaggaaaagcagcagattgcatcttgagcttgaaaagaactcctctttgacttgcgttctccatgatacagctgacttcttttaaatcggtgttgtgagttagtgctcctgttccatcttcacctgcctttattaaacaagcaacacagaggcagatgacttctctgggtgctttatgcatgtatctcactttaaacactgcgttttttgtttccttgggaaataagccctcatagccaatggttgcttcaggtcttgaccaagtacccggatgccccagccagatgccatggtttgcctcctgggtgttcacctctctgtgggcttcttccctctggtttctaaggtgacagcttgttcatcagatgcatggaacagcacagacacaggcatttcacacccgtctattcagagcaggggccccatggcccagattttctgggaaagttctgttttcacacattctgccttgtgctggtcagccaatgtattctggtttgagataacagaatgtaaaacagtagggccatcttacctatagcacgtgacccagagaaacaagggccctgggttagtttgcaaagcaggtcaagtcagccttgagtcctataatgctgcagagagcccagcaccctcttgccgcagcaaggccggccccatctgggtggtggctcctgggtctccagcacccagcactgggcaggcactgggtggttgctcagtgaatatttacctgatggaagcgcccaggcacagtggtggtgagcacagatccatgcacgctgactaccatgccccacacatccacgctgcccctggggcgcaacagtgccagtgagaactccccaccagaacctgtgcctcagctgaaaatttccttcccttctcccatccctaacgactccccttcctacaggtcccagcagatgtgaaaaggagaataaagagcctccagttcctcctttggccccaaccttagtttgcattctaattcattaacatttgcagggtggcttgcagctgtccttagagatggtggtggcagttctcctgaaatgcacctgtgttgttcttgcactttctgtcacttctcagtgggcctcagaagtcaggtgggtggacttatctgcccagccatgtggaagaaggaaggctctcatgtagatgtctacgtgtacatagcgcctcaaagtgaggattatacactacacatcaattcccctctgacgtcttagtggaaagtttccattgagccctaatgctccctagaagtatgtcacatcctgcccgcggaggggcccacccagggccccattctggttaccctcttcatgctcgaggttgtgccctccaggtgcatctcagctcggagaggggccctcagggtcgcagcttgctctgtccatcatccagcatctgcctcctcactttgtgaataacagggcacatagatatcttcactggtgagatttgctggtggtaaagcatattatctggctgtcctcatggaaagcaaaggaagctccctcaaggcaggggacaccccagggaacctttgggagaagcaggaaggagtgagagccgtgggcctggggcctagtgcagcacactctggacattccccttgcttcctgcccctgccctttcattcctctctggaaaggctcattcaccaagttcacagagattctgtggttccctgcatgtcctcaggaatagctctgcgggaattctcatccctgatggaggatcagtcttgtggaagtccttcctgtcaataaggacattcttagttttcatggggttgccacagagaccggccacatcaaaatagagacagcccacttttccagaaacccatggtgacctgctttcgcattagcttctggtaaacctcacaggtgtggcctgttggcctcttgctatttagggagccctctgggaccagtcttcacctcagtccctaacccagcgtcctatacagtgtgtgaacaccaaatgcctgttagtggagaggaggaagaagatgacagtgataagaagcggagacaagctcctatgtccctccagcaactggacaggcaggaaaaagtaggagatgctccagagattgtgcaaatgcttccttattttcaggcatgcttgatacttataaacaccgtagacagacagacagataggtaagtaggtaggtaggtaggtaggtagatgtgaacaaatgtgaacctggaagggccagtcttccaatatagatccttagtggctcactgggtccagatttgaaatagagccaagtggccatttgccgactaggggtcatacaggtatgctgagatcccccccaaacctgcacctttttatctttgggacttttagagctcacctgaaccaaccaaccagtactcagccgtatcagccaatcagaactaagcaaatttcattttttttaatttgaataaacagacctgattgggaacctgggtgggaacttttgctctaaaacccaagtcttcctttgttctttggaacataccttcattttatattggaggctgtgtctccctggtttgcaaactgttcactggaataaagtctctttcctccaaattcctttttcagagaacttttgttgacagatagatggatgattgatagatagaatgacactctacatatatatgtatagtatgtgtgtgaataaatgaatgaaaccaactaataaataaaccacaataaaccttagggccctgaatattaatttacccaggagagacccagtcactagagatcagggcatcatgaatagtcaatatcagggagtgagtgaagactttaattagtggctcacagtgcatttctcgaaacccaaactttaggggcctttgatgctggtctataccacagcctgccctgctgcgctcccattgtattctaatactcggcggtgtttgctataaacgtgggtgaaggtagggttgttgggttgaacgtaagttatcccaactcactagctggttttggaaagtaagcagaattggttgtgagtttagttttctgtctacttgaccttgctctctttttttttttttttttttttttttgctaagtctggaaaaggcccaagtgcttggtatgatctgaggaagggccttaggagggtccccagagctagcatttccagtcaggtagcagttgaatttgcagatccagagaccactgaggacacttactgcatcagcctggctggctggtgagtagctgtgctctcagctcaccaactccctcccttgctgtgtgtgggaaaggtggactaaggacataattcctggtgaattcaggaattcagaaagcccttgtccatcatgcagtgtccctgacctgagtccacactgtgcgtggttctcacaggccaggctttgattcttgctagatgcgtagctctgtgactttccagccagacacctggctggaaagtatcctcagtgcaagttaactctggcatctctctaattctgttgctgggttcgacacaaaaacatcctagtgacagctggtcccatttaaggtcagccacctgtgcttccggagatggaagtagactcagaccagatgagttttttggtgtctgtattggattaatgtgtacttctttctaataggaattccaatgacagttgtcttgttggatttttttctacctacatgatcattttcctttttagagccaccatagttttatcctatttaaaatactttgtactttgaaccatggacacccacctcccaaaaattaaaccatttataacatgacccttgagcctgaagattgcatttcaaaatatagacaataaatagagtgatttttaaagcacctgtctaatcagcattaagcagtcaccagcacctccccataattgaaattccaaagagtgactctaaagcgtggacgtgttcagaatcaaagatggaacggtttttagggtaaatgttacatactgaaatcaagcaacatgtaaagtttttaatacatagatgatcgttatacagactaataatcataccaattgtcctcaggccctgctggacagccgcgcatctgtcttgtaacgagctaaccatgtaataaagcacggtgagcaggcacttcctagggcagtgccaggagcctttctgaatactgcaaaggactatgtccaatgcctgatctagcgtctttagagatggcccacctacagccaaggtctcccaacaatgtagctttagagctaagcctaggcgggcttccccccagtatgttccacattgccatgtagttaaacatgcacccttttttttaagtttgccccttgcccttaatgataacctacattcttcctaaaagttaccttctctggaacatttcattaaggaaaggaagcagtcatttttgctgctttatactgtttgaattgttcaggctgctggcagtggaggtggacagggattcccactctttggtgctgggggaaccttttctcatagtaatgccctgaaaccctgcgccatggcacagcgcaatgcttagaacaaaggagtgaggaaactcaaggtgggcccgctggcattcttcaaagaagccctgagaaactctgaaattccccagtcttgaaagaaatgagagagagagaaaggaagtgttatgctttagaagacaaaaagcaatttctagactgtctttacataggaaactaattcattacttattgccactaaacatgagcttgtcagtggaggcctattccaagcacagtgaatacattattttctttaaactccctattctacaaagtaggaatcattcccatcttacagatggacactgaggctttgagaggctgctcatctgaactgagattcaaccccagaaccatctatttcctaagcccaagccctcaaacgtgccatgacactgcttttgtctgtggttctgaatcgcctatgactcctgtggagatggcagcagaatgtctgggatttctacaccaggctgaagcctcccccccgccacaccccctattccctggctcactttcaggaagtggtgcctgggctgtgcccctcagatgtggtcgcttctgtatatgtgatgaattttgagactctcagtggcccaggaccatcactacgtattaaatccataagatgtgagaagggtaattaacacttcctgttgttatttccccttctttgcatccagggaaaggggtacaatagggaagagcaggaggagggggagggaagatccacacgccagaaactgaagtggtctggaatgggaagagtgctgggcacacaggagctttctggagctgtgtctagagggaaaatgaaggttccctcctgtttaaaccagactcccagtctgtggctttcacactacatgcagagtgtggaacacgtcatctactgatgagccctattcacccaacacactcagaacttgggggtttagcctttcctaactaaaaaaaaaaaaaaatctctgtgaagttttgacatctggatcaacaattagccaaatatctgtgggtggaatgctacctggagagaaatatttcagaacccccaaatgagagcatccttcccacacagacccagacctggcccagacccagaagaacaggttgagatgaagttttgtcctgaaatcacagtgtcctggaagcagtagttctgaggaaggggcagattgccgtcccagcctcttcactgaaggatttgaaggctgattccagttgtatgaaaacagcatctcactgcaaagaaggtgctgttagaccaatgtgaacatgagctcaagcattctcacctagaaaagcacctctggttgtgcccttttgaaaaatgttataaatttcttatgccaaatttagaaggaattaggttccagattattttctctcgggtttagaattgtgtttacgacactgaagttgagttttatatgcctttggtcagactcgtgacaattagccactcctggggagaaggggcaccctcgtgcccaggtgccagcagccctcgcccgcagtgcctggccggcttccatttctccttgaggtggctgagctggccggagcgttcgcgggctgagaggaccagcagtgccatcttgtggaaatgttgtcagtgctgaagccaggctgaaggagggagacagcctcgactgtcacactctgaagaatgatgttatccagaaatgtctgggtgcaatcgagtgagacgtttccctctgctcaccagccatgctaattattattttgctgtccagaaaattaatagcccaaataaattaagaccaagccaagaaggtatttcaagaactaaaaatggcaggaacggatttgttttccatcgacttactgggaaatgtttaaaaagtcaccccagctgggaatatattttctgtaaactctggaagcacaaagctatggattctgagcagagtcaaaacaagagttttggaatttgcttctaggctgccctgcaggctctgtgctttcctgaggagactgcttttcccggtcaatgagcgcatgtgctgggccacaacctatgtcacccccttcatcagtgcatgagaagagcccccagccccattcactttgtatgggcagaagctgatcgagggtaccctgtcctcccactgcagtgctctagtgtcgtgtcctctctgttacacaagtgctaagcacacactgtgactacctttcatcagcacacagtgggtgaggcccaagggcctcttcttctgcactgacagagggtttgatttgaggtgcggcccagttctcaaggtcattaccctggaaaagcagtctctttgcccaccctcctcaggaaagcacagagcccgccaggcagcctagaagcaaatttggaaactgtgtttcgaccctgtttagaatctgttgctttctgctgtgtgtatgtgcgtgtgtgtgtgtgtgtgtgtgtatgcacatatatagagtcacctaagaaggtagggtctgttgctgtccagttttatagacaaggaaactaagcctcagaaaagtcaaccaccagctcaccagcttgtccctggcagagtcaggatttgaacccggatcatccaacactctagcccacactcatggtgtccatttgccacggtccctcctttgcgtggttctgaatcgtctctggccctgtcggctgcctcgaatctgttaaatggtttgaagcctcccctgcattttgttcccgagactgaggaacagagtcgtctgagatggtggagatctcagacgacccgactgaagagcacagcccttgcgcttcctcccgggctccacccccaggaccccaagcaaggttccagcctctctgaggcaccatttcttcctccgtaaaatagaacatcacctgccgaaggaactcagatgagctaatgatttatgtggaagtgctttgtatgctagttaaatgctagagacataagtgatcatttttcaggaaaaaaaatccactatcaagtcagaaagtaaatctttaggtagatttgaatatattgtactgtctggttgaataaaggaccctcaggttacatttagattgcttaccttaaaactctgcatctctaaatcatatacagaagacaagctaaaactctgctttaaaatgaggggactgggcttggagccaagattacatgcactatacagccctcgttccaagtctggttcccagcacttattactgtgcaacccttgggcaaatgactggtcctttctgatttaccattccaatctgtgaaatggacagttcctgcctcacaggaccaagagagttagatacagcacttctaaggggagcgcctaactcagcacctggtccatagtacatagtggtgattgataaacagtagcttttatcaacctgagatcatttctatcctttagggaaaatagagcaccagtggcttattaaaggccatgtgtccctgccttctgtgtacatgcttcctgctgatagagtacatttacatgaaaaggagacagcatttgcagaggataacttgagtagacttccatgaacccaggtcaaaactaacatgaaaatgattctgttacgtacaactctccagtaatgcctttgctgccattttgattactttcagtgggatcagagatttgaccagattcccagtttcactactactacgcacgtgtgtgtgtgtgtgtgtgtgtgtgcgtgtgcatgtttctccccatcccagaattcaccttcgtggtaactaagctgaccctaatccctaccaggatgcttgggaaggaagaggctgaccagtcagatgcacatcggaccctccctgttgcacagaatcctattttggggtgaagaagggcactgcatttttctaagagtgcagaagctctccagggttaagggaagaagggtaaggaccccacaaaactagctgtggtgagccaggctggagcagggcagcagatacaaattactttgttcacaagttgcctgtcagtagcagtcctatttgaagattactagcaatcggtccttttggggagcccggattcatttcctggctgacctgctctctgtagcccaggggaaagtattattgcaatatcggtgtcctgtggggactgagtaggtacatgtggggtgtcgcgtacagttctaggcaaaactctagaaaccgcactggaatgcagttgggagaatagctgagagagtgaaggaatttgaaatcatgcctttgagtctgggaaagggatgttctgggggcttgtggtagccttcttcaaataccaaaggactgtcctgtggaagagcgttagacttgggatgggcgctggactaagtgcagggagacagaatccggcccacctgggagacatccaggcggcccccactgaaggcccttaagctctcaactgcgaaaggatgaaggtatagattgcagcagccgtctgcctggtagggaacctcctgtccagctctaactcacaagagtgcatcgctttacacctctcagaactggggcagaaaccaggctgtcagagcaccacgatgatgagggagggtgtaaagccttagaacacaaaagaatgttaaaagtcttctcaatttttatatgagttacatgttggggtagcagtaacttgaatatattgagttaaatagttgctgtttgggagtttagggaagttttaaaactatgaatttgggtttctcagccctttccacattcctttaaagatgagaccatcaaactcagtcttgatgatatctgcattccacagggttactcagtcactgagcgtttctggcattttatcctgtctgtctgcagtttccacagaatgccaataaggtataaatcttcattaagaaaatttagaaaataagtaatagcaaacttttgttaaggacaaagggtccttttaagagtttgatgtggtccttgccagatggacaatagagacccacgtgcacggacatcaggtggctgcttagtctgggtgtgaaaaagctgcagtttctgctagtgtataggaagtgttatctggattctaatcctggctaattctgcctggcttgcagttcttttcaatttaaataagtgtagtttttaaagtctggaaaggcctgaggatatggggcgggcagggttgatagttttcactctctgtttcctgagagaaaataatgttgcatcttcaaaacagcatctgtcagaatgattttcatcagattaaataaatcctcaaagcagctatcatacttcttagacttgagaaatgtaggttatactttgcatggaagcctaatggcatttaaaataggtgtgttttgcatgtacagccttacacccagacctttgactggggtttctcgcttgtgagattttgttcaagctaccacatctcaaagagtttagtaactgtttttactttataaacgtcataaataattatttgccaatttaagttgctgttaattatagttggaaaaaaggattgggctctgaagcctttgggccaaacttgatgaaaaccttcaacacaacatacgctctgtcacgggacaagttacatgaaaatacatatcgctgttagacattttggaagaggcctgccttttgccatcttttcatgggcagctgccatatgtccttacagccaattatggccttttcagttttagagaagaattttgggggcgacttttggttcataaagacctttaatgaatgatcaatacagattgatatttattattctgtggcagggaagcttattcttaaaattagttgctaaatctaaaccacagtacgatacttcttcacacccattagaatagagcctttatccaaaaaaacagaataaaacaaaacagaaaacaacgagcgttggcagggatatggggaaataggaacccatgtgcgttgctggtgggaatctaaaatggaacagccgctgtggaaaacaggttggtgattcctcagaaagttaaacacagaattaccatataacccagcaattccacttctgagttacacacaaaataattgaaagtagaaactcgagcacatatttatacacccacgtccatagctgcaccattcgcagcagtccaggtgtccatcagcagatgaatggataagcagaatgtggtctgtctgtacagtggaatgttattcagcctcaaaaaagaattcccacacattctgcaacataaatgaaccttgacaatattatgctagatggaataagccagacacaaaaagacaagtactgtatgattccacttacatgagatccctagggcagttaaactcacggtgatggccaggggctgggaggaggagagaatggggagctagtgtttaatggggacagactttctgttgggaatgatgaaaaagttctggaaatagataaaggtgatgatagcataataatatgaatatacttaatgccactgaactgtatacttaaaaatggctaaaatggtacataatttttttgtaattagttgctgagctggctggggtttcaaagcgaagttagaagggagggagagcttggactgtctttaggaagaacgtttgccttgagcagaccagagctaaaggagaccctcagtctggtgtcctgtcacttcccgccgagtcgcctcttgcggctcgataagactttctcatgcaacacaattcttgaatattgtgtaaaaagtgcagtcttaaagcaaggacctcgcctgcggaagtgctggacacatggggttcttttctttcagtgccttatttcttaccagtgccaaacagatgggggcgctggagcacagcagtgcaggatgaagtctcaggccttcatgttgttcttccccaggttaattaggtggaatgcacactgttttggttgtgccccaagagactgctctgacctaagcttgccactgagtgacattccctgtccctgctcctcagctcggagtcagccctcagggtgtgcacaagggcaagttcacggcctttccatcctgagtgagtccctttgactgcggcatcagaccctcagtcttgccatcactcagccaagtcgccagcaccacatccagcagaatgactagccactttgtataggatgcagcacaaaggacaccagtccctggctcatcgccacacccggcgggcctcacctcacccctcgccacccagtggttggcagaggcacatttcttatgctgagcctagcatgattttcattgacatcctctgtctttatgagcagaatccaccaagccactaaagctcagcagattcagtcatgactcagcacaaaggagctatctccgtgaatttggggtttcacaaggacagcgccatctgtgaatgcctcctgtggactcttagacgctgcaacctgcaaccatggccctggacactcctggaatgagctgggcctgtggggggagggtcattcttactgctgggggtctcctttagcccccagggtctccatggccattcagcagttgcgatgggacagtgtcttgagcagctcacatgggagtgaggtgctaaatgtgggtttaggaaaggaaagagcgtgccctgggagtcagaggctggtttctaggcctcagcttccgtgtgtgttttccagcactcaggctagagcagagctgtcatgatctcatatcatcactgttcacacacatttctccgggtacatactcgaggcatagaaccccacccttgtcgtgatcaatgcaggagacgcccagaggacagcacctctgaggagcaccgagggcagggaggaagggcgggactgtggcaggcccctgggctccagactcccgtcctcagtgcacacaggggaccagtgctggagacagattcctgatagccaggtcccccgagagcctcacgtggcagctactacacagtggggctgggctcaaccaaggagcctgtcaggaacacccaacatggaggcctctccaggctggcgccctactgctggatggcgcctctgcgtcctggagttccactccacctctgcaaagggtggcgtactcacagggtagaccaccctcattgctggggatctcctttagcctccagagtctccatggccattcagcagttgtgatgggacagtagttgtgtgtgtgtgtcaatctttataaatacacaggtacagtaatacagaagtacaagtgattttaacttgttttgcttgtctgcgtttcaataatgaatatgtacaggcagacctcagagatattgcagggtctgctccaggccaccataataaagcaaatattgtgataaagtgagtcccacaactttttggtttcacagtgcatataaaagttatgtttaccctccactgtagcctattaagtgtacagtagcattacgtctaaaaaacaatgcataacttaatttaaaattttaaaaatttaaaaattctgtatgctaatgatcatctgagccttcagtgaggctcagtctttttgttggtagagggtcttgcctcagtgttgatggctgctgactgattggggtggtggttgctgaaggttggagtggctgtggcagtttcttaaaataagacaacaggccaggtgtgatggctcatgcctgcaatcctagcactttcggaggtcaaggtgggtagatcacttgaggccaggagttcgagaccagcctggcaaacgtgacaaaaccctgtctctactaaaaatacaaaaattagccaggcatggtggtgtgtgcctgtaatcccagctactctggaggctgaggcatgagaatcacttgaacctgggaggtagaggttgcagtgagcagagatcacaccactgtactccagcctgggcaacagagtgagaccctctccctctgtaaaaaaaaaaaaaaaaaaaaaaagacaacaatgaagtttgtgacatagaacatagatcaactcttcctttcaggaaagaaagatttctctgcagcatacaatgttgtttgatagcattttacccatggtagaacttctttcaaaaatggagtcagtcatctcaaaccctgccactgctttatcaattaagtttatataatattctatatcctttgttgttattttcagtgtttacagcatcttcaccaggtgtagattccagctcaagaaatcactttctttgctcatccatgagaagcaactcctcatccctgaggattttaatcacaagattgcagccattcagttccatcttcaggctccacttctaatcctagttctcttgctgttttcaccacatctgcagttagttcctccagtgaagtcttgaaccccctcaaagttacccatgagggttggaatcagcttcttccaaactcctgttaatattgatattttgacctcctcccatgaatcatgagtattcttagtggcatctatagtagtaaattctttccagaaggttttcaatttactttgcccaaatctaccagtggaattacttatttcttaaataataagacttgaaagtcaaaattacttcttgatccatgggttgcagaatgaatgttgttttagcagacatgaaaacaacattaatctccttgtatacttggtcttgggtggccaggagcattataaatcagcagtaatactttgaaaggaatctttttttctgagcagtaggtctcaacagtgggcttaaaataagcagtaaaccttgatgtaaaccaatgtgccgtcatccaggctctgtcatcccatgtatagagcacagacagagtagattttatgtaattcgtaagggccctaggatgtttggaatggtaaatgagcattggcttcaaattaaagtcatcagctgcattagtccctactaagagtcagcctgcccttggaagctttgaaaccagtcattgacttccctctctagctgtgtaagtcctagatgacatctttttccaataaaaggctgttttgtcaacattgaaaatctgttgtttagtgtggccactttcatcaatgatcttagctagatcttctggagaacttgctgcagcttcttcctcagcagttgctgcttcaccttgcacttttatcttctggagatggcttctttccttaaacctcatgaaccaacctctgctagtttccatcttttcttctgcagcttcctcacctctcttagccttcatagaactgaagggagttagggcctttctctagattagactttggcttaagggaatgttgtggcttgtcttttatccagaccactcgaactttctccatatcaacaataatgctcttttacttccttgtcactcactccagtgctcactggagtagcatttttaattttctcccataactcttcctttgcattcacaacttggctatttggtgcaagagaccagcctgtctgagcttccgacatgtcttcctcgctaagctgggtcatttctagcttttgattgaaagtgagagacatgcaactcttcctttcacttgaatacttccaggccattatagaccattgtagagttgttaattgccctaatttcaatattgctatgtctcagggaatagggaggcctgaagagaaggagagagacagggaatggctggtcagtagaactgtcagaacacatatgacaagtattgattaagtttaccatcttatatgggcacggttcgtggtgccccaaaacaattacagtagtaacatcaaagatcaatgaccacagatcactgtaacagacataataataatgaagatggacacccatagacttgcttatgcagagttgccacaaaccttcaattcctaaagaaacacattacctgtgaagtgcgataagcagatgccataaaacaaggtgtttgtttgtgtgtgtgtgtgtctgtagaggggagggtgtttatatatgtatataattactcaagcttcctcagccaccttttagggctcagtttggtgaggaagctaattccctttattatgcatgtattcttactagattgactctctatggatgacattttatatcaagtttctggagtggggtgatgtcctgcatttccgcctttcagagcctcagcaggttaaaaaacaaataggacatggagacagtggaagccactgtgcactcctgctacggaaagacggctgtgccttgttgaagatgatactatatgattcgctaccagagtggggccatccctgcttcaggctgttcctagatgtttaaaagaacattccaaacgacgttaagaaactttgtgctgccatttgtgtattcctttccaaatcttttctaaaatgttagaattcagaccacagttcctgagctttggatgcaaactccttggccctgaatccctggaagccctcccctgtggatggtatcagccatcacagcaggatgtgctttaagaatccaaatgaattcagttataccacgtggcgggacttttaaacttgagctgagcttactcatttctggccgactattaatcctatagctaaatcatgtacgtaaaggaaggggaaaaaaatccaacctgggtaaccacacaacaaacactaaataaaaccaaggtaatgtatggggcatctctgtgctgcttagtaaaacttgaagtttcttaatgtcgcgaagtaacagaaattacttgggggaatttcaggtgtttttggtaaactctttggggaagtaaacagtcagtgaactttcggaatgctgggacttttgactgcagcaaaacaaagctaagacaagtggattccttaaaaaagaccactggcagcagaggagaagcagagctgggaagagacaggctggtgagctcaggggataaattctaccccctctacccagcaggactggccttaagcaaaactgaactaagagggagatgcttcccctccacccacctccgtgagtgtccccgatcgatcgcgctgtcccagctgggctgaccttgtattcacctccaggtcttgggtgtctgtacctcttggtggaggcatttggaagtgcacacaccttgtccactacctcaaactgtgtcctgatgtttttaaattatggcacacgtagccataaaaaataagtgtacagaagagtatataattacatggagagatgcttgccatagccttagttcagaaggcagattacaaaacagtataactatttttgtaagaaaaaagttaataagaagacaagcacgtacatctgtccatagaaggaaagcctgggaggatagccccacgttaacagtgtgtgtttccaggtggtagacctgctggcgatttgagcctgtttgggcttgtctgttttttcacactgagctgtactgctttggtactgcatccattccctcaatactcggcagtttaggtgagctcagtgtgagttaacatgtcaagaggtgacatgtttcccaaggaccttatatttgtaatgctcagggattgatggggacgggaggtttgtgttggctctagaatctcccctgtgaggacgctggaaggggaagcctagggttgaggaggcagtgagaaagtctccaagtccacaccatgtaaagctacttctcccctgctttagggaagcgcctgtttcacgatctcattaaatccaaataaatgggcttgcccatagttaaaatgtgttgatttaaccaaaaaacaaaaataggctgggcacggtggctcatccctgtaatcccagcactttgggaggccaaggtggaaggatggcttgaggccaggagtttgagactagcctgggcaacatagcaagaccctgtctctacaaaaataaaagaaaatagccaggtatgatgctgcacacctgttgtcccagctactcgggagactgaagcaggatcacttgagtctaggaggtggaggctgctgtgagctatgatcgtgcctctgcattccagcctgggtgacagagaccctgtccctaaaaaaaacacaaatagaaagtggttgaaggcaattcactcgcagttggctgcagtctgtttctctctcgtacttggggctgaactagcctcaggagaaggaggctcccgagccccgtagtgtgatcattacaacaaataacgcagaggagaggtttgcttcccattctgcctccacgccctccagcctggctcatccacatacacatcgtctgccaccgtgttccctgttgtggactgttttgttaaatctgccttttcccttctttttttccagtccacctaaacccactgtgttcatctctggggtcatcgcccgggtaagtctgggagtgtctgcggtgggtttgaggcttttgcatggcagcatggagtctcctggttgcttctggttttgttaaactctacctggaataacccagcaccactgctcatctcctctgtggccatggctctcttcattgccgcgtttccccagaggctgcttctgcagaccgcaggccagactcgcatcctttacctttccagagccgccgtctggtgagacccaacattgtgacttaagcgcagacctcccaccagtgaactcccatcagcaaacccccgcagtgaaccccacagtattgccgtccatagggctgctgttctcagaacattcactttcttatcagaggatgcctgaagaaagtgccagtgttggggacagcccactgttggtggagctgtgaccgcagccagccaacctgccagccagagaagtgtggctccagcctgcccatgtggaccccaccctggccacacccacagttggcacagaagcccattgatccctctggaaaatagggagtccctcctgagactggacaggccgaacctggctctgtctcgtaggcgccctgtgcatttccttcccagccagcgtcccaggcctggctcacagctgtggtggcacatctgaacttaagatcctggatttggttctgtcctgcccccaatttaaatagtcacaaatacagatgtagcagaagaaaccccgcagcatccaagtcagttctgtgggagtcgcatgttcctgtgtctcacggcatggggcagagccagtgagcattcttgctgtcctgccagtgtgtgggcctcagtgccacctgccattccctggttttgattgcccaggccccctaacacccacaagggacagacttccaccttcctttatccattcacagtccacgcctgccctgcagggacgctggtgggtgctggcctgggcttcctcacatacaactgccatgcttcctgcagggacgctggtgggcgctggcctggagcttcctcacccacaaaccccatgcttcctgcagggaagctggtgggtgctggcctggggcttcctcacatacaactgccatgcttcctgcagggacgctggtatggggcttcctcacccacaaaccccatgcttcctccagcgacactggtgggcgctggcctggagcttcctcatatacaaccgccatgcttcctacagggaccctggtggacgctggcctggggcttcctcacatacaaaccccatgcttcctgcagggaggctggttgctgctggccttcggcttactcacatacaaaccccatgcttcctgcagggacgctggtgggcactggtctggggcttcctcacccacaaacaccatgcttcctgcagggacgctgatgggtgctggcctggggcttcctcacatacaaaccccacgcttcttgcagggacgctggtgggcgttggcctggggcttcctcacccacaaacaccatgcttcctacagggatgctggtggctgctggcctgtagtttccacacatacaaaccccatgcttcctacagcgacgctggtgggctctggcctggagcttcctcatatacaaccgccatgcttcctgcagggatgctggtgggcgctggtctggggcttcctcacccacaaacaccatgcttcctgtaggaacgctggtgggtgctggcctggagcttcctcttatacaaccgccatccttcctgcagggactctgttgggcgctgtcctggggcttcctcacatacaactgccatgcttcctgtagggacgctggtgggctctggcctggagcttcctcacatacataccccatgcttcctgcagggacgctggtgggcgctggcctggggcttcctcacccacaaacaccatgcttcctgcagggacactggtgggtgctggcctgggggttcctcacccacaaacaccatgcttcctgcagggacactggtgggtgctggcctgggggttcctcacccacaaacaccatgcttcctgcagggacgttgatgggcgctggcctggacgttcctcacatacaaccgccatgcttcctgcagggacgctggtgggcgctggcctggggcttcctcacatacaaaccccatgcttcctgcaggggcgctggtgggccctggcctggggcttcctcacatacaaaccccatgcttcctacagggacgctggtggatgctggcctgaggcttcctcacacacaattgctatccttccgcagggacgctggtgggcactggcctggggcttcctcacccacaaaccccatgcttcctattgattaacctgagctttccgtgtttcctgacagggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctccagctttgttttttcttatagatcagagattcccttttacattttaccagggttgccaggtggtttcagtagaaatacaaacgtgtacatgataggtattttcaaaacttattttccagatagaaaagtagaactgttggacacctggtgactggagtctaattatctacttaaaatgtcagaacatggaaaaagcttaataccattgattaaaacatattacttgggcccagcagctggcctgtgccaggtaggccctttgggaacagatttaagagagaatgatgaatagtaagcccaggggtgacagtgagcagcttttgatgtacaagatgtttgccttaatcagaaggtctcctgtaacccttgtgagaaaataatcacaactattacactggcaatccagaatcaaatcagaatttgagtgggaggggcctgaggttttctcacccagggccatatttgtcagggagcaccagagagagcaccaggggccacattcagagccccggcttgggagtggctggagcccacgcctccaacaaccctggccttgcctggtgttgcctctgaagctgctgcttgtattcctgcctcctgtctcccatgctaagctgaggacaggaaccagggccatactcattttctgtcactgggcagagagtccattctcagtaaatacattgtggtggccagaaatgccaagcatccaacaagcatggaacagaaccacccccagggctctccacatcattcctgaacatcattatcctgtgtcagttttctattgctgccttaacaaagtcacaaattaagccacaaactgggtggcttaaaacaacaggaatgtattctctcacagttctggagaggtttgaaatcagtgtgttggccaggccacacgccctccacagactcagtgggagttcctggcctcacccagctcctggcggctgtggccatccttggcattccttggcttgtgggcagcatcactctggtctctgactccgctgtcatatggccatcccctgtctatgtgtctgtctccaaatctttcttgttttctgaggataccagtcattagatgaatgcccaccctatgccactatgacctcgccttcactaattacacctgcagagactctgtttccaattaaggttacattcagaggcactgagatttaggacttccacatatcttttggggaaacatcgttcacccaagaacatcacccatgtgctgaaaagccagaaacctcactcccagctcacaccatttgaagaacagttcacttagtgcatcacttttctgcaaaaactttgctgggagaaccttcacctgctgcaggtttcatgataaagcatctctagccgtgcagcagcccaagcctggctgcaggacgtacagagaaaagactggaagcagagacatgaagggacaggacccttggctgcagaggctgcctgtccctgggtccagtggctgtgggattacttgctgtcgcatgtgtcctcagcccagagagtcgcggtgttgccactgtgctccatggatggtggttgtaccattttacaggaggaaagactgaagttcagcatccagtgtcaaagccactgttagcagttggccaataagcacatcaaaagatgctcaacgtctttcgtcaccagggagatgcagatcaaagccacaatgaaataccacttcaccaagatggctagaaccaaaaagtctatggcacaagggtactgacaggaatgcagagaaattggaactcgtacaatgctgttgggagtgcaaaatggtgcagccacttgggaaaacagtcccaagtgaaaaaacagaaaaacagtttctcaagtgagaaaacagttcctcaaacaattaaacatagagttatatgacccagcaatccactcctaggtatatacacc

SEQ ID NO: 12363 - DNA, 18048 bp, Human
ttgtcataaggggtggtaactaatcaaaaactgcctcaacgtttcctctgctccctatacatgtgcatcctgatctgacaccaaaaggtagagagtatttctccttatgaatctgagatctccttgtgattgattgaccaacagaatatggaaaaatgatattctaggaactcttggcccccagccttcaggttgtgagaaggccaagccaaggagaggccatgtaaagaactaaagtgctcagaattacagctccagctgagctctcaggtaacaactatgaaagtggcatctgaaatgttctgccccaactgagtcttcagatgactacaatgctagctgtgagagataagaaaatggtagttgttttaaaatgcaaagtattgaagtggtttttgatatagcaatagataacaaaaatgcctagttttattgtaaatgttatccacagttttcaattttgttatctaattgctcctctgtttttatgtagggatttgaagagagtctaaaataatgtcttgtaatgcaatctgcccaaatctgcccagaatccaattctgtcataagattataaggttcttctagcatagatctcagttaagacccatgaaaccatcagagagtgtaattcagaaccagagcaaatcacagggaatttatagcttccccatatggactttggctttctaatcaaccctaaatgaaaatagacatctctttcctcattgtctgcaccaccctcccccgcatattatagttcacactaaatatgttgataatccatatatctgacattagttgcctgaataaattgggcactctaattttctagatccatgttaggagcatcagctcaattttttttttaacaattaaagcatttttttaaaagttacagtgagttatgcagatactgtaatcaagttaatagtttggctaattttcaagccaatccactcagtcattcaaagagtactgagtgattattaagaactgttctaggtatccaggcactgattatagatcagtagacaagcaaacatccctactcttaaggaaattaaggtccagcagctgatattctctaaattcttgttcagtggccatcctgccgtcacttgaacacgctcctgggaaattgccaaacccatttccagctccctacaacttttagtacgcttcctcgaaaatgttttggtaaatatcattttatccatttcattacattttcagtggtggcacagagtcccttcaagattagtttccttggatgctacccagctagtattccccttaatccaattctgatttcaaagaatcattaaaatgtggcaaacagggaatgattaagtgttaagtgttagatctaaatttcttgaataacacaatagctacttaaggggggtactttagtggacgctttattagattagtaggagtttgggaactttgtgtgtatatgggggtggggagatgagaggaaaaggaggtgagtagtagaggttgttaaaagaggaaaaaggaagaaataaaagcccatattctcaaaaccaacaatttaaggaactctagtattttagtagctttctccatgtacaacctggaaatgtacattaacaggaaactttctacccacccctgcctccgcctttcccatccttgggtctgctgggatctgtcggtgggtagaagacattgtcattgttcataagactgcctgaatgtgaatgacatatatttagaaatcaaaataaagttttgggaagatcttcaatttaatggaaactagtctagtcatttgggaaccacaagagctttttagggaaaatgtgcctctgccagctggaggaagtgtgggtgtaccggggtcccggtgacaccttgtgatgtcagtcacccccagcctgaggttgattggctatgaagagctgcagcagagtttaaattcctgcaccatcagagaagtgtccagaatatcaacacaagagtggcttcattgggcatagatttcctctttgagaacatcaacctgatttttgagactttttgaaaaaattctttgtgaactacggagggtaagtcattttcatcatttaattttttaaaatgacttttgctggttgtttggaaaatattaaatatgtatacatgtttgaggcattataccatgtagagagagatgggagagctgcgctttgggtaaaaacagttcctatttttgtgcctgttgtttatgccacagtaaataatgatatgaaaatgacatgttaagacaatacagccaggtgtttttcttggtaatgctttaattagatctctgcatgacacttctaaaagggatagtttatagaacaggaggcagatggaaggtcattttgaaatttagttttaattagcaaaacgtataaaacttttacagtgtgtttcatgaataagggaatgtttgcaacctacaagattgtgaaaaaaaagctaaacttattgaatggcaggactttaaaaagaattttttttaaattaaaatgttattcatctagagagcatctagtaacatttattatgaactgcataagtaactaaaagatgattaaactactgaaataactgagggtgtgataattatgttttttgtattcatgttagcatgatgccttgaatacagttagaattcaataaatgttgaatataattatattttaaaatattgcattttaaaacatatattttaaaatgtccatatgtatttttatttactgtatttagtgcacttcttcatctgtgtgacgtttagaagagtccatgtgttttagcaacttgtcttccttaagagcagtaacttgtggttaaccatactttctgtttaactgaggcttgactatcttattttaactttgttgtttaaaaatgcgaacaaactattttctaaagggtattagtccacttacctacctgaaaatggtgatgtaaaacaatgtgcctcagatgcttagaggccttccaaatctatatttaattttgggggcacctcagaggtatattcctgtgattaaaagcatataatattggattcatcgtaattgacctgaagacacatacaataggaagaattggatttttttttggtttgtttgtttctctggattcctggtagagttcatatcctggccaagtttgattctattttcaaagagtaataagaaaacaaattctagcaggttctagttagttggattctggttaattttattattataaaaccaacttattttattattattgtttattattattaaagtttcctgctaatgtacatttacaggttgtacatggagaaagctaccaaaatattagagtttcttaaattgttggttttgagaatatgggctagaaaagtgcctaacacattgcatgttcataaatatttactgactgctaatgaatgaatgtattgttcagttgtgttcttgaagataacaatactaagacaaataaagcaaattaatatgatgaattgttttccaaaagaaaaaagagtctatgacttttcaaacctttattttcttcttttggcctatttccttcattttggtttacataaaagaagatatatattttacaaatgtatcttaaccttgagaaaatgctagaacaaatttccttacttaagagccgaaagaagttttggctacacacctgaaatcttgactttagtttccctctccacattctaaacatttggctcttttcaactctatgaaaacaattcacaggggcagaaattctctaatacaccgccttccaaatggatggaactcaagttgtttatttccttttgttacgtcatctcactgtagaatgacagcatgtagaatgtagaaataacattaaccaatcactgaagaagaactcaaagttctggacttttaattgcaggcttgtagctgtggttcacatttattattcagaatacggctactgcctatctgcttctactcttttttgaatagtagccaaaatgtttataaaagtttggagctcttgtttggaaatgcacttcacaaaattataattatttttatcagaaataccaaatgcaaacctaacaaggggtttaagatctgattttctttaatgcttacagttggactatattttttgggtggcaacatcagctctctcagaactctagagtgtcttttattttagtttactagacttgcatctgggaaattattgctttaggtcaggatgctaacgagtatttctagaatcctgagcaagttagggcatctttcttgtgttttagaatcttccatccctaagaaacttgagcacttggggcatgcacttctttgtgagaaaacacaacgttcattggtttagaataaatgcacaatggcatccccagttttctaattatttagattagagaagctaaagaaaatacaagagaattcaatagtcattgaccttctgtcaaggctctaacatttgctagctttcagagaatcatgaaattataaccctattcaaatttcactttgaaaattaaaatgatgaggtaactttcatttgatctgtgaaactgaaagcattgaaagggttattttgagaatatcatatttgagaaaattttgctttcctgaagaaataaacctaacacattttttaaaaagttttgattgtggtatctaaagagaagtaacatctattaaattaagcttgattttggtatagttaagcattttcatatgtttttctctgttgatattaattgaaggatttttaaaagaaattaagatagtatcaaacataaggactgatatacactatgcgaattagaataaagaaagtagcacaaattaagaataactatgctgaggagagataatgcccataacatacatgagaggttgtttgaccatttgagttgtgtgaaagcagaaatgagaagcctgttcaggctccttatcttaggatttctattattttattgaatacattaaaaataagattagatgacttcttgagcccaatgtttcagacaatattcagcatattcaggcattatcgagtgatatatatatatatatatatatatatatatatatatatatatatatactttttttttgagatagggtcttgctctgtcacccaaacaggtgtggagtggcacgatcatggctcagtgcagcttcaacctccctggctcaaagaattctccccactcagcctcctgagtagctgggactacaggcacgtgccaccaagcctggttaattatgatatttttaattcttagatcaagtgttaaaatctcttgtggaactttaaaaacaaacctattcctgtgcccacccaagtgaatggatttattgccctgggatgggatttgtgcattggcatttttaaaactcttcccagttgatagtaatatatatttagggttgagaatctttggcttttaactcctatcattattttaggggccaagggaaaacttccccctcaccctctgaaggtttgctgaaaatcaactgacaaaatatagattaataggagaaaaggaatacaaaattatttttatgtgacacaggagccttcagaacgaagacctaaagatacaggagaaactgtccatctttatgcttatgtccaacaaaacatgggcagccatgtagaaatatgattggacaaaaaggttttgaccttatactagtagaccaagtggggtggcccagcaaagcctgtccagattcttcttggcctctccgtgcagcatttcttccttcttgatatgggacaggaccttctctgcaatgcgggtcttatgacatacaattaaactaggggggtcagagaatttctttaaggccagttgttacacagaaagacagggggacttagggtaatattttcaggttttattgctggctttggggaaaagaggttctggtttctataacctgcctttgggaaagagggattctagtttctatggttagtctcaggggagaatgaggggccagagataggagggcaggggaaggtcagagagaagcttttgcttctgaggctgcttctgaggccttcattatggagtattgttttctgagttcctataccagtaaactattgcaaatcaaagaaaatgactgaggtgagtctcaattatttttggagacttatcttgccaaaattgaggatgcacctgggaaaaatgaacacaaaactaccagaaacatctatggtccatgtttgtttacaaagagtccgaggacttcagtatttaaaggggaaagaacaggcaataggagaaaggaaggacagataaaagaggcaagtggttgcattcctttgagtctttgtttagtgctcactgagcccacattttatatgtgaaaggagagggtagaggaatagtcaattatgcatttgtctcatgctcagtgaatctgcatttctacataagataaagtaaacatagactagaggaagctgtcagacatgcatctgtctcaggtgagaagaggaatgacttttagttctgtcctttgtcctgaacttatgaaggtaagctgttaatttacattgtgagggtgaaattcaaccagactgttttggggtaaagatctcagggcccacaggaatttccctgtgagaaaattgtgagggaggtatgtagccttttatccttgtagctatctttttaagaacaaaatgggaggcaggtttgagtgacccagttcctaggttgactttccctttgacttagtgagtttggggtcccaagattttattttcctttcacagtatacatttaacatttaaagaaatgaaacaaatcgacaaacgtgaaataaacttgcaggattatttgtgaaatgtatggaagttcatcagacaagtatgctagggcagctaccagggcttactagtgcagggtaaattgcgttccttaaaccatttcaataaatttttactttagcatctagtacttctatttttaaatacaaaacaaagtgttttccaaagcaacagctcttgaagtgtgaaatgaagttaccctccagaaaaatagtttgatttggcgtgtttctctcagcatgatttacaagtgtatcccaaacctgtaatcttccccaaatccttcagtactgtgaatgacagcaaaaataatttagcataattatgtataatgtatgactaaacgtgtcacagtagatattaagagctttctgaagttgtaatatgaagcctactctagcgcatctcttgcagatcacaaaaaaagcaaaaaaaaatctattttgtgtagacattattatgcagtcataaatgtgacttagaagccattgtgtgtgtgtgtgtgtatgtgtatgtgtgtgtttgtgtgtgtgtgaaaacaaatgcccaccacctatcactggtgtcaataagtgtagttttttagggagaatacatttgctagggtgctctgccataccaagctgcataattattgtaaaagggaatggatagaaatttctatattcctctttctttactttttcgtcaatttatcatactttatgtgttagcgtttgtacatctcctcattgaaacattttcaatttatttcttaggagtgaggtttttaaaaaccactttgttgagttataatctatacaccacatacttcactaatttgaagtgtatagctcagtggttttcagtatgttcacagagttgtgcaaccttcactacaatacatggaacagtttcatcacctccaaaagaaatcctgtacccattagctgtcacccctcaacctcccatctgcacaagctctgggcaaccactagtctactttttgtctctgtagatttgcctattgtggacatttcatgtaaatagaatcattccaatgtggcctttttatctggcttctttcacttagcatagtgttctcaagtttcctctactctgcagcacatgtcagtacttcattcctctttatggttgaataatattctgttttatagatacagtaaattttatttatccattcatcagttcatggacatttggatgaatttttagtaggaagaaactgttaaaaagttgaagctactttattcctttaacatggagagaaacatctatgtccttcattccaggtagaggtatcacacccaactatgaagatcagcatcctgctcatgttcctttggggattatcctgtgctctcccagtaagtattagggtagggatatatgaaaaaaccctttcatacttaaaactccacaattttgattggctatgaaccaagatggctgtgtatgttccagtccagtaaaaatagtagtttcttagcatgctgttttcttaagaaatatcattcaaggtgttttttattctgttcagttgccattcacatagatatcattcatacttttcttccctataagcagtgcttcttaaagtgtcatcctggaaccaccagcatcagcatcaactaggaccttgttagaaatccaaattcttggaccctacctcagagctgctaagccagactctttagggataggaaacagaaatcagtgttttaacaaggcctcccagtgattctgatgcagcctaaaatttgactatccctactcctatgtatgaaatgtgttaataactattgctttagaaatttctctttggatttaccatgtgtactaaattttctaggtaaccaggtatcaaaataatgaatctgaggattctgaagaatggaaggtgagtagaaatatgactttttgaaatattttaattttaatttattatgagtataaccaaattgatttcattgcaaatgttgaaactgctaatgacttcatcagcatattaataagctaagctatagagttcatagaagaaaatactgctgtgattccaacttagtagtatactctggcaaggaagcatattttctgttagctttcttcttataatggatgtgtataatagtaccaggggatgcatgacaatgaatcaagagtcttcaggagagattatgacttgaaatctgttttaacaagagttatctggtgggcaagaggtcaagtcctggaaggtgaaaaaagaaagaagaatgagaggacactagagtctctggaatgagagctaatgttgctagcatgttattatattgagagttactaactctcaataactcaagaatcattgccaggcacagttctgagtgttttacatatattaactttcttaattttcacacctctgtgaattaggtattatgttttattctcactttacagatgagaaaactgatcacagagagtaattcaatcgtctaggttacatggtcaattagtgttagagccagactttgatattacgtcactctagctccagaatccacattcttaaccagtgtgtcatatccctctcaggaaggagccaggtctaagaggtcagaaaattctcaagattggcactaagggttaaaatcttatgcgaaatcagagcattttgttcactactgtgtttcctactggcttttacatatgataaagcttggccccaatgcttttggtggtggccagataatgtcagtgacctgaggtggggtcctgtccatgcctgagtctggaatagactttgcagtatttattatgaactttcttcagagaaatccataggctggttaatttaaaagcagacactctagatcctctctctcatttaaccagagacgcacaaacatgccctgttctcaagtctagccttggcatgagaaaaataacaatgtcttgctcccttccacccattaattccaaatgataattgactggagcacagcctgccattgtgcctgcctgcagtgttgcaggccaaagacagcgtgattatagctcctttccctaaggagatacccccagtccagcacctctgaaacgcacgttgaagacatgtcaatagcagctcctccctgctctactttgcgccttgggtgttccacacaggactttgccctcctcaaggggaaggggaagaagtgatggggaggggtaccagaagttgctaaggcattcttatagtgcttatgagactaaagatagtgaaataaattagaggtatgactagttaaatttctgatttagcatttgtttttaataccagggcttttacatgactcgagaagggtttcatggctttctcaattcagttttgtttactattaaattttataaggtggatgttatcaaatggattttttctttagtttatatcatgttgaataaatagttttcgagatacttccataggcattagctggtttcatcttcataactaccttgtggggtaagcacagtgggtgttaatttccttaatttatgaataagaaactggtggtcagacacgtgaagtgaattgcccaccttcacctagagtaaccaaccatctcggtttacctggaacttaggggtttcctggaacacatgactttcagtgctaacaccaagatgattggttttcagggctaaaaccaaaaccagtgagttaattgagacttaaatctggattctgagtttcaatgctgcttttcctgtgttacgtttcctctaggttgtatgaacggccaggttcaaaaaagcatatttatttctgtaaatgaaatatcagaaatataaacattgtctaggtctcttatatcccaagatcttttcaagccattagtcattttactttccttttggaaccatttcatcataaaatttcactattactcatgtaaatgtaagatctctaccaagaaactaaaaataataacctaaaattattgtaaataattacaataatgaaatccatctgtgagggagtaatttgttttccttcctttccttttttgcagggtcatttggctcaggcaccaacaccacccttggtaactatctcatttacttttgtcataaacatctcatgaagtaactttaacactcttccagttgccttttacaattttgaaagtagtaaatccagactggaagcaattgatgtgtatcatgtttttttctttcctaaggaattactaaaaagaaaagtaaacatttttcccctttcaggagagcagtgagtcatcagaaggcagtaaagttagctcagaggaacaggtaattaaacagacctttcttaacttttcaggctacttaggaatggaaggaaatgatgttagattaaattacctggcgacagttctaaatataatattttctaactatgagttatgctggctaaagagtcctataaagtaagaagagaaaaatgagtaaggagaattcacatgcagacatgctattcatcttattttcatcactgagcctagattgctggcactgtggccccaaatgtctctcctagttaaaacataaacacatgcgcagaaacacacacacacactcacaaatggtcattgaccatgtcaaacttgctcatcaacttaaaatgttgcttttacaattggagcagttcagctcaggtgaagaagtgcctgggagcttctatgtgtcaaggatcctgctcgaagacagaacaggacagccctgaggaaactttaatgaaaagaactgcttcagtgatgactttctcttcgaaaatagtcccatctgtgggactgggctctgggagtgagaaaggcagactcagtttatatcccttaaagctggcattctttttcatttttctaagactaagtgttgttactttcttagctatgctattgttttgaccaaactcaatcctgtggggctccagagagtccaggagccaggtttctccctaaggctttgatccatgttgcattctacacttagccagagttggaagatgaattattagcctgtttatccctatttacttaaggttatcaaaggaacattctagaaatttaaaagcatagaactggagaaatgccgtttgctggggactttgtgatttgttgtctcaagggtctgtaagctttcaagttacggtagcaattcctgcttgagaaagggtaatgaggtatggtgattcctgcagttcctgcttgtgagttgggttaacgaggtatggcaggttaaacccatgctcagttccaccatactagcataaaactccagtgctaggaagagaggtcaacagcatatacacaagtactcccaatcacccaattacagactcagacattgatcagtagggatgtgtaaaaacaaaacaaaacaaaacaaaaactagcaggtatgctctgttgtagggtatggtaaagagagcagatattttgggagcataatgtatgaagactcactgtccttccttactggtacagagcatccaattgttttacttacagggctcacctctctgacttcccacgtagcactaagttgccttgttggtcacactagttggtgtcttctagctgaatcatctataggcaactttctggttgtactaacgaggtagaaacatggtttgggtgaagtatataccttactataatatttaattttcattttagctaaagattttatcctctggtcctagtacatttttccctccagaagaaaaaaaattggggtcattttaagatcactcaatatttttaaaaactctgtttcacaccaaacactttaatgcatgagcattataaaccaactctaattcacaaacaattacctaagaggtttttttgtgtgtgtgtttgtttgtttgagacggagtctcgctctgtcgccaggctggagtgcagtggctcgatctcggctcactgcaacctctgccccccaggttcaagtgattctcctgcctcagcctcccaagtaactgggactacaggtttgtggcaccacagccagctaatttttttttttttttttttttttttttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtattttttagtaaagacggggtttcaccgtgttagccaggatggtctcgatctcctgacctcgtgatccgcccgcctcggcctcccaaagtgctgggattacaggcgtgagccaccgcgcccggcctgctaatttttgtatttttagtagagacgaggtttcaccatgttggccaagatggtctcgatctcttgacctcggcctcctaaagtgctgggttatgggtgtgagccaccttgcccagcccaagagtttttttttttttttttaaggaattatatatacagtatgatttgaatttcataaatgtgatttccagaaagctttttgagaaaatgttggcagcattgagtgaagtgtgcctatataaaatggaaccacttgagtttcaattcctcttccttcctatttaagctctggtagagaggttattgagtagtaaaactgaccgtagattagaggaggggatgtagggcgaaggaagcagaaagactagaaaggctctagataactccttctctatcggttcctggaatactgaccatatctgttaaccccaaattctaggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaaggagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccggggaattctattcttgggataaataatagtaaattctataggattcaatacttagtttgcaaaagcactttgaaattatggcacagtgagttgttttggataagaaaatctttttctcccaattaatttaccaattcatcattttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaatatgtgtttatttgtaatcgtggtgctgattattaggatatatttgtgttaagcaactctttctttaaagcattcccaaatagttcagtaccttcctcctattaaaatgaaagattttcttaaattatttcctgaaaattttatttgtaattcaggtagcatttgataaaaatactatgtgttgcttatgatatttcactaactatacctgttacagaacagggagaaaaaaatgaagtaaactctgaatttttgtttgatgccacagtaaaagtttatgatgtttaggcttaacattatttcctgctggtctctcagactcatttgtgtaagttctggaagctacagagtaccatattccttatatttttatttctttgaaagaaacgacttcacgtcagcacttctactttacaaatgtgtttttactcccacttccactgcagtacctcagaattccccacaaaattattagtagaatccagaagacttcctggccgggtgcagtggctcatgcctgtcatcccagcactttgggaggccaaggtgagcagatcacttgaggtcaggagttcgagaccagcctggccaacacggtctccactaaaaataccaaatgagccaggtgtggtggcacgtctctgtagtctcagctactcaggaggctgaggcacaagaatcacttgaacccaggaggcggaggttgtagtgagccaagatcgtgccattgcactccagcctggtaaacaagagtgagaccctgtctcaaaaaaagaaaaaaaaaaaaaaagaatcaagaagacttcctaactttcagtctcacctttcccatccttcacatttctctgttccctcacaaggtcaaaggtgtgtttacctggggagatttaaaaattgtgtgtgtgtgtgtgtgtgtgtgtgtgtgtgtgtgtgtgtgtgtgtgtattctctaatgcttccccttgaaattttagagcttttaatttagtaggtctggagtgagacccagagttctgcatctctaaaaggattccaggaaattctggtggagcctatccactatcgctatttggggtctccatttggattaattatctgactccattaacctacaggttcctgccaacccattgctccttctgagaagaactgccccatgctcagacctcctgggtgcctgaggcacaggtggccaggttctaaccactcacatgccccacctcaccataggggattggaagaattagcacctgatgtgaggggagcctggctggcagcttccaaggaggcatgttgcaaaggcctcatctgcctgaacgcggatgatgggggcttgaggtctaatcttattttccttctctgaaaatatgtatatttagggaaagagatgtcagaaagtggttagaacaaaaacagaagggaatacacagagaggcagaaacggagagtgggctaacccccattaatgtggcacacaaaatggaaaattatggagctcctgatgctgaggggcaaaataatcatcttccggcctgcaagttggatttgactcttctattgcccccaagccttcctggattctgggatgttttgtcttctcgaatgccgcctgcatgagggcacccacctttcttcaggcaacttgagtgagtctttgttcccggcaaccaaaatgcttaatgaacagagacttagaaacttatgttatgttagctagcgttcctagcttctgtaacccagtggtccccaaactttctgctgtcagggaccagtttcatggaagacaatttttccagggatgaggggtgagggggatggtttcagggttattcaagtgcattacatttattgtgcacttattttctattattattacattggaatatataatgaaataattatacaactccccatagtgtagaatcagccctgagcttgttgtcctgtaactagatggttccatctgggggtgatgggagacagtgacagatcat

SEQ ID NO: 12364 - DNA, 101356 bp, Human
aaaggggtgatctcttaattctttcgttatgtcctattgtacatagcatataatggtaattcagaaaaattacttctaattacataaattttcacaatggtatagtgactaatacgctgaaatagaaaagtaaggcattgttatcatggtctagttcagtctttattgcgactatatctgataatatacggtaagcatctaaccacttgccaggggccacagagccacagggagactatgtctcgcttaaattcccaaaagtgggcccctgtgcttcaaaacgtccccgcatgggaaccacaaaaacgttgcctccccagttatcaccccaagggcccaagagccgaggactctgcccggcgtccttcagctggcaccagctgtcagaaaagcggaactggggacgaggactttgcccctaaccaacatggccgccctgaggcttcgggcttcgggcggcagaaggaaggtcacgtgaagagaattccgttcctttattggccccgtctcctggaagggcggggtacaataacccaaccggcgccggccttaaaggggccaccgttggatctgccggtggccggccctaggggctgggggggcggtcgccgcgccgggcttctgcccctcccgcgcggaacggtgacgggcggggctggcgctgggaggccgtgtcgctgggagactgctgacagcccgccgcctgccgccgcgcgattccgagggggttaacggcggagccgccggccgggcgcggaccggagcgcgtgaggctccggcgcgcaagcccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggtgaggaccgcgccgggcgggccgtcggggcggagggcggacacttgttgcccgaggaggcggcgcgggtcgcagcgcccagtcccggccgcgcgcggggcggggaggcagcgacgtcccccgggctgctcggccgcggacccgtcagggctggggcgtggggacggcgccccgagggtcccggtcccctagcacccccggggcgcgcggagctcactgcagagtcccacaggctcgccccggcccccgtgtgcgcccaggctggtgcgactaggggggtgaattcgctccccaaggtggggcagcgccgccgccccctgcgctctcgccatcgccccgcatttactcgctggaggagggggtcacctcattcctagggaggaggaaacagacattgagcggcgacgtgactcagtgttcataaataggacgacgtccctgcattcccaatctgcactattggaagaaaagccaatgtttgggtgaggatccgtggttgctcattagccagcggctggccagttttggtggaattgtgttggggggaaggggaccatctttcagacctttaggatatttagtcaagaaccttgcccccttgtgtgaaggtgtggcttgccgccatcggggacacccagtacatggggagtcgactccttcccccgcctccccccacccccgcaaaatccacacaatttagacactttggagggtgaggggcaggtatgagtaatcaataatggtggtggggaggaagaatttatttcaaatctgcagttattgtgcagaataaaatgtggacaacgtgggcgtcacagaatgaaaccggtctttgagagatgccccattaggagagcagctgtcaaaaaaagcagtgctttcagcgcttggctgtgggtccacaaatgctgtcaatgaactatagttgaaggctgctgccaatacaacaccactgtgaaacagaatggtgtatgtaagtgtcatttatttataatttatatgttcacttactttctgaaaggaattacaatggccgtgtgcttaggtaagcttccaggcatgctttctagagcagcaattgtcaggaactcagggtcttactgattgatcttactctaaaaccttttcctctccatataaactaagcgctagccagcatttcagaccttttccttaggagttctaggctgtctttctgctagaacaaggtcaagtcacgtaagacggcacttacttgtagtgttggagacaattttttccagtgttggatacaatcctgaaattgtgttgtatgaaagtttgcccacttcgctagctattcattttaacaaatatttattgagacttcgctacgggataggtactgtcctaggctctgaggctgcatcagtaaataaaatagcatttctgcctccagggttgacattttttggaagggaaacaagcaataaagaaatatcaaatgtatcagaaagtaatgatgctataggaaaaaataagacttggagggcaggaggagggagtggagatctgggagtggaggggagattgctattttccataagatgatcagggaaggtcttactgatatggtgatattttgagcagagacaatgtagcattggttcattcaggctttgctgtctattgagtgcttactgtgttccagccactggtttaggcccagaggataaagcagggaacatttcaagctccttgctttcatggagcttaggatccagtggttgagggggagatagacaataggaaaaaggcaagtgaacaagatcatttcggatagtgataaatgcgatgaagagactgaaacagggatagagagcaaggggagggggcttggtcagagtggtcaggtcctaacactgtgggggttttgttgaagagctggtgaattggggcagtcctgagggaactaacaagggatgtccaggcctgcagccatgagcaacagctggaagctggagctgggggaggaagtcacgtggctggaaacctaggggaggagctgcctgccaggagctgtagacttgaaggtgtggagttgagatgctaaggcagggtacaggcagggaagaaattctcaggcttctgatttcattggcagaactcaaaggacagctaggaggcaagggagcccctgcagtggagtccataggttgggtcatcctttcagggcccacagaagggtagataatggctctggggacagtgtggataaaggggacttacacagaggagttagtagggagccactttagatggagtggcccagggaggcctctgcacagcctggaccaggttgacaggaagaagctccctggggaggtgtttgtgtggccggcatcccggcagagggactagcaggtgcagaagctccagtgcagggtgaactccatttttaaaggacttgaagggttgcatgagagacagagaggcgattggtagctgaggttggataagcaaccagaaaacatccccctggggccatggtaaggattcaggtgtgattctaattgcacatcttggtggagaatggctttcaggagggaaactgggtaggctagagaggaagcaaggagacctggtaggaggctgttgccatcatccaggggagataggaagggagtgggactaggatggtggtattggagatggagaaaggggcagagcctccatctgagcctcttctctccatttggagaatctggagcttcagaatggggatgagggagggttgtgcactgatgtccaattctagggtcctgtgagatatacagcaatcagtgaaaacccaaaaaccaggtgggctaagggagtcccagtctctgagggcaaatagctctatgcagtgggcaacctgagagctaaagtcacagcgggtccttggtaagccttgcagcaagtggaccatttctcatttagctgaaaccatccttctaggtgggaatatgtagtttctgcggtttcaatgtggcagtcttactgttaagactggggtgtcacctttggatgatgtaatgtaaatgtaaatctactttaggttggtggtatctccccttgtgtaaacagatcattaactgcaatgctgacaaaagtccctgggggtctggccgtcccctccttagccagtctgttggatctggagagtgatggtgtgaggaaaaaagactggatcaaacttctttatatatagtcacatgattctgtaagcttagtcttcaaggaaagaaaaaaaattaacctgaactagaattcttttgaaaatttacatcagaagctgttttgtaactataattgcttggccagatatgtaagatttgttttcattggctggctcaggatcaatattgtaaatactgtataatgagtttgttaattaaatgtattagattcacactgttacagatgaatgaaaacttttattaaaatatgattattttctgtttgtacaaatatttgatgaacatattccattatagtactctttttgtgagtctttttttcttttctatttagaaaagcaaaacaattcaaaatgctttgaaccagtaattacatgtgctttgaattgctgaaaatggttagttggttccctggaataagagtttattcagtcatcatcaagctgaccaggaatttaagagttctcagataatattccgttcatttccaagcagtgaatatagttccgtatagtaatggaaacaaatacccttttttcagttgtctgaaatatgaatgtatatttgattcatagagctttgctggaaggctaagtcagaaaattatagaaaaatttactcttttcgcttgagtaaacttacctaaaaaaaacaaaaacaactcacctaagatttgtgatagatgtagtgctatcatgactttcttttaataacaaaatattcggatcagcatgaaagaagtagaagtgacatccttccattctttatgtgagtagagacctttgagcagtgctcccaaccttagctgcacgtcagagtctctagggagctttgaaaaattcccatttccaggccactccaaacccattccaatctctggggctgggaatcgcctggaaagctccccaggtgattctaattgttagctgaggttgggaaccattgtctgaagccggggtttggcctgaccagaggcatcgttatatcttaaaaagatcactgaaaatttgatgaagctccacttctagctagatgacttaccctttctgtgccttgatttcctgaaccgggagccaggcccttggtctgcaggcttccttctcctgattgttgtttgaccctgtggcctacaggcggggtcactggtgcccacagaccaggagatggggcatttggtttaaccttaggttacctccgttcgccttaatgggtgctgctcactctccacccaaacggcagatcatgcacttggcctcccaaaacttgttttctggtcgcaggacatcattcgaaagcaatttgatgattgaagtgttttgaggacctaaggtggccctgctgatgtacatagtttccactcctgaggttgtatatacttggctgcgtttctgcctgttcctcttccaagccagtctgttgtagcatattgtaaaatgtgacatcctagcaggagagtaacagttgggttctattgcactggaaaatccaggcagttttaggccattttcacttttcaccctagtgtgagggtgaggcatgcggtttctcagatttaaattctgaataaaatttccccttaaatgatcttatctccaatatggtatagagtttaatttatttgggaaggttcagaatgttgtacatttttgaaagctacatgttacatatgtgcgaagtttattttcagttttccactatttctctaattttagggtttctgactctaaaatcagatgtttttcacatccagagctgctttaaatcctcctcaccactccaccccctaacaactgcttggttcccctctcagctcaatctgctgtcaccttcattacttaaagcattttttcttccatagcagtagctttaaatgttactgcctgcaacttcaggcttttccagcctcaggacaattacataaaggaacaaaaaataggctttgtgctagagcagaatagctaaggcaggagctgttggttccaatgtttatatttcaggctatattctttgtctctttgtttctctccttttaaaaaaatgtgatccactcattttcatacatatcaccgcagggcctgtttgcgcaggtctgagaacgcatcactcctggtacagtaatagtgactgtgcacacatcagcatgtgtgggatgggtagaccctgggtgtacattgtctatgcagaatcattaggactcatctcaaggatgctgaggaagtgccagtcatttcacatacagttcagttgtgagagacaattttttcctttgtaaatactaatcaccatcaaagcataagaatgctgatgagacacagccgatcactctgccatgatctctgagcattaggaggctataccatggcagtagaaagtaaaaatgtctcttcttgggaaaaacagaaacattttcaaagtgtaacctcaggagaatattaattaccttaactcaaactttgacgttggggaaagggttggcttcatgttgtgtaaatttcaatcatcatagaaattctttaccatatttgatatagttggggtaggttttttatttattttcacctctgaagatttagctgggtttaatatgctcacattccccagtgaagtctacatgaggaggctgggaagcatactggttaaggctatgggtcttaagcatacctttcccacttatgcagtgtgactctgggaagctatttatcctaccgatgccttggtttccctgcctgtaaatggagctgttgatagtactcacattttatgatacacataaaatgcctgtcagagtgattgggtctgtatatacaatataggtttgtgtattagttatctactgccatgtaacaaacccaacacttagtggcttaaataataaatgttaattatgtcacagtgtctgtgggtcagaaattcagggatggcttagcctggtgcccctgcctcagagtctctcccaaggctgcaataaaatatcagctgtggtttcatctgaaggctgaactgaaggagtggtatctactgccaggctcacttgtgtgggggctgctgcaccctctccatagggtggcttgcagcatggcagcaggcttccctcagagcaagccagatggaatgggatccaccatctttttgtagcctaatctcagtgatatcccatcactttcgctgtattctattcctgagaagcgagtcggtaagtgcaaatctcactcagggagagggaattacaaaagggtgtaaataccaggacgtggggatccctgggggccatcctataggccagtggtccccaacatttttggtaccagggaccagtttcatggaagacagtttttctacagaccagggggcagggagctagtttcaggataattcaagtgcattacatttactgtgtactttagttctattattatataataaaataattatacaactcaccataatgtagaattagtagaagccctaagcttgttttcctgcaattagatggtcccatctggggctgatgggagacagtgacagatcatcaggcattagattctcataaggagtgggcaacccagatccctcacatgcacagttcacaatagggttcatgctcctatgggactctgctgccgctggaactcaggcagtaatgtgagcaatgggcagcagctgtaaatacagatgaagctttgctggctcacccgctgctcacctcctgctgtgtggcccgcttcctaacaggccatggactggcactggtctgtggtccggaggttggcgatccctgctataggctgcctaccacagttagatattcattagtacattttttaatttggaaacttttttgacttctgtggagcaatcagtgtttagaaatgcatattaagatttctttctaaggctgggtgtggtgactaatgcctataattccaacactttgggaggccaggagttccagaccagcatggccaacatggtgaaaccccatctctactagaaaatacaaaaattagctcagtgtggtggcacgcgcctgtagtcccagctattcaggaggctgaggcatgagaatcgcttgaaccctggaggcagaggttgcagtaagctgagattgcgccactgcactacagcctggaatacagagcaagactctgtctcaaaaaaaaaaagggagcaaatccaaacggatccctgacattattaaaaagacttatttggaggaaaaaaagaggatttttttctaatctgatttttttctttttagcttcagctccataaaagaatagttttagccactatagtttaacatggaacacttcattgagaggactatagctaggttactaagtttctgagtatcaagagcagttaccccaccatatttctgaacaaagaactcgggaagctaaaccttttataacttggaaaggtccagtacttttccttttgttactaatttcagcaggtgccgcatgaaattcccatgtgcaatcataattaatgccaaagagagaggtatctgaggtcggcctgaattcacgattaagagacaaaaatattatttaattcagaaagttcctcaacataacaatagcatgtcttattttatcactgtattattaatcttctcaggctgccataacaaaaaacacagattaggaggcttgagcaatagacatgtatttcccacagttctggagcctgcaagtctgaggtcgaggtcccagcatggtctctttctggtgaggcctctcctctgggctgcagatggcccccttctccctgtgtccctacgtggtctttcctcagtgtgtggagagaggagcaagctctctggtgtctcttcttataagagcactaatcctattatattagggccccacccttctgacctcctttagcctaattacttccttagaggcctcatctccaaataaagccacactggggattagggcttctgcatttggacttgggggatgcaagcatttaatccatgataatcacctttaatttttgttaatctttgtgctttattttaaagataataaaatagtttctattcattaatatgaagtgctttattttgtatattaagtaccctatttatgtaatacatgtcacgggtgcacctagccggggtcagtgtcacaggcagtaaaggaatttaccaagacagttgcaggtaaagaaagccagatttattagagaaagtataaaaatatgttgcaagggtgcagcaggcagcacagcagagaaggggccgtctgccaagcggcagaggctggaaggaagttttatagggttgcgctggaggggcctatgtgctgaaaaaggtcactgtgcccggggttgtttgtgattggccatttctcagaatcactgttcattgttctctcccatctggggcccctttctcattgttgtttacttatcaggactccacaagacgtatcattttatctttacaagaactctgtggcataggtactgttatcatccccattctatagaggaggaatctgaggccaagtaaacctgtctgaggtcacacaggtgaggaactgttgatccctagactcaaacccagtttcagctaactctaaagcctgtgctgctcatcatctttttttttttttttttttctgagaccgagtcttgctctgttgcccaggctggagtacaatggcacgatctcagctcactgcaacctctgcttcccgggttcaagtgattgtcctgcctcggcctcctgaatagctgggattacaggtgcctgccaccacgcccggctaatttttgtatttttagtagagacagggtttcaccatgttggccaggttggtctcaaactcctgaccttgtgatccacccgcctcggcctcccaaagtgctgggattacaggtgtgagccactccacctggctgctgcttatcatcttaaagcatggcattaatgcgagtgaatttttcatatatctttcacatctcatttcaatcctaggatagctctgtgaagagagtgtttttacctacgggaaacagagattcacatgagttacgactcttcattctttcagtcatgtatttatattatattagggttctctagatggacagaactaataggatagatcgatatatataaagaggagttaaaagggagtttgttaaggagtattgacgcacacaatcccaaggtgaggtccgacaataggctgtctacaagctgaggagcaaggaagccagtctgagtcccaaagctgaagaacctggagtctaatgtttgagagcaggaagcatccagcgcaggagaaagatggaggctgagaggctaagccagtctagtcttttcacattcttctgcctgcttttattctgacagctgattagatggtgcccacgcagatagagggtgggtccgcctttcccagtccactgactcaaatgttaatctcctctggcaacaccctcacagacacattcaggaacaatactttgcatctttcaatccaatcaagttgacacttaatattaactatcacatatatgtaatggatgtttatgcatgccgatggcgtgccaggcaggtggcaccctgctgctcaggtggaaggcagtgcctggacactggcaccaggcagacccagatttgaatcctggctccatcaatccattcattcattcatttattcaacaaataccttttgggtgccatctctgttctgagcactgtgctggttgcaaaaccagctgtggggccccaggctggcagcccacttccccagtgtaaggagggcacagctctagacagatcttggtgaatgacaaacaccacctctcccttcacggaactcacagcccacttgcctgtcattccccacaccctcataaggtaaatcagagttttccatgtaggaatctgctcaaaaagagcatttcttcaatgtgattctagttctcttccacacagcttctctggcttacacccgtaccctgttttgtccagcatgtggctagagaggaggtacatttcagtcacttaaactttgtgtctttaattggtcttggaaacatatacagtactgatctgagatgacccctgtgtcagggatgatttaaatgaccccaagatggccgggtgctgtggcttatccctgtaatttcagcactttgggaggctgaggcgggcagatcacctgaggtcaggagttgaagaccagcctggccaacgtggcaaaaccccatctctattaaaaaatacaaaaattagccgggcgtagtggtgggcgcctgtaatcctagctactcgggaggctgaggcaggagaatcgcttgaacccgggaggcggaggttgcaatgagccaaggttgtgccactgtacttcagtctgggcaacagagctgtgtctcaaaaagaaaaaagaagtgaccccaagacggattctgtccagttactgcttgaagatttgccaaaaatagcctcacaaggccagatcacttgagtaaaatgtttctcaaaacatctgccaacattgaagacttttccaaatgtcatgatggcaattattgattgataaggtgacatgtctcatccactttgtccatcctggcttatgcctgtcatccaagtgaaatcattagtagcaccctctcccactctgaagcttgagtgataaattataattataggtcctctattcacttagcacttacaatcaattatacttacaatcaattataggtctcctatttacttagcacttaccacttgtgccagatattttaggtacatcatctctttgaatccttcttacagccttctaagatatatactattatttccccatttcatagatgaaggagacttcttcaccctttataaaaataataagcactgtggaatcccggggtaactggatatccgactctggggttctcgaagtcctgggaccagaaggttcttccaaggctgtgcctttcatctcttcagtgagaaattcgtgctgagaagggtgacgaaatttcctcaagggtgctcaatagatactagcaaaactcaaaagcaggtctttttttcttgcagcctgctggttttactctgcccacttaattctccaacgaataatgttctcccctttcccagcgccatccaaaagaacccggagcatacaaaccgggggacttcgggagtccaagccagctggaacccggtaatattgccagggaaggctgtccccaggccgcaggtagggagaagcagtctccagcttgtggaggggccggagagctttgcaccgagggcctgtccaatgctgttcaaagaccagcggtcgccgccggggggcagtaacttcatgtgtgtgctgcagtggagcttgctggttgacttacactttatttcaggcatcaaaggcaaagtgcactttcagaagggagaagtcatgccttgtgctgcagagaagctattattataaagataagtgtgtaattgaacctttcaagtggagagacacccctctccctccagcagaaactgtgcaggtgagaaagccgcttcctgagtggacctattccctgctgctgggagatgctgcccgctttgtttagaatacaaataggggaacgtgctcacctgaaggggagacttttgaaaggaatgaccctcctcctgaagatgactgaaattatcagcattattatgaaaagaatatgaaatatgaaaatatcagcataaagaaatacagagagagaactcagatgaaaacattttatttcagagataatgggaattttctgagctggcttcaggtattaggttactcagtagattaagaaggaaaagcttttgctggtaggcaggtcacccggatgattccagaattaccaccactctagtcaagtagtgacagtgttctgggctggagtcacgattctggggaatttgtacagcttccctcacatgcatcccaacctgtagatctcaggtggtctggtccgcaatcagtaaaactgctgtgcagcccctcaaaacagaccacccttcagaaaaattcactgtgttacagttcatgaactgcctggaaacacctgcaggtgtttggaaagtgattcagggttcatttgtattggtatctctttctagaatagctaaattcaagatgtatctttcaaactagacacagggtgaaatggggtgcgggtatagagcttgttggttgtgggggtgacttcctgcatttagtgaaaggggtggttatgcagaggcagcacagagcattctgtgttgcatttgtggcttggaatgaagtggacccagctggctgccttcggggctgtgcctgagattctgagcatcttcagctttgtgtctgtaaagaggtctagatggtggcttactaggatgctgtgagaattgcatgtagcatggtaacgtttgtgatcgtatcaaggacaggagatactcagaaaatatttatttagtctttatgaaggatcttgttttaatgtcaatgaatatgttgttaccagttttatattaggtcaatgtttaattttttgcttatttttctgtgcatctattttctttaggtgcaggttttgttgctgcttattaatcttagtaattttcatggctcagctgagagtgcagtgagtgtgaaggtgtctatacctacacatgtgatcactgttatctctgaatcctgaatgtggacagcattcaccttcttttttttttttttttttttgagacagagtctcactctgttgcccaggctggagtgcagtggcacgatctcggctcactgcaagctccgcctcccaggttcacgccattctcctgcctcagcctcccaagtagctgggactacaggcgcccaccaccacgcctggctaattttttgtatttttagtagagatggggtttcaccgtgttagccaagatgatctcgatctcctgacctcgtgatccgcccaccttggcctcccaaagtgctgggattacaggtgtgagccaccgtgcccagcctagcattcaccttctttatagatggacacccaccttagtttagagttgttcttgttaaactacatcaatgtacagcagtaaggagggttggtctggattcaaatcccagttctgccagtaaccagctgtgtgaccttgggcaagtaacttaacttctctgcacttaggtctcctggtttatcaagtgggattataaaagctcctacctcctggggttgtgttgtgaggatgaaaagacataatacaaatagagggcttacaataatatcaggctcatagtaagtatttagtatgagttagcaattttattaaaatgcagaaattacagtgtctacattgcttgcagctgcttaacctgttcctgggacagtgcctgccacatagtaggcacttaataaatatttgtgtatcagtggaagtaaaacatcatcatgaacaagaaaatattgttaagtccattaaataataagctttattttcccatgagtaacttaggcactttcagaagctgtgtgcattttttcaggccagggggtcctgcagcttaaaaattttgcagtggtgtgtgcctgcatgcatgtgtgtttgtgaacacacgtgcatgtgtgtatgaaatgaacagatttagatactgaatattcagaataccgcagcaccatatatgctatgccagcagactggcatggcttattaacacttataaatgcttagaaaaacctgtattaatttcactatagtatgttgagactttgctaaaaggatgttttaatgtgaaatgagctttgctacaaagttgcaaacaacttaagactctaaacacttttttgaaaataaatctcaacataatgaatatgaaagcctcatgaactataaagcataaaaatcattattattgaagaaagaaatcctaggcttcttagcacaacttaaaataaaaatattgcaattgagaaataaatgctaatgcttggtggtgaggtttttctcctgtctcctcgcctcctttcctttccctccctctctcctgatcttccccttcccctcctttctcccttctctctctggttcctagaatgccttttagaggaaaaacagaccttttcagaaatacattgtcatctgctaaatctccacctactgcaccagccagcctcagcaccctgctaggaggtggctggtcattctttgccgtatcttaccttaagagagcaaaatcaacttgtgatggttcctatctctgaatgctgccctggtttccattagaatatgctggggaagatgacctttcttaatgaaagtaggcagcaccctgctgtgcttttaattaaatgaactaacctttaaaaacgcgattcttagccctgcagcagcatgccacccagcagtctgtccccagtgatggttctgtgagccacctgtgtcatagggaggtaccaggggactgaagattggagtgaggggctttagcatagcgtgatctggactcttggttgttggggccagttctcgtgctttaggttcagggtaacttatcccttatctacccttctagccagagaacacaacacagccattacaagctgacttaagcaaaaagttacccaccagttgcaataggtctacacctattggtcatgctgcccatgaggctatttaatggcactggggagaaatgcatgaagagcatgactcatagtaagtaccgtttgctgatagtaggcaccaactatagattgtcacattcgttagatgatttttttatgaccaactatcactttgttaattacgcctcaaatcacagaggcgtaattaactatcaaagtaatagttggtatcccatcttctctcaacccttctttagggatagcctctgttgagtgtatgtataccctttcacacacatgtataaacatatgtggtgtgtttggaaagataaatacacttaaataggtaccatctgcatgtttacattacgtagtattagattgcatactatattttgctacttggctttttaacatgttgtggatatcttgtcagtagactcaatgtatttcttttttctgaaacagtctcactctgtcgcccaggctggagtgcagtggcgtgatctcggctcactgcaacctccacctcccgggttcaaatgattctcctgcctcagcctcctgagcaactgggattacagccacctgccaccacacccagctaatttaatgcacttcttttgatgactccctgatgattcatgattagaacataacacaactcaaccagctattcctattgattgtcatttaggttgttgccaggtttttttccctattataaataatgttgcaaatagcattctttgtttccttatgtaaatgtatttgtaagatacattgctagaagtggaatttctgagccaggaggtatggttactttacgttttaatagatactgtcagtttgctctgcaaactgtttatactgatgtattacccccagcatcgcatgagttcctctctgcccacattctcaccagtactggggattagaaatcattttgaatcattgccaggatctctgatagacgtaaaatagtatcatcttgtttgaatttgcttttccttaattaggaacaaagctgacccttccatatgcttattagtcagttgttgctttttttcctctataaactgattgtgtatatcttgcgctacttttctggtgagtttatcgtctgtacttaggaatatgtaagttatttgcttattaaggaaattagtaccttactgcacatattacagatattttctccagtttgccatttgattttatggtgtttttactccatagaattttgtattatttttatttgtagttcagatgcagaaattttgccttcctttctcctgaggttgtttcatacctaggccaagatgtataggagtaggttttcttctagaacttgtacatttttgttgttgatgtttgcttttaattcactggacattctggtatgaggagtgagttagatttctggttttctcgtttgcatgttacctgtgggatgttccaatgttgtttgctaagcagtgctctttctttgaagatttgaaataccacctaaatgatcaaatatgctcttctatcaggattcttctcttgatctttttgttcatttctaagccagtttcatactactgttttcatgactgtgatcttacattttagcctgatttaacaattaatacagtgaattgtcctattctttttttccagtatttgttttcctggctagtatcatttgctgcttcttctttgggaactctagaagtatactgttactttcaaactgtcctctactcccttacaagaatgaaaacgaaaatggaacatccaaacctgttaatattttgagtgagattgctttgggtttatagttacttagggagagttgacgtctttacatcctaggttcctgtggtgttattctacttatgtaagccatcttttctctactcagtacagggtggaagttttctttatatagaccctatctatttctttaatttgtatttatgttttagattcttcaatatgaacatttttatgtaaatttaagaaattatttaaaaatgggatttttaaattacacttatttttacctctatatagagaagattattgtttctgtgtattaattttgtaaccaaccacctgtgctaaagcctttgactatttctaatagttgattcttttgcattttctaggtataaaatcgtatcacctgcaaataatgatgatttttccatcttgtttataatacttcaaattgtatttcaacattatagaggcagcagatgggtattctcatcttatggaaacacgctagtctttcaccactgaccatagcttgggtgtggcaatatggtattttatctcaccttcaggtatcttgatgactttccctgttacagacctagttaccccaacagacacatctagctttctttcattacttttacataggctccaagctgacacacaattcttctttaaagaagcagcttcccgaacgttctgtgagccacatctccatctgcacactctcgatgctgccctgtggaggactccctagggtggtgggagtgtcctgtatccgcactgtccactgcagtaaccactggccacttgtggccactgagtgcttgaaatgtggtggacatgactgaggaactgaacttttaatttttttcattttaattaattttcatttaaattgtcatgttattgagcacttaaaatgtagctagtactaccgaggagtgtttacttttgctaattttcattgacatagccccatgtggctggtagctgcagaactgggctgcacgggttcctcgctcattcatggaagggtaagatatgaatgctagaaaggccctggtggccactcattgtgcccagagatgctgagattgggcccacatcacacagcaagttcatgacgaaactgagactgggagcccaggattcttactctctgtctcaagctggtgtcactgtccaaccccttctttactcctcccctcccatttcccttctgtaagttatcaccgaagtcccagtgtgtgcagaccaacgcacagcacagtgagcaggcccgagcctcgcagacaccttccctagtgtgggtccagccaagggctgtgcagttgttgagttttcagccgagctccttcactccacagtgcaaaggttctcgcaagataaaggcagggaggcaaagtcctcggccctttgtcgaggtggaaagcaccctgaggtactgtgttggtgttccaacatcatcaggaaatgcccatcccggttcgaatgtattttccagtgcttctaaaagaagactttctgcatcttctgcatggcagcgggggttgctcctgtccctgagacggctctaaaccttacgagaacccagcctgccgtggtcagggagtggagagaatatagaaagcagagccttcgagaaggccctcagctgaggctccagtgggcaaggaggctttctcggtcatgcaggagccacagccctgcttgcacttcgagttttttctactttagccaactctttctctctttccccagtgagggggttccctgcatcagtccctgggcccctgtgggtctcctcagccttccctcccagtcgttcattcaaaagaagcaggagggaaccacgctacagagactctcggctttttctggagggcaggaaggcctccgcttatactggaggtcacctgttggagcttagaggttaagaaggccgggcacttgagcttcttcctggcactgctgctccctggtagcatggacatgggtgcttcagtttgcccacttgtaggatggggctcataatagccacctcacagggctccggggatggggacgtgagtccacagacagaaagtgccgagagtccactctccacagatgtcagcactgatccacactaagatgtcttctctacctgcttcaagggcaggtgacctccaggaagggccccctctgctcctcggccagaatccttgaggcaggcttatctggggagcttggcctgcatctgcgtagatggactgtgtgggggacccccagactccccttttcacacgtatgtcccacccctgccggggggtggtcagcttgtctgacaccacaggtccccagctccttgaggcagcctgtccggcctgcccagtggcccccatcagagccatccaggcagcgtgtgagtgggtgttgggagcagtgcccttccagtggccggcgaaggcagtgtgcatgcctgaatctgctgccagttgagaagtcagctcctcaggtgggacaaggaccctggccttcctgggaacctgagcagattgcgcagtttccttttctcagcacggctcctgcactggcttacgtaacagcaacaacctgcagagcctgggctccggggctcattcccagacagtgaagtctatgatgaatagatgggtctgtacactcttagcagagagccagtaatttgctcaaaggtcaaacttagcttgattcagaacacaaaattactaggattctattctttctgcgggtgttgcttctgtatttttcatggtcaaggaaaagctgtgaagcactttcttagggcttaagagctaagggatttttcctccttttttgatgaccctcttttccagcatctcagcacacccccagatgggaagaggctatgatgaatttctcccaccatttatgccacacccactctgtgcccagttactagagcaagtggtttccaggtgtgtgtgtaaggaaatgctcttagtgcatttgttctgtgtcaggcactgttttccatagtgtttgtccagtgccaggtgctgctgtaagtatggcactgcctagaagtgtgaatgcatttcatcctcacataaaccctgtgaagcagatactatgactgtccccattttatggatggagtcactgaggcatctggaggtgaagtaacttgcccatgttgcacagctaagttggaggagggggcaaggtttgaacccaggccatcttattccagagttagcattcttaaccactacccatgctgcctgtccaccctggtcccccatttcgtttgccacccaggatccctgtgaggtatgcgcttgttacgattccattttacagtgaagacacggaggcctggcgagtttgtatgggggccagtgcctgcttgggattccgatgcaacacctgcaggtctgactcctaacactgatctctgctgtgcacctggcccattggtcattgttatttctgagcacctggactgtgccttattcagtgctcctcacattacgactgtcaaatgcaagtaactgacttaggggcctgaggctcccctaaatgggtaccttgccacccttcgttttgttgttgttgttgttcttgttttgagatggagtctccctctgttgccaggctggagtgcagtggcgcgatcttggctcaatgcaacctccgcctcctgggttcaagcgattctcctgtcccaacctctggagtaactgggagtacaggcatgtgctaccacacccagctaatgcttgtatttttagtagaggtggggtttcaccatgttggccaggatggtctcaatctcttgaccccgtgatccacccacttcggcctcccagagtgctgggattacaggcatgagccaccgcgcccggcccacccttcttttgtgaaacattctcatttttttcagctatgtccctgactacagattattacatatttccatgtgcttgtttactggttctgtttcctcctgtgaattgactgttcatatcctttgcccattcagctctcagattgtttattttacgcagatctgctttctaactcaagggtcacgacaggaactcctctaatataatccatcatcatgtaacatttttgtcccctttctgttttgcaacaactctgaaaataatgacttgcctatactgctaaataagagggtaagaatccatgccccacgcctccagccccagaataaaaaacaagtggaaactaacgatttttttcttacacgtattatagaatttctaagtctgtctggagcagtgggcacccaggcatagaccacttctttagactgagcacctgctctttgagggcagggactgtacctggttccattttccagatatttttccacttgtttatttcctaaacctttttcctactccggaaaccatgcatatcctttccccatgcatcagctggcccagcagccacagcctcagcccgacctcccaacaccttgaggtccagcttctcagtctctggcaggctggcacgtctgctatcagcaggcacaggtgttccgagccaggctgccccatgcccccttctgtgactaagagacaggccaagtgggtccatgcataagagctcttcagtaaatgcaaaaggtggcaggtgtgctagccttatttggcatcgtttcataatgttgtgaaagggtggcacttctgcctgtgtcatataagccaagtctttttcataaagatgtaatgatttgataattggtaatgatgtattgagaaggttggaggaggatgagccttgcatatggtgagaacagttgtgcctattctagcagctccaggcactctgtaacctgtggttgggtgagggctagtggtattatgttgaaacacatgaaattgccaatacttgaacatttttgatgaaaagtattggtgcttcactatagtgttcccctctgtgatcaggtttttcctgtaagactattttataatgagcttctccataactaaagcaagattgggaacatcataaaagatcctagtctatataaactcagggtcaaatgttattgtaatctagatgagaaggatttaactcatgtcagagcaaaggcaggcaaatagtaatttttaatactgcactgcattgacacataaccactgtcctcatgggtcttctgtactgaagccctcatgggtacccagagtccagctccccatcctctttccttcagttcccacatgcgcttagaagaaccagcactgtggtcctttaccatgtcctcctggtgctccaattaagtaaagccattgaggttttcctgtagttgtagattgatatctctgagttaatcacgagagaacatagacatcatataggaaaatctggccagaaacaagacagcctcagccaagaaatgttttttcttggaatcggaaaacacaagaaacagatgattgggttctgttcacgtttgaggggaacgtaaatcatcatgggtttattcataaatgattatcctcttatagactggagtcccggcgtagagtaaaggcaggcatgtagacggctccgggaagggggcctcagggaaggaggtcagggatttgtgagggtaaaaactgcccatgatattactttgccatctaatcctagtgctgggaaaatgggactttgctcccctctgcttgaactgtaatcacctcctgaccagtgtttatgttcagaagaacagcagcccagccctgatccttggggtttatcgaagctttttttagcccagtcagtcagaagacagtgccaaaagggtgtgggcgtgtggcggacgccattatcagggactcatgagagctgtgctgttccaggagtgtgtctgagcccagcatggcattgcacgcagaccagggcagagggtggccttgatgccaggtgcccaggtgggctgtgaggctgagcgctgcccgttcctttccagaatggaaattcagacactggagtgcacttgcgtagttttctcaggttttctggctccccatcatttttctttcgtctgtctaagcccaagcacagggagttttgataagacagatctgaaatgctggcagggtgcaagggaggggaacgcttctttatttcatttggtggcacctttccccccagctttcttaaggcatgactgacaaattgaactgcatgtatttgaggtgtgcatgtgatctgcagtggtggataccaagaaatgactgccacagtcaagttggggaacacgtcttgatggcactttttagagctgaaatcccggtcatgttgtagtttgctatgtgaccacctacattctaatttgggtggggcagggagaattggtgcatcgagatgatggccaggttccctggacctgtgtaaaataatggacatttacgtattagcgcaacatatggatccaccatgcgagaatctcagagtcctttatctagataaatttaatcatcgaattagaacccagtggcagtttaagagacttaatgtgagctctatttagtcttaaaatagttgcactcaaagctcagctttaattttcctccactttattctgatcctccagggtttctcatgtcccacaggatagaaggtgtccctagcgtggctggttggacccttcccatctgccaccgtgctgtttgaatacatcgtgttcccccccagggcccatgcttgccttctcctggagcagttttcacccagaaagccatggctcaccttggttaggtcttggctcctcactttgcaggaaactgtccctggctacctgaccccatcccctgctcttctgtcctcagcctactttgtttttttctctgtgcccctcccttatgtccagagggcacactgtgttgtactgattacagattgtccatcttttcctatcagaatgtggacagcatgtgggcaggggtttcattttgttcacggctacattatcagctcctagaactgtgcctggtatatagtaggtgcataaatacgtatttagcataagctgggcagtgttcagggagtgaggactggatcggggatctgtcttgattccatgccctccacgaggaaaataatttttgtgtgtcctgtcaggtttcttcttcagaacactacagaggcctcgctgtgcacggatcataagggcttttattccataagcaaacccttcttaggacctcccagatgaagacataaaatattgctgtgccccaggatttctagaccatccaaatcaagtattcagagcactccaatatacagctataattctgtagataaacttaatatttcaactatgacatagctgtgtgtatccatgagattccacgcttctcagatataggaagcctgtcttctagtcctcttgtaatctcatcctgaagccctgcactcaggggccatcaaggatctgacagatcagcctttctcagtccctggccccagcagggggaaatgctgtgtaaaaaaagcacagcatcctggaatgtcagacccagtaagggcaccaggtgctgagcaggtgctgggatgggaggaggatgaaaaaatatatgtcaggataatgtggagaaaacactcacttcaggagatgcagtgtagaaaggaaattcaggacagtttttttgcctgtaggtctccagttcttattaccttctagatcagagtaataaagttagtatcctatgaggtgtgctcattatatattcatttatgtattcatttgttcattcaacaaatatttattgaattgttctggcaatgtacctggacccaggggaaaacaaagcaatatctttgctctcgtggagtgcacattttcatgggagagacagatactatttttttagtttattagattgcgattgctgctggaattaagcacatgggggctgtggtaaacaataatgggaggtgctgatgggccctggagggccgctctgaggatatgatttttaaactcagctcagaagggggtggtctggacctctctggtaaggtccaggcagaggaaatggttggcacaagggcctctggcagacagactgtggtgtgctaacacaggaagccagtgtgaacagaaggtaatgatcaaagggaaatgggtattgaagaatattcagtagtcttctgcatcaatcagggttctccagggaaacagaaccaataggatagacatagcggtagatgtgtatatagatatataaagaaatttatcatgaggatgtggcttacataattatggaggctgagaagtcccacagtctgccatctgcaggctggagacttgagactggctagtccaaaggcctgagaaccacggcagctggtggtataaatcccagcccgagggtgggagaagatgagatgagctgtcccagctcaggcaggcgggcaggaaaagggggcagactccccccttttgttctcctgccttttgttctcttcaggcccccagcagattagatgatgcccacccacattgggaagggcagtctaccttgtagagtccaccaattcaaatgctgatctcatccagaaacacccgcacaggtacttccagagataatgctcagtctgcacacaccggggccagtttgacacacgcaattaaccaccacatcttctgaactgctctaaatcttctcttattttttcaacgatcatgtccttttccaggaaaattagcatcctttacctatatctccttcttaaaactttaattaccaatcctgtaaagatagtagtaagatcagagtttaaaaagccttccagttttagcactttgctatccacaaagctttttcacaactgaagcctaatgaaaagcagtgggagaccccatttaatggatctacaattaaatatgttcttcttgatcctttgtatgatccaaagtatgaatacaatctttattatgctttgatttttttctttactaaacttttaaaaattgtggtaaaatgcacataacttaaaatttaccatctttacatgtacagttcagaggtattaaatattaaatatattcacattgttgtgtagcacatctccagaacacttttcatcttgtacaactgaaactctgtatccgtcaaacatcaactccccattttctcttccctcagcccctggcaaccaccattctactttctgtgtctatgaatttgactactttaggtttctaagtatttgttttttcatgactggcttacctcacttagcataatgtcctgaaggttcatctatattgtacatgtttcaaaatttccttcctttttaaggttgaataatattctactgtatggatggactacattttgtttattcattttcccattgatctacactggggttgctgccatcttggctattttgaaggatgctgctgtggacatgattgagcatatctcgtcaggaccctgctttcaattcttttagatacatacacagaggtggaattgctggatcatgtggtaattctattttcaattttttgaggagctgccattccgttctgcacagtggctacaccattttacattttcatcaatagtgcacaacagttctgatttctctacctccttgccaactcttgttattttctgtttttgatactagccatcctaatggctatgaggtataatcaataaaaagctatacttttctaattgaagtataacatacatacagaaaaatacacaaatcaaaaccttgctgaaattttacaaaataaacacacccatatcaggtcaagaaatagaacaatgccagcacacctggaagcatccttcatgtccctccccagctattactcaccagtcaccaccatggcccaccaagttacccaccatgctgacctccatcaccatagaggagttttgcttgtctggaactttatataagtggaagcatgtttttcatcatttgtgtcttgtttcttttgttcaacattatgtttatgaaatgcttattgactacagcgttctccagagaaatagaaccaataggatgtatatgtatatagggaaaagtttgttttaagaaattggctcatacaattatagtgactggcaagtccaaaatctccagggtgggttgacaggctggagacccaggaatgaactgatgttacagttcaagtgtaaaggatttctgctgcagattccttctttcttggggtaggctagtctttttgttccgttaaggcctttaactgattggatgagctccctgccaatatactttactcagagttcactaatctaaatgttaatcgcatctcaaaacacctgcacagaaacatccagaataatgtttgtccatatatctggtatctgggcaccatggcccagccaagttcacacataaaattaaccattatacatgtcatagtagttcacttttattgttgtttctattctgtggtgtgaatatatcacatttccatttgacttttccagttgggagtattatgataatgctgcagtaacaatctcctacatgtattttaacatatatatattcacttttccttggttatagtacagtattcttttttatgactctggctttgttttactattattttcattttgtaattttatgtttatgttcatgaaagatataggctgatcacttttcttttttataatatttttctcaggtttcaggatcaaggttatgctaaaagcataaaataagtagaaagggcccctccttttgtttcctgtattgaagagttgatgtaggattcatattatttcttaagtgtttgggagatttcactgataaagatatctgggtgtagagttttcttttgagaatgtttttaattaaatattcagttttataaatagatatagaaccaattgattttctcttctgtcatttttgtaagttgtatttttctaggaagtagtccattttacttaaaatcttaaatatattggcataatatttatataggctttctaatatctgtaggacctgtagttatgtttcctttttcaatcctggtagtgacaatttgtgctcttttcttcatcagtcctgtcagaggtttattaaatgtattaatattttgaaaagtcaacatttgacttaatttctgtttttttgttttctgtttcagtgttttccactttttttcttctacttttttttttatttttttaaacggagtttcactcttgttgctcaggctggagtgcaatggtgcgatctcaactcactgcaacctctgtctcctgggttcaagcaattctcctgcctcagcctcccaagtagcttggaatacaggagcctgccaccatgcctggctaattttttgtatttttagtagagacagggtttcgccatgttggccaggctggtcatgaactcctgatcttaagtgatccacccatctcggcctcccaaagtgctggggttacaggtgtgagccactgcgcctgtccttttctccttctactttctttaatctcttgttctgttttcttgctttttaagatcaatatgtaaatcattaatttttagtcttcttatcccatatattcacataagactagaaatttacctctaagtatggcttttgctgcatcttacaagttttgatatgtcatatccttattattttccaattcaggatattttctgatttccagtataatttcttcattgatctgtagattgtttagaaatgtatcactttgttcataaacatttggggttttttttttaatgttattgattcctagagtaattccattatgtgatcagaaaacactctcagtcctttgacattttttcagacttgctttgtagctcaacagtaagtcggttttgataagtgtttcatgtgcacttgaaaaaatatgccttcttaacaacaacatatatagatgcagtcatgtaacaacaacgtatatagacagttgggttaagtttgttattcgtattgtttatgtcatctatggccttactgaatttcgtctattcttatcagtggctgagagaagtgtgttaaaatttcccaccatgatttggatttgctgatttctcctttttgtcctgctagcttttccttcatatagatttgaggctatattattggatatatacagatttaggattgttgtatcagcctggcaaattgacccttttttattattaaatgtccatcttttttgctagtaatgcttcttgtcttaaagtctattttgcatgatgtgccagctcttgtttggttagtatttttatagcacatttttccatccttctatttcctgtcatcttactgtttgttttctgtttgttctacttgttctatattccttttctttcttatcttcctttgaattatgttttttttttttttttttttttgagatggagtctcgctctgtcacccaggctggagtgcagtggcacaatctcggctcactgcaagctccgcctcctgggttcacaccattctcctgcctcagcctcccgagtagctgggactacaggtgcccgccaccatgcccggctaattttttgtgtttttagtggagacgggatttcaccgtgttagccaggatggtcttgatctcctgaccttgtgatccgcccacctcggcctccgaaagtgctgggattacaggtgtgagccactgcgcctggcctgaattatgtatttttaaaaattgtttcattttccccctctactaacttgcctgttagacattactgttcttttagtggttattctagatattacaaaatgcatccttgacttattttattaaggtctaatatgaatttaaaattaaagctgatatcttagcatgtgctgcttctgtagctaatgacattagcattattctaagaatgcttataaatgtgtttcttttttgtataacaaaatggcccttaaaggcctcttagagctgttaatgttataaataatcaccaaagtaagtgattattaccttaaatacattaaaagagtgaagttgaaatcttaatctttagaaattattcaacttttttgaaattctgttactaattctcctaaaaaaattttgttttaaacaagaatgatttataaattatttttcataataaactacactgtttgtggaaactgaacattgcccttggagcaggcagaagtaatatccattaaatgcatagcaaaacatgaccctcagataatttttgttttcagtttctaatgccacagatttacatgaagcgattaaggacgggtggttagtgtatatttaattttgttatttggattcaggatgctcttatgaatcctctggtgaaagtcagaaagcagaattatgggtacaggttgattttcaaaaagactttgtcaccaggcaagcaggtacacgcttctgcaatggtttgaggaaggtattatcttttcagtttttacctcctttggactgacgtcctctgtgtcctttgtagttttccccctggctgtccctaattacaccatctcatctagcaatttgatgaaaacctcaataggtgttactatcaacaggattatatttcacagtggaatgtaattttccactgcagtcagtgatggaagaagagtggtcagtaagagaaaaccttttttgcaagagggatgtatttgaggatttattcacaagaacgaactatcattatgaagttttatttttgcaaggtacaattttttttttaaccatggtgacatctgttttcttagatgtggtagaaacattcaaaaagagaaatactctggtgttggaaggcttatttttcatcatcattttgctttgaagttgtttggtgaatgcattctgaatgagacagtttggctatttctagcacaattgagtttctgatttccctttggattcttaatatcttttgagggccagggagggatattaatagagattacttgaaataagctgtgagatttttctgcgtctagaatacaggcaacaaattgttgcacgatgacagcagcaggctgtgattgttccaggctgtccttggccagtcctatcttcaggaatccaagtaggagcaggaacaaccattcccttattccattcaggaggaggctcaaagaaaagttgttccaagttaattgggagtaaacagaaactcatagttagactttatgattataatcaataacaaatatgtgtgtatgtgtgtgtaataataaattgtgtgtgtgtgtatgtgtgtgtgtgtgatataggagggtgtagttttttcagtggtcagccttcaggtctctgcagtggctgatatggtcatggggtctctaacttgtggttaactttgtcaactcatagcaattcaaagcaaaattgaggctatctctatcagtgtgctagggcagctctaacataataccacagattgggggcttaaacgacagaccttttttctctcacagttctggaggctggaagtccgagatcatggtgccggcagctttggctcctcctgaggcctctctccttggcttgtagacggctgccttctccctgtgtcctcacatggtcttccctctgtgcacgcacatgcctagtgtccctttatgtgtccacattctctcctcttacaaagacaccgatcagattagattggggccccaccctcatgacctcattttaacttaattgcctctttaaaggccctatctccagctgaggtgggtggatcacctgaggccaggcgtttgagaccagcctgaccaacatggtgaaaccctgtctctactaaaaatacaaaattagccaggcatggtggcacctaactgtaatcccagctacttgggaggctgaggaaggagaatcgctgaacccaggaggcagaggttgcagtgagctgagattgcaccactgcactctagcctgggcgacaagagtgaaactgtctcaaaaaaaaaaaaaaaaaaaggccctatcgccaactgtgtagtccagttctacggtactgatggttagggcttcaacacataaacttgtggggagtgaaggacatgaacatagttcagtccataatgctgttagagccagctgagctctctcagttatattcagagtgtctgcaggaatttattagccaacactgttgttcctaaaacaaccagcaagaggctctctctctctctctgacactctttagaatggcatcagcctccatctccacaccgcacagccaacccagcagccagtcctgggtgcctcttcagatgatgttctgggctcctctgctttttaccctccctctctcacccctgtctaaaccagtgtcctcccctgcctgtgttatcgcggaagcctccccattcttgcttccctcttgtcactctggagctctgcctctcaatggagcagccagtggtgttttgaaaacatgaatcaaacctggccactctcttgctctgagtcctctgagcacatttagcgcgggctccagatgcttgcctgggcatgtgaggacgtggcccgctctgccctctccagattcagctcctcctcgcgtctccaataccacagctgggctactctggccttgctgctactgctcccatgtgccaagtgtggtcccttcctcaaagcctggaattcccggaaggttcttcccccagatacccacatggcttactccctcactcctcccaggtcgctgcccagatgctccttcctcagaaatgtcttcccgagcccctagctaagcgagcgcaccattccccccaccccagaccatctgtcctcaaagtgtcttcatagcactggtcactccccaacatcagggtatataattgcctgttgtctgtgtttgctagaacgtcagcttcacgaaggcttttgtctcatttaccactaggtgcccagtaccttaggagcttggaagttcttagtacctaagaatagcacttgcttcatgaatatgtattaaattgataaatgacattctgtggctcaagtgagtccgtggtgtcaaaggttatgctgggcagactgcctttggtaatgagcatagacccctctttaggtccaaagcaacccccgggagaaacttgcatcttcccctacctcgtgcccagaatacaccttgccttggatgatgagttgagaagctacccacaagggtagatgactcgtctggcttgaaagagatcggccctgttggcattttgatagcaaatttagagttgggaggtcactaacaaggctagtccccaattctgcgacctaaatggagaggcagttgctttgcaagagtactgtagagcccgtgggagacacgcttctcagcctgccttttggtccacatgtaggccagccacttcctgggctgcctttttttcaaagatttttttcatgaataacggtattaaaactttcatgcaaagtgccctgatagtgtgtaatatttttagggcctgtaggcaatggaggctttacatttttagtgattttttttcctcatatacactggcattgaccctgggaatgatggctgtttttcttttaggcttgcttgactgccataaccagagacgtggagcaggggatttattctgtttcctcctcctccttcttcttcctcttattcctcatctttgatttgagggggcttttcaggtatgagggcagaggggcatgaataatacttcctcagactgaaagggtctttgggggcaacagcaattcatttttcagctctctgagatactcattttgttttgtttttgaatactccttaacttgtagtcttcctttctctacccagtctgagaactgcctaagcagaggcagtttggaccctacaaacagcgtcttgatttggctgggatgttggaatagggattggaccctagaaacagcatcttgatttggttgggacgttggaatagggatctttccattctaagaccttaaaaaaaaaagttattagagaagtgaaaacattttagttatttagactttccagtctagaaggcattttcagtggttttccctgtagagactaaggcatctctgagacaacggtgggtccatctccacaaggacttagaactcccgactcgtgacttctgggtggttctcctagtgcttgtctaaagaacatttttgagcttttggcctaaaactctcttcttccttctcacccctccttttccatagacctcccctgtgttgcctgcctgcctgtgctttgccttgatttacagcatccatgtgcatacgtaggtgcacgagacagccaggtgctagaaagtttgcaaggccaggagggatatcacagggtcctggatttgggtcccttcttcgtgcaagcaccagccagacacttgacctctctaggaaggattccttcatctatagagtggggcggagatcatggtgagccatgcacaaaggtgaggaactgtagagaaagcatccgggagccaagtcagcccttcacaggtgtctgtctgtgcaggcagtcaccacacccatctctccacccagcttcagctccaaggagcctgcctggcctgcttttgcaaacactgtctccagctgcttcgggttgcagcatctcattcctgaaacccggaggacgtgactggataatagccgggcaagtgagctgtggtgatattttaacacaggcctgatctgatcattcctcactcattcaaccctaggcaagcctggattcatactttccatggccacccgtgccagccagtttccatatcagccagggcctcaggaaggtggaaggacacactgtcattctttccatttgcgctgaccctgcctactatcaggcctgaatgccagcaggtttagctaaagaaagttgcaactgctgaccaggctgtgcaggccggcctctgtctctagcatacccgggggtagataagatggttcctgatgctctaaagctgggcttgacttcccaggaaagtaaatcaaacagggcctcttccattctcactgggaatccttggttgggctcttttttattttgaaccattgaaatatttgtgcagacacggtgggtctgaaagtaatgcactgtgacactttcccctctgttctctgacaccgggtgttagtgggagaatcagacggatagtaatttccctgtggattctcagcagccctaggagataggttagcagtggttatttctattttacagagtggaaaggcaattttaaagaaaaaaatattcttctgctcaaggtcacaactgcaaaccagtggcctggctcatggctctggacctgccaacctgtcgctctcctcttctgaggactgggttgtggctggtactgtgtttcagttttagaaaatgtaatttgaaggaaatgggagactggggtctattttgagactctcgaataattcattttactctattttctataaagcctaagagtgattcattagcaagcataagtaatgtctgagtgatgcaactgtactaggttaggttttgggacctggttgttgaattggtcatgaacatttgtcacatacatgcattgagtcatacattgctagagatggaaggcagcttagtaatcatttagtccagtgggtcccaaatctagctgtttatcagaatcacctatagagcttattaaaaattcagatgccctggtgctacccaaggcctggggtcaaagatctggaccctttatctttaacattgcatttttggggggtgggactctcgctgtgtcacccaggctggagtgcagtggcgcaatctcagctcactgcagcctctgcctaccaggcccaagtgatcttctcaccccagcctccagcctcccaagtagctgggactacaggcatgcaccaccgtacctggctaattttttgtatttttggtagaaactaggttttgccatgttgcccaggttggtctcatactcctgagctcaagtgatctgcccacctcagcctcccaaggtgctaggattacaggcatgagccaccgcgcccggccataacatcgcatttttaacaactcttccaagcagttcctaaacaactggcctaaaaacctttgagggaccccacatttgagaatcactggatgcaagtccttttttttgttggcttgtttttgtttgtctgtttgttgtatgtgttgttattcaggtgaggaaccaggggcccaaagggtagatgaccttgcctggagtcacacaaatctgtcactgttggagtcgggatgggaaacccagctacgctcttcccaggcatggtgtgaccacagcccaaccgagtggccaggaggacccactctgttgggcgctgtatttagagcaaccgagaccacttctggtaacacttggtaacatgccctgcactcttggaaaggcactcttgtcagggcgggtgtcttagagaacccacaaagttcaggagattcttccagagcccttagcaaagggccatctgcaaagcctctcttcctccctgggcaggtccattcccccagggcccagagtggggccaccaagaccagagcagacaccaggaattgaccctggtctggaactagtctgtctgttctgatctgccgccctgtgacaatcacctgcctgggaaccctgctcacagatgaccaggcccagtggagagatgataagaataggtagtttgttctgatgcagattcctaggggatctggctgatgctggctgatggctgcttacagcaggagacctcaagtttctcaatctaatgttcttagttctgcatcaaacagatgggtttattttctggatcctgtctattcacggaactcatttaatatggagggcgttatgatgtcctgcctcatctgctactcaagctatatatttgcaggtgaggggagaagaatcataaggtaagctctcagagatacgagggtcaaggagaatataagatcttacattccctaacgcacctcttgctcttttgtgtttttgcatgtggccttcatgctggttgtcctctggactgtgtgaccttggtgccctcagtttcctcatcttattggtccctgtacttctaatagtcagtgggctgacagtccacacccctctgcagggctccagacctggctgtctgactttccagcaggctgtcccctcggtcatgccgcagacttttcacactgtgtccgaagctgagccttgatctgttcctgaacttgctgcccctcttttgtcctctcccatccactccactgtttgtgctagaaagtggggagatattgttggcaccttccctctcactcctacatattagccaaaggttttatagatttcacacctaagcagtgatgtttcagcctgcttccactctcccgtgctcaggataactgccttggttcagtcactttcatgtaacactcctgcctggagtacgcagcagctcctacctggtattctgattcctctccggcactcttcagtggccctctagtgctccctgagtgatcttttgtttgtttgtttgtttgtttttgagacagggtctggctctgtcactcaggctggaatgcagtggcatgatcacagctcactgtagcctctaccacctggactcaagtgatcctcccacctcagcctcccaagtagctgggactacaggcgcacaccaccatgcctgaccaatttttgtatttttttgtagagacagggtttcaccatgttgcccaggctgatctcaaactcctgggctcaaaggatccacccacctccacctctcaaagtgctgggattataggcacgtgccaccatgactggcccaagcgatttttctaaaaacctatgtatgtcatcatctcactatcctgtttctagatactcttcagtacttatctgttgttcataaggtaatgttcaaaatccttactttgtgaataaggcctctcatttggaccctgttgtgtctcagctcttgcttctccctcactcagctcattagtgcagtggtgctcaactacctgaggttcccaggacacagggcaccgtaggatggaaactgcagttgcctccgcctgggatgccccagacctcttctccatggagctgacccctgccggccttctgatggccttttctcagtagagggtgactctgttcccaactaatctctgatgttctggaatgaagaaacaattttagtattgccagctcctagcacagtcattgccatgttatatgtgatcaatacatgtttgatgagtgaatgaatgagttagcagctcctttagaaaccaagtcctataattgaaccaaagacaaagtattatccattagctatctttggattttcttccacctgcttgtttgtgttataatattgatgtgattagcatagatttcttgctgagcggtgattagagtctcagtaaactccatccagtttaaactttgaaacattcacagacattgaccaaaatgttcagacttctccagtgctagtacattgttttcaacctcctgtgacttatttcttctaaagactacttgctggctgatttgcgttttatttttaatattcatcattcttcctgtgtgcacacaagacaatcaaagactgatttaaagtaaagggaaaaataccatcaagcctggaacgtgtcacagccacccaccccacacttgggtttgtgtccgagttggacagtgtccctggggctctttttctcttgtcctgggttcctctggaagctgtccagatccctgccgttggaggggccccaactcttattgccagaaaagaacagctcgggtagaggacacagcctccagagaggggtggtgcaggtacgaacctgcagagctctgtgacttgtttattgcacttatctgacaaaggtaatgcaaaaccctgtgcttttattgggaaatagaaggaggaacttgttggacaattatggaatcagagaatgatgtcactgggtggttccttagggatcatctaaggtaaactacattgttgagctgttgggtatgaataaaaattttccacaagctttcctgcatttcttcccctccagtcaccatattatagggcacagcagttttggagaattccacaggaccctggctcactcagagttaaggatcccatgcagtgtgatggaaggaacccagactctagtgctagacagacctaagttgggcctgtccaaattctttgagtttatttcctcatttgtaaaataatgcctacctcagggctgtcctgaggattaaatgacaccttttggggtcactagtggtcccttaacacaccgctgtctcgtctcttcttctgaggttcagctacaggagctcattttgcacgtgtcgttgctgttaatggaactgcgcttaggaagtccagtcaccaatcttcctatgttaaatgccttttgaaaaacactttcacctggcacggtggcacacacctgtaaccccagttgcttgggaggctgaggtgggcagattgtttgagcccgggaggttgaggctgcagtgagccatgatcgtaacactgcactccaacctgggtgacagagtgagagcttgtctctaaaaatatacatctaaatgaaataaaaaacactttaactttgcataagcttctttctcacccctagtcatcaattctccgggctgtaggtttgacctcctttcagtgggctcgccttgagaataagaccgtctcagccatagtgcttggcatacgctagaagctcagtaagtaggagaggcaagagggaaggaggaagagaaggaggaaaggagggaagtgggaaatgctgctactagcaaatgagcatagccgctccagatggggagaaggtgaactgtgtttgtgctcccatggagccctgtgatgcacactgtgcaggctcggatcctgaagaaaggccaggtagctgtgcagacagaggctcctgaccacatcctctgagaaaccccaggaccagatgtggtagagagtgacccacgggtgctgttcgcaaacatttgatgtagatgaactagttttagcagatgccctcacattttgcagttgtgagtttcctcccatttcttcttgattcccatctgcccgtgcagttctgcctccatcagccatgcgttgacatttaggtgattaacacttgatgccgtaaccattgtccatgttttattcataatttgacgctaaaacctgaaaagttgtcagtacggtttatgctaatacagctataaaaatgttcttcgatgccagctaagcagctggtgaggattacgttccttctgagtaggtctagcttctgacgcgggaggcacccgaggagaacgtgctcagccgcggaagcagacagacactccgtgtttacactcaaacaactgctgaaaatcatttcatgtcacgttttacttcatatttggatctgactttcttgaatggcatttttatttttcttagagtttgtattatctttttttgacgcattgtgtgctttatcagatcctcaagttcttgtatcttctcagttatgacaaacattctattattcacgtttcctattctggactggcttttcccaggacctgaggctgatctaccttctgggggctcttcttcgctctgtccctaagttgggtctagtgcatcctaaatctcatgtctttctcctttatggtttatgccatcattttgctggactacatttatattttctcccctagaaaagagaatgaaaagtcagttgtctgatttcttgaaaatatacgtagtatctcaccctcacgcttgattgatagcttatctgcaggtagacttctccagtggacattgtttctcagaacttctaggaaagctcattggcttatagtgtccaatttagctgatgcaaagactgatgtcagtccaacttccactcccttgcaaatgactgattttttgtctctcttgaaacatccttctttgtcttggatattctgaaatgctttgtggatgtgtcttcacatgggtctgtattcatagtaggcttcatttggtgagtcccttccattggaaaattcatcttctttagaacctgaggatttttgtagcgttccttaagctctgccctttgatttctgttctttctgggcctcctagtaatgctgggcctcctaaataggaactctgtatgtcttatattttcctcctttatatgttttcatgacacgtataattttgacggttttctaattagaaaagcaatgtatattgtaacagcgacaacaaaaattacaagtaggcatgattataaaatgaagcaaggccttggaggaggcaggaagatgcagaattgagggaacaaaagatggcattatctttgggaggaagaggaatgctccttattgacataccagagaaaggaccaagaaagagtccagatgcaggaacatgttgtagcacacaggggagcagtgaactcgagtcacttggccttgctagttttataaagtggaagttgaggtcacctacttagactgaagacttggggtcataagaaggtgtgaaacatgtacagaggaaaaaagtggtgactggcagtttgacccagagccttgaagacctatctgcatttgtagtgggaccagttggcctggttttgtaatgttcgattattggaacctatgagcaggagcagggttgaaatttggcaaggcaagcatggtaacaggacattgatgagggaactcagtgaaggcaaaatatttccatcagtgatggttaatacaaaagattagctaaataatcctttttccatgtttgtgacttagtctgtctgtgtctccctgccccattcaccattaccatgccaaaatgtgtcccaagaagaaccgagaaaaaaaggatgttgggaacttttggtcccagaatggtctctgctaaaaatctatccatttacatcaagtcagttttcaaaaagcatcctttgatcactgttgtaaaaccaacatttcacccaagagaataatttcatcttgcatgcagaatttttagctgacatttgcttggatctaggaggagagtccagataagccaaggatatggtttggctctgtgtccccatccaaatctcatgttgaattgtaatccccagtgttgggcctggtgggaggtgactggatcatgggggtagattccccccttgctattcttgtgataatgagttcttttgagatctggttgtttaagagtgtatagcatctcccctttcactgtctctctcctgctgtcatgtgaagacatgcttgcttctcttttgcccttctgccatgattatacatttcctgagacctttccagccatgcttcctgtacagcctgtggaaccgtgagtccattcaacctcttttcttcataaattacccagtcttgggtagttctttgtagcagtgtgagaccggactaatacagccaaattcaccctttttcatggactttagaatgttgagactggaagaaaccttagagatggtcaagctcagtggttttgaaacagtttcattttattttgttgttgttgttctgaatgtcagatctttataagtgaattctttcactgaactccaacacataaaacagcaaagtggagcagcccctcatgaagtaggggtccaccctggggccccctgattagctcctagtcaccccctgtgccacctccaccagccccaggatgtcccttattttacagttaatggaactgagccagaaagagggcacatggtgtcggagctacaggcgcctccagtattctgtgatcttctgcctgccactggagaagcagtgggtccgggacccaaaaggcatgtggatgagtccagccctcggacaacctagtcctcattgggcagagggagccatctcctggaatttttaattcgaggactttttaccttgacctcttgcgaaatccctgggccatagtgggttaactgtttgtattctggtcccactgattttctgtgtttgcttcagagaaggtgaaggtgaattctgcagattttccatcctaccgtctttggaacaactgggtactgtgtctccttaatgataaaagggagctcttcttgaaataggatgatcattttccacagtttcttggtaaaccaattacactagtggtgattaaattaggtctttgataggcatgcaagtaaaagcatttgttgtaatttacaacaataagtaaattgtctaaatggttttaatatcattaaaaatttttatctggcaggcacagtggctcacacctgtaatcccagcactttgggaggccgaggcgagagggttgcttgagcccaggagttcgagaccagcctgagcaacatgctgaaaccccatattcacaaaaaattagccaggcatggtggcacacacctgtagtcccagctactcaggaggctgaggtgggaggatcacccgagcctgggaagtaacactacagtgagccatgtttgtaccactgcaccccagctggggcaacagagtgagaccctgtctcaaaaaaaattttatctgtattctgtgtacagttctaatttaaaacaaactgattgacactgttagggaaatttgctctctttaattaaaaatacattaatattttaacacaatacttctgttgaagaggtagatacaagtttaaattttgtaaaatgtatttaattgattttaagtggtaactttttttcaggataattttgcaagtatgtcagaaaactaaataatgtgacaaatttaaacatgttacatttattttatttatgtatttatttatttttggagatggagtttcgctcttgttgcccaggctggagtgcaatggtacgatctcggctcaccacaacctccgcctcccgggttcaagtgattctcctgcctcagcctctcgagtagctgggattataggcatgcatcaccatgcccggctaattttgtatttttagtagagatgaggtttctccatgttggtcaggctggtctcgaactcccgacttcaggtgatctgcctgcctcggcctcccaaagtgctgggattacagggttgagccaccacacctggccacatgtttcatttgtttataaaggaactcccctctaagaacagatcctttttactcttcttcatcatggttaatttttgtgaatttttgttaaagtttgcaacttgcttgagtcaatgattggggaaagaattttttaaaaaatatattttatcctaagtcatgtaaatttctataaaaaaaggatattctagcactgtgctaaaagcagtttgtagctcttttaaattgtatttggagcaagttcacttgagaaaattagatgtggattctggtcacattctatttttggtttatcgtagtgttactgggttgattgtgcacttcatgtatcatattttggttttgagtgttccaaaaaaaaaaaaaaaagagtccactatcatcacaagacagagatgtatcagcagaaaaaagtgttctagatgaaggcaaaaagagttttgagccactcagcatggatatgtggaaaacatgctccacgtgtttcagtggtagaccactaattcaagacgtcagtcatgctgctttataatcttaactcatattgcctaagaggttgtcatttacatcctgttcttaggatgttttttccatatttaccagacctcttacaccactggtaagtaacgaaagctatatgcagaagcaaatcactctagtctttttgagaatccttgtgcttaaaaagctccttctttcttttttcttaattattattcccttacttgtctagttctcttattttctccagatcatattttacctataacagtttttaacctctacatctttagaaaggaaaggccctttttcactatctagaattttctagactggatggtttttaaaaaaaatctctacagttactacacttattgaacactgcatttatatagggatttagggtccttcagctaccccagggagcttgggcctgggccctcccgtctgtccttcaactttagtctgtagttgggctgtgccaccagcttccagaagaagccatgggcaggcccaccactaccttcacctcccttcctccagcccctttgcctctaccaaaccccacccgaagccccttgagtggatcttgtgagccctgtggtctctgcattcaaagactggatccgggaaggaattaatcagtgtccctgggcaaagtcttgaattctttattgtttgagattatgacatgagattatttcctcatctgtaaaatgtaaataacacctacctcagagccaagataagaaatttaagatgatatatataaacacctagcacagttgctggcacacaggatgtgcttaaattgtgagtcgctttttccttccttttccttccttttctctccagttgttcctcccctgtatcccatcaggcactccatcctgaaagctctgccacagtgatttctccaccttagcctctggcagtgactccagggtaggcaggtggaggaaggacaggccctgcctttctgtctgagctcatagatgctatcataagtgggtttctaatctaggatatggtaacacataaaacatcaccatggaagaaaggtgcgtttgttagtatttgtattaaattattttgagataaaagaaaaaagctcttatttgaggcccagtcttttaggatttatggtgattcctatatagcaattcttccaacttcaaaaataagctatagtctaaaaaaattctctctctgcacttgctgtttagtgctggaaggcattttccacagagacaatactgtattctcaagcccacagaaacctatgcaacctatagtgtgactaaataatactgctcagaggctactctaaaatttacacactaagtgatatggtttggctctttgtccccactcaaatctcctattgaattgtactcccataattcccacatgttgtgggagggacctggtgggagatcatttgaatcctgggggcggtgtcccccatgcttttctcatggtagtgaataagtctcacaagatctgatgggtttatcagaggtttcacttttgtttcttcctcattttcctttgccgccgccatgtaagaagcaccttttgtctctcaccatgattctgaggcctccccagccatgtggaactgtaagtccaattaaacttctttttcttcccagtcttgggtatatctttatcagcaacgtgaaaacagactaatacactaagaaagatcttgcagaaaggaagacattgaagaaaaaagggatgaaatgaaatcagacttgaaatggctctgggccttctcagagctactggaaagcaggcccaagtgcacgctgcctgctggttctgccccagcaattcatgagtatgattcctcagagaagcaaggctcctttcttcttaaagacctccttcacgtatgattagcatgcaattcctccagtggatgtaaggagagccctctaagagctcattctgctgtaaacacagggaaccaaggtggcacaaacacaccgtgactccgggcatcgctgccatctcgccaacaaacacactttctagactcaaagttacaagctcacttcattgtgaagttggaaaaccaaattctcaaagttaactgaaaagttaaaaaaacatttgaggtcaagctcttgccagctcatctaattatatatagcaaggtcctgtgttggatttgtgggaggcaggggggagatttgcatcaaaggtagagcacttttagttcctttttctaacatgagcacaaaaaagtgtctagatttcaaggctgaattccgattgtaggggctgatgaggtcagtggaagtggccccaggcagctgcagtgctgaatgaagcagaggtcagctttcaatgtgcacttcgggcttccttctaaagggaccatggcatgctatgaaagctggggcagaggtcccaagcaggaggctcacatcctggtggaagctgtcttaagagtattgccatacagatccgccaacaccctcactgctcccagagccgagccccttctgtgcgcttagctatcagatggaatttggtccttactttgacattgaccaaccaaatgcagaaggaacatagggaaatatctatttcactccagttatcttctgtccatgtagcagaatgaactctggaagataagtggcaaaagcaagcctcgtggctccaaccccattttcctcttatgttgcgatttccttgcatcaacagcagcgacaagtgggaaattccagtggcgcccgtgctgctagggacttcttaggtgtaggtagaaccttggcaccttcccagtcagtaactagaccgaagttctgaatttgaaaatagatttcagattagcatgagtggtgaaatattttttttctaacagaagtatgcctcttagagcttgtgttctcaactttcgaagtattcaggagtttctttcttttttttttttttttgagatggagtctcactctgtcttccaggctggggtgcagtggcttgatctcggctcactgcaacctccgcctcctgggttcaagcaattctcctgcccctttcccttaggccagaaatatttccacttctgctgcagtgttgtgtagtacattccagagtctcccgagtagctgggactacaggcatgtgccccccacgctcggctaattttttgtatttttaatagagatagggtttcaccatgttagcctggatggtctcgattctcctgacctcctgatcctcccgccttggcctcccaaagtgctgggattacaggcgtgagccaccgcgcccagcctcgggggtttctttttagtggaaattacttgtacctttcttactttgaagcattttgtttgtgtctacacaaattttgaaattttacatagaaccacagcaggatttagggggtggggaggtgggaggcaaagcagtaccattgatcaagtttgttagtttaaagctggtgtagtttggatgtttgtcccctccaaatgtcatgttcaaatgtgatccccagtgttgcagggaggcctggtgggagatgtttgggtcaagggggtagatccctcatgaacggctgggtgctgttcttgcagtagtgagttgagttcttactctatgagttcacagaagagctggttggttaaaggagcctggcacctcctcctctctcgctctttctcttgccatgtgacacgcctgctcccccttcaccttccaccatgagtagaagcttcctgaggccacaccagaagccgagcagagctggtgcgtgcttgtacagcctgcagaaccatgagctaagtaaacctcttttctttatacattacacagtctcaggtattccctgagagcaacacagcagggaccaacacaaaaaccatcaggtcagagaacagtgaagtgagtttgcttggtgtgcttctgacccctcctctgcccctttttttcaggtaaggcctgggtcttcaggtgaggcctggtcccactctccattctttgtccattccagtgagggactccagggagctgagaatcctaaatttgaatgtggccttccaggtcactgtgaccacatttgttttcaaggaaggaaaatggaacatattttatttacagtttgttgccatgaagtgtaactttcagccatgtggactcagggaatgttagtggccatttgttcaggaagggtaacctgccacagaccctagtcctggaatattgagtgggtctggggttcgcacagaatttggagaccctggattaggagaagactctgggagtcatttgcccagaagcaatccactctggggctggactgcccagccacatgccacatggttgcccggcctctacctactcgcaggaaaaggcagcttcctctgtccctagacagcccatttcatctttatgcagctctgaaatagtgcccctttcccttaggccagaaatatctccacttctgctgtactgttgtgtagtacattccagagacgtagcaggttcagcaggtgacggaaagtgttcctgcgtgaacgtagtctccagccccgacacctggtagatggttcacacgaacacacacacattggggagcaaaacccaggtgtgagctccgcccttgcagagcttcaggcaaatgtgtatacatggtcgctggggaagagatactgtgaagtgtattatatcacaaggtataccagctctttgtgctagttatgtaagccacacattttgccgagcacacatagaaggaggctcattgaattcacctaatactgcattttaaaatgacaaaaaatgaatgtgttggtcaggaaagagttctggggctatgtagtggcaccatttcttgtgtaggccatgttttcccatctgttgaacagtttgttcaatacatatacacacacactcatataagtggttattaaagaagcatcttcctcagttatggctgtactcctgtgtaatacagctgtttcagctgcagcgccctcaccttcccaaccagcgtgtcagtggagcagtagcccccatttgagggcacgggataggataggtgacattgccacagagtgtgagctggagcaggctgccctctgtgcactgccaagccctgaaagcccagcaggaatgtgatgtctttagttagcacttctcaaactatctaccagggaaacctggtttttgtttaaatttccaacctgttgccaacggataaacataatatgataaaagtgaattactagaagaatgaagtggaacaaaaagagacatggaatacaagccttagctttttcttttctttttcagacaaggtctcactctgttgcccaggctagattgcagtgacaccatcacggctcacttgttgactttgacttcctgggctcaagcaatcttccccagtagctgggcacaggtgcatgccaccatgcctgactggttttgtttgtttgtttgtttaattttggtagagatggggtctcacttgttgcccaggctggtctttaactcctgggcccaagcaatcctactgtcttggcctcccgaagcactgggattccaggtgtgagccaccacacccggtcagctttttcttattagttccaacagtcatacaagttttctgataaatttaaaggttttaaaggctaattctctttttctggttttccctcatgacatgttggcccctccccactgatcacatattgggtagcactatcttagatgacaagcagaggtcaagcccaggattttaaaatataaatatgtatatttatagttatgaggcttttataaacttcatagaaaaataattaatgaatattgtatccaacttacattacttcagctttactttaaattttttccagtgatcacaacccacatttcatgtggttgtgactctccgctgtgttgctattccactcttattcactggcctggccctccttgctaccctggctgtctgtccctgcctccctgttctctcctttccccagtctcctttcacatcaggctctgggcggcccagggcagtcttcccccaaatcgcagcctggctgcattccttccttctggcagtctcacagttcttatgggacagtgtccgggttcctccaccaatggatctggcccctgcctgcctctccagcttcatttcttattcatttcctgccctgtgatccccccgcctgatatggtttgctgtgtccccacccgaaatctcatcttgaattgtaatccccataatgcccacatgtcaagggtggggaccaggtggaggtggtcagatcgtggggacggtttcccccatgctgttcttgtgatagtgagtctcctgagatctgatggttttataaagtgtctggcatttcccctgctggcactcattctctcttctttcaccctgtgaagggtgccttccaccatgattgtaaggttcctgaggcctccccagccatgcggaactgtgagttgattaaacctcttcctttataaactacccaatgtcgggtagttctttttttcttttttgggacagagtctcactctgtcgcccacgctagagtgcagtggcactatctcggctcactgcaacctccgcctccctagttcaagtgattcttcagcctcagcctcctgagtagctgtgattataggcacctgccaccatgcctgcctctctctctctctctctctctctctatatatatatatatatatatatatttttttttttttttttggtatttttagtagagatgggtttcaccatgttggccaggctggtctggaactcctgacatcaagtgatccacctgcctcagcctcccaaagtgctgggattacagacatgagccaccgtgcctggccattgggcagttctctatagcagtgtgagaatggactaatacactgccctaccccatggacttcagccatgctaagttcaatgcagttctggaagccttttcatgcttccctgcccttggtgctgataaaccagcactctgctgagtgaacggtagctgtttcttcatttccccacatgttttttctgtcataaacagcagacttaaacatctttatacaacttatcttttttaatgtaggaataatttccccaaatggaattaccaactctcaagactacggaccctttataaatatgattgcattttgtcaaatggttttccagaaaggttggattacttttcagtgtccacatcaataaaccctaaattttaactcaaaaatattctgtcagattggccccaagttgagttttatgctagattttactgtgtattctcaggtttctggtggctaaagtgagagaactggctttctgctttagatgttagttctaacaagttggggtctttgtctccccatgttcctttaccctgaaaacagcggacaccacaatcaatactgatggcaatggtgtgcgtgtggaggtaaggggaagttaaaaggtttgtttatggaagagtccctgttctgtgtgtcaaacaaaggtggaaatgaagaggaacaaaataggcaacttaataagataagctgatggcgtgctggtggcagcaggttgccatggatgcaacatgaataggatctctgattatcgtagataagaatatcctactgtgcgttattataatatcactgggtaccatgagcattttacacctatctcattgaatcttcatcaccactgcacaagctaggtaccatgttattattattgtattttatggatgagaaaactaaagtacatggagatcaaataacttaccaaaggtggcgagggctgagcgaatctgggatttgatcctgggtagcccagagccctgataccaccgttgacaatggagaatttaacttttgcatttgcctgagttgatgtgaaagtgtccttttgaaagtattctagactttcaaagtctaggataagtttcaggtgagtgagagcaccttgggaagagggactgaggtggcaccacccatgtcgcctctgctctcccacatcactccttggggaccctctgtgcatgctccccttgcccacagcatttgtcacctggctttattcatatgccaccatggaaatacgctttcctgggaatgcctggcacatggtaggcatctaatcagtgatgaccaaatggagcagaatattcggggaagtcatggaatatagagtgtttgattttccaggagcgtaagaatgtaccaaaagatgtcactgcagagtaaatcggtgctccatgaagtctttattgacttctggccaaaacgtagccttaagaaattgcccctgaaggaaatggagcaagatgattgttttatatgccttcataatggaattcatggagcattcagtcagattttcttgaagtgcttgttcagtatgacctcacagaaagtatggggcagatctgggagtgccccactctggttaatgcagtcacatggaaggaaatgtaattgagtgtggcaccagtgcactgcagtgataaatgaccagggattttctgggtagtctccgaatgagaagggataggatctcgagccttttaaggaaccaaatccctcaatcctgtgtgcctatagaaaattgcagtgggcaggagcagcccagcgtgctccagctgtcctcagctgtgggaccaccgtggccctgaacgtcgggccaatattgacggaatattcttgagttaaaattcaggtcttgagttagaattcagtatcaaaagcattgacactgtgcatggattcatgtttagcttctctttttttcataaacagtttactgaggtagctaacttctttataaaattatccagaaagaggtcaacactttccagaaagtgctagttcttgcagttctgctttcaagtatttcagaccagccaagcaaaactagctccagcatttttaactcttggagaaagatttcactatttcaaatgtatttttgtttaggtagagagcattagaataatatctaaaataagttggatattgtaggtgaatcacagttcctgacatcaaaaatagtcaaaccatagcttacaaatacacttttgggatcattttcccttgtactaaaaataaagttttaaagtaaccacttgcccaaaaaaaagtttctcctgctggagaaagttgcatagcttgggaacttttatcccgtatttactctgatcatgatgtcaacacagcactagtttgtgaattagtccattctcatgctgctataaagaactaccctagagagggtaatttataaaggaaagaggtttaattgactcacagtctgcattgctggggaggcctcaggaaacttacaatcatggaggaaggcaaaggagaagcaggcaaccttcttcacagggcggcaggatggagtgagtgcaagcaggggaaatgataggcacttataaaatcatcggatcccctgaaactcactcattatcaccagaacaggatgagggaaaccacccccatgatccaattacctccacctggtcccacccttgacatgtggggattatggagattacaattcatggtgagatttgggtggggacacagagccaaatcacatcagtttgtaagagtatagtcagaatggctttatagtcagaatggccttactggacattgctctcttttgtttctttatttgaccactaattttccatttagcttcccccaggctcttactgtacttcctgcacaaatgtatcattcttctgatgtctttgtgaaatcatgtcaatatttccaatttttcacacatgattttctttttgtcatcacttcaaccaaattttcttctggtgctaattattaagtattaaaattattaaagaattgagaaatggtttccgttataaagccctgtcttcatcatttagaactttacaacaatcctcttttgtaaagttttccaggaaatggatgtcccacaaaaatcaacaatcttaaaataagtatcagtatgggcactattgtttgcctctgttctttctccttgatttttattcttattctttgttacttctttgttctaagcgtaaaagatggaaaaatgataaagtaagatcctgctttcaaattcttagggaagtctaggttgctttgcttatgtggagcagttcacagaaggaactttagaattagccacctgtccgaagcttttagcccctcccagtgtggacttctttccctgggactttcatgggctgcctgcatctatcctagaatgtgcctgtaccggcaaccccgtcagactaaaccaggcttgttacagtcatgatttgtgcatcctcttttgctcgcttaggcaaattctggatttgtgttagagtggtcagaaatgccaagaacctgacttcttagattaaaagacaaaattgttggggggagaaaggttttttaatggtctgaacattttctcagttcagagcctgagatctgcatgagctcaccattgctctcgttaagtaatgttcactggctcaccgtggaaacttgaaggcatgtcagtgtacctgaaccgtgcctttttcaggactaactcaaagaccttcaggaagaaatatttgggtacagccatccgggaccacagaatcacagggcaggaatgtgaatgttgatgctggcgattgtgagctgcctgaccttaggcaagtagtctcaattcaccaagcctcctttcttcaaaggtaaggatagttaacaccttccctatatcctctccaggttttagagaaacttgaaagagttaatacatgtgaaatgaccttgtaaactgcaaagtgtaggttgactgtgacagaattattatcagtcagaacctgcataataaactggaaaatgtgagctatgttccaaagaacatcaggaccctctgtgggacccagttccggatactttggctgactcaatccaccgaaacaaagggttatttcagagcatggcatttaaattgttaggcttattagaccattaccagcagggcatttgtataccttacaaatgagttctttatcttcttccttgcctacgaaagttaaagaagtgctgtggtggccgcctacgtaattggattcattgtggagctctacttgaagttgcactcatctgaactcattcttgaacatataagccactgcccagaacaaacagggctcttcttacagaaagactcctgcgctgtgaatcagtcacagattgtattaaacttcccaacactactcaatttgtcaggcaagttttgttttattttttccctaatcctggccttattccaaattttccaactattcctggaataagtagactacatccatccatctttgcattctctcaatttccagtggccctagtgggaatttcatgtagctagactgacagcaatttgtattttgttaaattatgattaattggaaacctgtttttagcatttaggtggaatgtttcttgtagtattccattagcatagatattaatacacttgagtgctaatacctctgccttgctttcccacactttgttcacttatataagctgaatgagattatccatgattgtgttctttccggtcacatccttttggattccctgaattccattggagcattggagcccagggagcctttaccgttgattttgcgacagacagggcgagatccaggagatgaaatgttctccccagtgcaactcagtttgttactggaaaagcgagagctagaaaccaggacttcagactcctagaaccagtgtccttttgaagatgccgtggttccttgaaaaaccagagtaaaactctacaattcaaaatctttaggaaatacgttaagttgtttgagatggccagattttctgtagagctgaagggtatatagcctcttggttgttagaaatgtgatgtttaaccatttgaggaatcagtgtctaaaatggacagtccaaccctgccttcttaaacaatgatgaacgttttcttcttgatcatttcctttcctgatgattcttagcctttcttgatcattccagctcatcagtcatctcaattctcagtcacggtggaggtggagttgggtgtcagcttaaacaggtctgaacctgaggcctgctttcctagaggaagtcctggcctggcaaacctttccatctctgactgtctcatggagttctttgtcagagtgttggtgcagggctcctgcaccgggtagcagggcaccccagctgcagagtggtttggtgatgggaacctgaaacagccttctccctcggagttcgagagggagaatctcttttatggaatagccaaatgtcttgtgaatggtcggcagcatgaaaagcattatccttttctatcagtaacgcacaagcacctcctcaacagcttgaacttgtcaacatagttcatcacaggcttgatggattattcttcactattttaagaatttgtgttaggctgggtacaatttcattgtcactttacctcaaattctgattccaggtcggacatccaagagaattaagcacaacatgtagccttagttcctcacctataaaaaagtgatagtacctgtctcctagagtggcttgagggttacatgagagagtgagtgttgactgcttacatccatacctgataggtgactggcagtcaatttcggatcgctgctatttctcatcatcttcatcatcgccatcttcatcactagtggctgttaaatctatcagcatcatctttttttgtgaaagatggccaccacctttctcatctttcaagtatgttaaatgagaaagttgtgttgatgtttactattttaaaaaattgtctcaaattttaaaaagccaccacgtgttacttgctaatgtaactgaatctgtcactcattttagcatcttccccaggcttggcaaaggcacactgtgatagttaaaggtgcctgctgggatctcagggtgttgggttggactgtctttctagccttccctttgactcattccccgacttgagcaatcacgtgacctgcaccagccttccatagatggaacagaaacatgtgggctgccacctgcacacctcagtggggcgttgtgggaattatgagttagtgtttctgacataggtggctggagtgagctatccaagtgtgaggtgtccatgtggcttatctagccgaatggacattacctttaccaggggctctggtgtggtcttcacagcttttttaaatttaatttaattttattttatttttcgaaacagagtctcactctgtcaccaaggctggagtgcagtggcgtgatctcggctcactgcaacctccgcctcccgggttcaagaaattctcctgcctcagcctcccgagtagctgagattacaggcgtgtaccaccatacccagctaatttttgtatttttagtagagatggggttttaccatgttggccaggctggtctcgaactcctgacctcaggtgatccgcctgcctcggcctcccaagtgttgggattacaggcgtcagccaccatgcccagccttttacagcttttaaaggaccataaatgtgtccccatattttcatcaggagtgcagtgaaagcacccttctcagcatggccctgcaacctcataggtaatgtgattgacgtcacaccactgggctcagtattcttctgttacattggaagaaacaaaaacttcaataatacttggtcttcacctgaacggtgcactgaaacgttctgtcatatttttttagccttttgaaaagtgttctaaatatttttgctactgactgtattacaatgattgcaaaaataaactatttccaagagagttctgttgtatatttttagtatcatcagagtatcagagacctcacttgaaaaatcattaaaaattaaattacatattttcaacttgtatgaattgtacattttattgtgaaagccatcttatgccacatccctttagaattagcatgggtagtgctgaccttattttaaacctattattattattattattattattattattttttgagacaaggtctcagtctgtcacccaggctggagtgcagtggcacgatctcagctcactgcagcctcgacctcctgggctcaagcgattctcctactttagcctcccaagtaactgggactagaggcgcacaccaccatgtccggctaatttttctattttttgtagagattgagtttctcaccatgttgctcaggctggtccgaaactcctgagctcaagctatcctcccgcctcagcctcccaaagtgctgagattacagacatgtaccacctcacctagcctcaagtctttactgctcttttttttttttttttggcctttaattatttatttatttatttatttatttatttattttttgaaatggagtctcgctctgttgcccaggttagagcgcagtggcacgatctcagctcactgcaagctctgcctcccgggttcacaccattctcctgcctcagcctcccgagtagctgagacgacaggcacccgccaccatgcccggctaattttttgtatttttcgtagagacagggtttcatcgtgttagccaggatagtctcaatctcctggacctcgtgatccacctgcctcggcctcccaaagtgctgggattacaggtttgagccacggtgcccggcctgccttttatttttttaaaaatacctttttattatggaggttgtcaagtgtatacaaaagcatggaagatattctaatgaactccctatattcagctcctcacccagcctcaacaatgatcagtacatggaatcctccttcccacacttcccaccatggagtaattttatttttttattattattattattttatttatttttttttttgagacacagccttgctctgtcgccaggctggagtgtagtggcacaaccacagctcactacagtgctgacctcctgggctcaagcaatcttcctgccttggcctcccacagtgctgaaattacagacatgagccaccctgccaatcatgggatcattttaaacatatcccaggcatcatatcatttcatttgtatgtatctctaagagataaggacacttaacaaaaataaagtaaatgtactttcttaatatcaccaaatatccattctgtgttcaaatgtccccgattggctcatgaatgtctttttataattagcgtgtttgcgttagaatccaaataagaggcactcactgcatttcagtgatctgtctcttctgtctcttttcatctggtttctccatcctttgtcataggtccccagtgaaactgttttcatatgtctcataggctgtcccacagtctggaaacagcaagtgcactgttagcactgtttagcacatctctgcattccctctgatatggtttggctctgagtccctactcaaatctcttcttgtagctcccataattcccacgtgttgtgggagggacccagtgggagataattgaatcatgggggcaggtctttcccatgctgttctcatgatagtaaataaggctcacaaaatctgatggttttaaaaatgggagtttccctgcacaagctctctttgcctgctgccatccatgtaagatgtgacttgctcctccttgccttccaccatgatagtgatgctttcccagttacatggaactgtgagtccattaaacctctttcttttgtaaattgcccagtgtcaggtatgtctttatcaacatcatgaaaacggactaatatacatctatttatctaaactcagaggcctgggagcttgctgaaaaatcagagttttttgtttttgttttgtttttatttggacaagactacttcacacgaaatatcctgtactgactattgctgtacaccaagacgcatgtgatcactgattgtctccttctgtgatgttaaaagcaccatccctggcttcaggtgtgttcagtctggcccagcttctgcaattcctgatccgcctctcacctggtggtttcagcagccagtgtttaccccagcctccagatgtatcagcagctctgtggtttcagcaccacactttcagcacctaatacagaattcactttgaaagaaagatttctaaaaatgacttgctagtaggtagttagaaatactgagtgattcttaataaaataatgatttcaaggtgaaagcgatggcataattcaaaatgtgtttacattttttccatagaaacacatacttgattactaactaggaaaataaaaagatttctgtctcaaagaaagaagatgagtatgagaagcaaccagtagagttatcttgtttactctcctcccgagagctctagctaaagattcgaatagtgcattgtttctgagatttttgtcttaatcataagtaattctaaagcatttatcttccttaaaatgccagcaaattgaggcaacttaaagtactccagttcctttaggtaataatgtaaaaaatcgctgattaaatattgaggagtccctttgagtaaggtgtaatgacatgccgtcttacagagccagggtgtagttgctgcttcttatcccctttgcatcctcattatgtttcttctcgatttcagacctctctttggtctgaaaagatttcgctttataggttatttgtttcatcacaagtagagctgactctggaatgaactcagtgcgttttgatcatgaacccagcactgtgctacaggcttgcttactggaatatacagtgtcctttagaatccagaaacagtggttcatcttaggaatgtatggccaaatgttgatttgggatttagagttaagatttttaaattgtacctaggtgtctgggttttatatattgttccactttttatgtggaataagcttcatcagaatcatttcaggaaatgagaaaagtaggatatggttatgaatcagccatggaaaactacggtatggaatgaattagtcagaaaaaaggtttcagtggccagcgtgagctgtgtgctatcaggaagtggcatgactttccatgattttatgtgctataaatcatgtggcatactgatccagacacctagagtctttttttttattattataatttttgaaataaaactgaaaagcaccaatgaagcaaaagcaccaaagccctttcagtagttgcttgctcgtccctactatcagctggaatggatctccacccccactgtgagctccgctggtgagggatcattcatctaaaagtccattgtggctgctgggtcaggtttgagaagcagttggcttccgcagagttgctgctacaaaaatgtggcatctgtctgtttcttttgtttgtaatactttttctcataccccttgtctggccgcttctagatctctgccatttatggtctagaaggtagttgcttctccctgtgttgtgctgtgtttagaaagatagtctgaaattcagaattaggcagttatgttccagtcttctatcatcctattaaagagaaaaagaaaaacttgcgcaaatggggtggattaaaagtttgggtcatgtgaagttcataaagctatatctccagagggaaatgctaaaaatatactcaaccactaaaattgcccatggagggaaataagtttattgctttattggtcatgtaagtcagttaaaatataatcaagtcagcctcctcactgtcttttattatcgatacatccatgaataggcattcaataatgacagcttggtatgtgtctatgtgtgcatgattggtttttttttttaataggcacatgtaatggaataattcagttaggaatggagtctgcatgtgagtggctacactactattgaatattgatgtcatttccattgattctgatgcctttggcaacctggtaaacattttctctggaaaaaatctcgtaaaccaggtttgccctgtttctctgccctgtttgccgtttgtggtaacctggcagggttcctatggagaattgttggtctggaagttaacccaacttaacatcgcatagtatcacttagcaatcacgtggtaaaaattggcatgttcttcctccccctctaccttagaccaatgcctcccagaccttactatgtacaggagtcacttcggatcttgttaaaatgaaaattctccttgagtagatctcaggtggggctctagattctgcgtttctggcaagctcacaggtgatgccactgttcttggacactatataccaaacaacatctgtagagttcaacaagaagccaaaccctaaagggtatcgtgcctctaacgctagtaatgcagagccagcccttctgtatccaagacctcaaacctctctacatcatataaacaccagccctccagcaggagtgaggaacaccctaggatggagaggaaccctgatagagacatcacgtgagtcctactggcctttccaccttgtatcttaaacttcacttgatcctctgagcacacagccatctgtcccaaattctgccaaagccttatcaagagctaataatgccttcctttctccattgactggacactttctgagcaaggaaggtggttagaactgttggtcatctaagtcttcccctgggacccatgatcgctattcctaagtcttcattctaagattttttttttacacagcccacttgtcttcatcctccaacattcagggagagttcagaaagtttagtgggataagaagggattttgacattagtggcaagggaaaaatgctggaagtccaatgaacaaaggtttgggagacttcagaattctttaagattgacttaaagaatcaaaaaagaatgttcactaggggaagtgtcccagtgtggaaacttcagcagctgtatttcagaatcaccaatcaccagaacatgggttttggactagctgaagaattgttgaaccagtgagagagctgccttctgcctcctcctgttttccctcaattgtcccagtaaaagtaggttaaatatttaattggttactttattaccatggaattttcaaataaaccagcaaatcaacatcattattttaaaattttaggaaatgtgattcagggtttgtcattattttttccaaggaagaaatgattatagatattttctgcaagggtaaatatctgtgacttttccagtttagaagccagccacagaccttcatacacaccatccaaaaaggaagagtgttcaggacataagattaaaaatagttactattggtatgcacccattctaatgttttcccttagcgtcacgggtgcctttaaaagcctttctactattttccttgggtcttcccagttttaaaaacaagagccccattccagatgattaccaaaatgtggcatttgaaaaggtgagtttaatcgttgtcatagaattccttgtctgactttatcaacatcattgagttatgtgcattgagttgtgcatatgtgaatgagttacttacagcttggtattagttgatagcaggatacagattctatcggctatatgataaagctctgcccactccattggatggatctaaaggtagtgggggcatgccttagtatgggggactgaagctacattcattacattcctgtctcatcattttctttcagaggcttttccttgagaacattaaagccaactgtagagacctataaggatgaaggtggtagtttgagatgggcatattttatattgttacatgctcttaagttggcagtggtgttagtctgcttgggctgccatgatgaatactacagactgggtggcttaaacaacagaaatgtgttgtttcacaatcctggaggctggaagtccaagatcaaggtgatggcagggctatttccctcagaggccttgctccttggctcatagatgacatgctatctctgtgtcctcacatggtcttttctctgtctggtgtccaaatctcctcttcttataatgacacccagcagattggattgggctcctccttaatggcctcaatttaacttagtcacccatttaaaggccctacctccaaatacagtcacattgtgaggtaccaggacggttaggactcaacatatgtatttttgggaggagttcatttcagccaaaacaaagttcacagaagccactttgaatttgcaaaactgtttctcaaatggagattacttcatggttcttccatttctttttgagaatagttttgtcttcatcttcattgggagatgacacatctgctgttttgtcgtggaagtaagaattgggacaataataacataattgtctaaatgatattttagggtatcaggtggttttgctctgtgagaaaacctctttagaaatacaacgagggtgtccacagataatagaatgggcctctgccactcaggagtcttggcagtgcttccattcttccatactccacctcatcattgatgtgccgccctgtcactgccaccaccagcaggcacatctcggggaaggagcaaggtgggcctcagaacttcacctgggtctgtgttcagtgcctcctggagtctgtctgggtggcatggtcatctctgggttctagtagctggcatggtcagtgcctgtaggtgttcggtggatggatggatggatggatgatggatggacaaacgaataaactgataatgttggcaaaccacttcccccttagctccgctcagaaatatttcagaacatcagccattgaggctgctgacctcctcctggtccccatcattgtcctccatcttggagacagctgctgtagatgccacagatagagttaaaccttgttttgcttgatgtatattaaaaacaaggcaaatattttgcttacctgttttagcctggactggagggtcaccagcaccactctggctgtgagagagtactacttttctaagtttccctccgtaatttttcattttgggatcctcggtattcaccacctcggcagccaccatgaatcatctggtagatgcattttcaaactcaaaagcagattagaacatcacctgaaccaccttcaggttagaaaatgaacgttgctataaaagaagtaaaaataataattatacaagggcataggttaagtctttgaaactgcctgcatggcagattttacatttttgaaccgaggctgccacagctgtggctagtggttgtctgaccctcttctttcacctggtgccttcgagggccactgagagcatgagtcagagcacaccaacacccaaacaaagcacacatgctcatggcgccttagtccctggccagagacacgcctgtctttcatcacgtgggatggagacagtgaagagcctgagcaacagaagactgatgaagagcttcaggcgtgagatgattgaacaccacctagcacctggcaaacggtctcatagtccctatcctgggtgttggaccacaacgaactgtttgctgaccgtgcaatttggcaaaatcatcaaacctacacaaaacaagaaacaagcgcacaaaataagtgcaaagaggaaaagtaggcatttttctctaattgctatatattctggcatagtcctttgctttgtttacaatagaacttagaagaaatacagttttatttagatggcactaagagaatttaagattcctttgccggcatattttgaactaaactttagtagatttactgacagatgtagaagttaatagcagctttttaaattatcatgaataatgttttcaattaaaataatatttcttatgttaagcaggatatcaatgttatcacaatacagttaaagacaaaggttttacaagtgctaaaatgggatgtaaggtatacctcagtgaaactgtttttaaaagttttatatttcaaaagtttcgacattgcagagaatttaaattctcagcagtactgccttaacttttttttattattatttttactcttttgaaaactctactttccagctttctcagtttgagaggacactgaagagcttttgcagaaatcagacatgtcattttattaggaaaactgatttgattattgatatgccaattataaaattcttagtcatccagcacatatctagccatgcaaaaaaaatttcatatgtaactttgaaagcaaaagtaatgaaaatcaatgtgaaattacattgattggctaaattcagttcttctcaaagagtagtaaaatgcagttgttaagaacataggatctataggctttggttcagaatcctggttccaaagctgagtggtggtaggtgtcttcatctgctcgggctgctataacaaaatgccctattctaggtgccttaaacaatagaaatttatttctcacagttctggatgttgagaagtctgaggttaggctgccagcatggttgattcctggtgagggctctcctcctggcttgtagactgtcaccttcttgcaaaaaggactctactcacctgacttcacctaaccctaattacctcctaaaggcctcacctccaaataccatgtcttagtccattttctgttgctataacataacaccacagactgggtaacttataaataaaagagatttatttggtttgcggttctggaagctgaaaagtctaagagcatggtgccagcatctggtgagggtcatcgcatggcagaaggcagaagctgaagcaagcacaggagacagggagaggacatggagccaaactcatcctttttatcaggagcccactcccaggataactaacccactcctgcaacaatggcatgaatccctttgtaagggctctgccctcgtggcctcctcaccttgtcaaggccctacctctcaacactgttaaaatggcaattaagtttctaacacataaacttttgggggacacattcaaaccatagcaccattgcactgggtgttaggacttcaacatgtgaattttaggggaacagaattcaatccattagcattggacaaagtacttaattgaggtcatttgcctggcctcttcatgacagcctttttctcttgggacgatgtttttcaaaattgtgtgtttcctggggtgcattcccatacatggcagtgagcaggtgagggagggggagaaaggtgaggggaagctgtgatgtggaaagagtagtagacctaggtaaaaacctggctgctgtgatgggcctggactcctggatatgccctattctcttggcatgtgggacagtccccgctcctgggctcaggctcctgtagcacctgggtgacgtggaacccgaacccttcgctgaatcctcagctactcaattttggcaggggtagtggctgcagctgagtaggagtttgtttgcgaccctttgtgttccaaagaaaacgccagccacagaatttactgtcttactcactggagaccttgcaaaagtgtgggccccaaactagggtttggggagagatttattcacgtaggtattatctggtctctgttacccagaaagtcatttttaataagtcatgcactcatgactaatcattttctccacttaaaaaaacttttttccaggtaggacataataatgggtcaagctacttatacttttcctgtttcccccttttaatgggaaaaacacgctctttttccatatctaaaatggaattgaatgcttcttgtaaaatgtacatctcagggaaaaacccattgctattctaaacctgcttcctcctattcttcagttcctggtacggtggatgttgtttgcgtcttctgacttctaccctctgagttggagactcataattattgttagtatgtgagcatgcagtgtctgtctttaaactgctaagacggtgttgcttttaagcgacagcgattgttttcttgttcatgtttgtgctgtcttctttgcgtcagctcctaaaatagaggggagttgtgtacctgttaacaacgtgttaacagcattgttggggtttttcagacaatttaattgtacaagtaaattattttaagttagagcctattcgtttgaaacaaagaaaatagtttttacatttctaaaaaaaaaaaaaaactaataagtaactgccaacaaatgctagactatatacctgtaaagtcagcattttaatgtcattttcttctagagccagagtttagtaagttcttggcctgctgggaagaaatgtaaggaagagagtgttgttaggtggggattttttaacacaaaaatataaacttgcctgacgtgatttctcgccattttctaagtcactgaaatgtttgttatctattttatttcagtaaatcactttcttttagcatccttcagatggtcaaacagcatgttgtatctctgagaaatctcatcttattaaagattgactgatgtccttcaacatttctatgagcgtttttcaacccacagagatccagttaagatacagacaaatatcaggatcttcttaggacctgtttgaaatgacatgtttcaaagcagctctgtattaaaagaggtcattcttttctgttgaacaagaaattaagtgaatgcatttggtgtgctggggctattcttcgaatgttagagcaacctgtttcattttagggcctggggtcattattctccatgggtggcaccgctatcctcccagtggcatttgaaaatccttgcgagactttgtggttgcagcaaggactgggggaaagctgctggcatttgtagggagaggggactgaccagcagggaggctaaacagtctagagtgcaaggggcagggccatgcaaggagaagctgtttcctccacaatgtcgttagtgtaactgctgagaaacagcgggagaagtcacaggctcagggaacacaaaggatctttgtgcctggcctggccagccccccacttcttcaaggaagcatactgggggtcacatctattttctcagtgtttccctttcacccatgccccacattgcagcatttttcatcagaaaccacaggagcccaaaatacacttcctcatttctgagatgcctttcttagtcagggctgaaattagttttcagtggacacccacactcaggcactgtactagcaaagccttttgttagaaactgtcacactggtgttcagattgtcctctgcccgagttttggaagggtgggtgacaagggccagcaaatagtcaacactgcccgttgtgcaatgctgtgatctccctctgagagcaagaagcaaacttgaggtgacactgaaacaaggggcgggggcactgagcctgctttcgtagctttgctttgcttttgcctcttggtttactttctatggggaacatatcccactaagaaggctggtccagcccgcaccatgatggcaggcatgggactcgggagacgtggtcccagaggctctcgctccactgatggtgaggagtaaatgacacagtaggctttgcagaagtgaagtcagaaatcagagggctccatctttcaaccactccctggccttcaaggatagatcttggagttcacgtcatacagtctttaaaaggctctcctgcccacaaggtgccctcactacccctcttccacgtgcgtccctcgcactgctgtttgctgagacttacagccccgtcccatgtgtgacttttactccaacccgaggcgggtgcttcctgacagcagggctgggtctcctttactttctatcttggggaccagcagtctcctctgacaaggaagagattcagcaaaggctcgttgagaccagcctgggtgacacagtgagaccctgtctcaaacaaacaaacaaaaaccagcagagtttctgattcagtaaatatatattagttttctattgctgtgtgacaaattactacaaatctagtggcttacaatgcccatttcttagttgacaggtctgtaggtcagaaatcaccatgtgcacaacagggttctctgctcaaggttaacaaggctggaaccggttctctcctgggctgcgttcctgtctggagactcttgcggagaatctgcttctaagcacattcagatccccgtggccactctagctccttgaggccactctcagtccttgccacatggccccctccatcttcagaatcagcaacagagaatgtctctcccatcctttctccgacttcagaaagaacccggtcccttttaagtgttcaccccacataatctcccagggtaatataacctaactgtggaaacagaatccatcacagagtcccgggatcatgcaaagcttgtccaccagggggccatttgagaattcagcctaccacaataggtagggcaagaattctggcaagttgccaagtaaggcagctactgctgctgtggcagccacagtctgaaaagcacctacctatgcacattctacaacaacctttgacttagattgttcccaaattgcaaatgaggaaactgaagttcataggattcagtctagagataatattcatagcacatagtaactggtacctcgtgggcactgaccactccgaatggctagcaggcaactgactctggctgtcagtgccactgtggtcatcttggccagcaccaccagttgactgaggacccccagcaagtaaggactgcagccagggttcctgcccaggcccatctgacacccaagcctgagctttggccacttcacatgctaggattaaaaagaaaatgtcatccctcgaagcctaagtcaggagaagaagaaataaaaggacagcagtttattgattccaaagcccaacttcctttgaacattctagctgctggatgttctataaagctacctttctccagtcttaaatttgtatttgcttcctgttgctgatgtaacagattaccaaacaattttagtggctgaaaacagcacagatttatgactgtacagttctggagatcaaactccaaaatcagtctcaatgggctaaaatcaggtgtcagcctggctgcgttacttctagggcaaaatccgtttcgttgccttttcccgggttccaaagactcccactttccttggctcatggccccatatcactcgaatctctgcttccatcatcctgtctccatctccgactccagccctgccatatcctgcttataaagacaccttgattacactgggcccaccctggtaatccatcatctcctagtctcaagatccttagcttagtcacacctgcagagtcccttcttccatgtatggcaacatatttacaagctccagggactagggaggggctgtcattcagcccagctcatagtctgaggcccacacctatgtggatcataacagtgaacgctttcatggaaacttcctatgcaccaagcctcaatgtaggcattaggtcaatttgtgccaccaccaccacatgaggtaggtcctgtgattatcctctttacagatgaagaatctgaagcacatgggacttgagaaccttgcccaaggtcacacagctaagaaatggaacaccaggttcagacccaggtggcctggctccagagtccatacttctacaactctgttgtacacctctcacagatgtgcaagtaaaaggcagaccctacatatgtagatggcaagaagccccacacccacccatctctccttcctcttacacccactgttccactaaggaccctgcttactcaggtgacctcgccttctgagtctaatgagttacaatccttgccacttctgcccatcgcagaaatgttgttccagttactattgctgcacaacaagccacccaaaacgtaatggctgtaaataacaatagtcatctgttttgcttgtgaatctgcagtttgcacagagatgattcttctctcctccatgcatcatcctctgggtttcccttggctggcgactggagggtccactcccaagttgtcacacttatatagctggcaaaaataccagctgccagtgaggagctcagccagagctctgggccagcagcctcagttcgtctctgtatgggcctcttcatgggctgcttgggcttcctgaaagcatggtgggcaactgggttccaagaggaagtgccccgagagaacaaggcagaagggcatggctttttatgacctaaacttggtgtcttttccaccatatagtgtcacttgaggcactcacaaaggtcctccacattcaagggcaggggacatacattccttctcccaacaggaatggcaaggctgtaggagagcatgtggagtaggagacagtgttgcagccatcttcagagaatttgttcttccagaattgtctttatcatagctacctatgacatcccaccacaccacacatggcatcctccccacctcacctctgtttataggcactttccaagcccaaatttgggtgtatgcagaaacacaagattttgtccaatgtatttatttttatgtccttaccaaaattttaaaaatgtgttgcatgaatagcattaaaaaaattttttttatttattttattttttttgagatggagtctcactctgtcacccaggctggagtgcagtggcgcaatctgagctcactgcaagctccacttcctgggttcacaccattctcctgcctcagcctcccgagtagctgggattacaggcacccgccaccacgcctggctagttttttgtgtttttagtagagacagtgtttcaccgtgttagccaggatggtctctatctcctgaccttgtgatccacccacctcggcctcccaaagtgctggcattacaggcgtgagccatcgctcccgccccgtgaatagcatttatttttaaaatgaaatatgcaaaggtaggatttcctaagaaatccaggacatccgttaatagatattagcactaacccaatgccatgcaaaaaaatacaagccatcaaatttgttcaaaatgagtaaagtatatatgtcctttaataaaagcacctgcttatttgatgccacatgacagtggatgatagtggaacgttaactaactagtataagcgcctacactgagcagattcttgtgtaggttgattggggaaagctttccttataccttttctttttaggtagtaatgaggaaatgcagaggtatatctttttcccacttatttaaagcctaaccctattctcaagtccttcatctgtaggactttttgtaactggaccaattggaggttgagatgggattcttatatacctagctagacttttctgattgctacgctccacttctagtatcctgagctctgagtgtctgtgacacacaagagagatcatttatattatcactggagctgcagtctcatcactcaagcttccatcttaagcccctgtagggacagaaactgaggcttttggaggccctagtagactactgagcacctggtcatggcttagtatttcttgattgatttcactgtgagcttttttttctttttgagacagagtctcgctctgtattccaggctggaatacagtggtgcgatctcggctcactgcaacctccacctcccaggttcaagcggttcttctacctcagcctcccaagtagctgggattacaggcacccgccaccccgcccagctaatttttgtatttttagtagagacagggtttcaccatgttggtcaggcttgtctcgaactcctgacctcatgatctgcccacctcggcctcccaaagtgctgggattacaggagtgagccaccacgcctggcccactgtgagctttttgaaggaataaccataccttcctcatctttatatctctaaggaagagtcagttacttggctgcatgcatttgttcaacaaatgtttatgaagggttttaagggttccagggtctctggcttggtctacccttagttcggtgaaggaaatcaattaaagtgtggtaaatactaagaactaggggtaattttacccagccaaggagttcgagaagtcacgtgggagatctttaacaaatggtggttgaatgaatggagacatgagtgatttcttggaagtctgcccttaatcccagtcagtccatgcaagaatctgctcagtgtaggtgcttgaacaatacgtaggcagcacccagccccggaagagcccacctgtgcagagaattttcccctgtaactgacttactgcctggaattttccccttagcaatgcattcctttgagatgcagactgatctccagaatttgctgattaaatacaaattctctgggaaggccttatatattaaacaactgtcatcattaatgctgtaatggggagaagtttattatgtaaccttccagtcttgttagaaaggagattcagaggaaggggtcatccagggagaaagaaaaggggcttggatgtgattctgggactgcaagaagaatggggaaaataatgcaggtgagcaaggaatagatgtagggacatggcagtgacaagaaacaattcagatgagtgtcccctggcactcagacagccctgactccagtgagaatggctcagccaacactactgattaaatgagaatttcaccagataaagatggcaggcaggagaggtaatcaaagaaagacaaaatcagtattttctggtgaaatccctgtttctaggtatgaaataggattctttcaataactagcactccaaaatgttaatgggttaaaatgagcaggtttagagattgtgcataacagatacagagcaaatattaaaagccgtgataccaaaccactacacaaaaacaggcaaagtcgattttctctccaactaacctttacccttacatattgtgtctgttaaccacggttaccttgaccattgatatatagcatctagtgagggaaggggaaaggagaagcttttttgttattataaaagtaataagtgttcattgtggaaattcatgctagaatctaaataatccaaatccaaataatcaagaagaaaaacacaggagtcttctaatactatcacacatattctttcttttcaccaaaatgagaacaataaacattgctttgtaacctggttttttctcctaacagcaagtcttgaacatcttttcatgtcattagttttcaccaccttactatgagtggctctatagtctactgaatgaatttagcatgtatattatctgatcacggatcttgatgtattttatttacataaaactatatttttgcatattttatttgccttgcaggaacatatttgcatctaatgtttgcccacagccatgaggatttctttagaataaattcctaggagtgaaattgttgagtcagtattcgggatttgagttgatgcggtttatactgaaagtttaaactgtttgaatttaccgctaatcttaccgatattcttcttgaagctccttacatggatgatgagctaatgatttggagtggaataagcagcatttttgtagtgttcagtttaaaggctgtcacatttctgagacttcagatgattaacttagggtgcaagtctggagccttctaattccttgagcttgggccttgcgggttggtcggttagctggtcggtgcactggtcacagtgacacaccccaggtcacttcagaaaaatagaatttgtctcccagcctcccttgacagtcagccctgttggggcagagcaaagccaccttgcccaagttccacccccttctcagggtagccccttcccagaactgaccaacgtgggggtatcaaggcccggtcctcctgctccgataagggtcgtctcatcctcaaagctccctgtagagtcggctaggcttccactaggaccacttggtagcttcactctccctctgcccagtttcctttcccctccccaccactcgtcctaataacctcccctgcgcaagaacctctgtcttagagtctggaagcggccagtacccatggcggggagtggatggggaattggctggggagttggcagtagctgtggttgatcacagtatgtgccacataatttcacctctacagaggacagtagagccactgtgtcctccctcaggatggaggagcccacggtggcttggaccaacagggagcgtttcttaaatgggtgaaacaggcacaatcttcccatcattttcaacataaggaataaaatgtaccatagatttgtacaagagcagtttaaaatgctctcttctccgaatgatcttttaagaaactatcttaaagaccacactctgaaaacacctggacctcaggctcctttcaaattgtttttctgtgtcttcgaatgccattcctgacaaaactttttttgcctccatgaatcatgagctaattctgtagaaatctgtaagtgaattacagttcagattcttcctctgtcttcctctgacatggcccaatcatttcttaataattgctaaagaaaccaactgtggtttatgtttgagcagaatcaagatcgtcgctataaccatgtcaccaccattccctggcatttacagcataatttcaggagtgggagacaacatttcacagatgcccagggagtcacccataggaatgtgatgtgcccatacatgggccagatgaaaaaataagtacacacacacacacacacacaattaccatgtgggagtgagggccatgccctctccatgtataattcggtgtaaattgttaggcatagaacagcttgagccccagagctgggtaaacttctctgcctgtacgcctggcacctcacaccatggctggccctagcaggtgactaatctgtttttgatgaattaccaaattaagccacaaattgaaatgccctgggggctggtcagccagcagccatcattggtggaggggcgagtagaccacagacagtgatgaggcctggggtatttgaagagcatgggttccccaacaaggggcatctgctcggccacagtgaaatggagctctgggcccagggtggccacatctccccgggccaccaccaccaaaaagaagtcagaagttctatttctgtgtgacacctcccaatttttcaatattaacaactaattttccgtcaatgttaatgggctacagttcaccaggagaaaactaactgggccattctaggcctgatggaaagggaacagctcttaggaatcagatactcggtgcaaagatgtgtgcccacattttagtcacttgacgggaacacctagattttcctgatgaaccaggttggcacagttgttctctctttgggtggacagagataatatccaagttgtggtggggtcttgcttgttctttgtatgtagtttattgttccttcagtatgttttgaatcattggtgaccttcatgaagatgacaggacatgcttcctcgtgtgacttgttatcaggcttttaagtcatcagcaaagaatgcaggccaaatgcagaaagaaagcgtttgcagtgccctgttgggacttctcaactgcagacatggaaacagggtgtgtgtatggtaatggaaatagcaggtaagagcacataactcacttttctcccagcacttggtgaaaaagaaaaaacaaaccaacaacagaaaaccatttctgacctgcctcttgagttttgaaactgggtgtggatacaaacgatctttagcgaagccattcagaactgggttttctgtctttattgaagagttgcagattttgatcttgctcatttttttccccttccctccatgaccctctcacctttactcctccgctgacattcagccagctattcaccaggtgccggcgtggtgtgtgcctggacccctcactgcgccagcctccctgggagaatcatctcctctaaggagagtatggaatgctgcagcggaaggaaaaggttttccaggcagcattaaccctggaaagtagaattcctactttgcgtgtgaaggactgacttgttgagaatgaaccagccgtggggttgtgaaagctgcttagcgcagggatgagggctaaccagacactggtgttccctgggcctgagtgaccacagccagcccactcctgggtgattgttcttccccaggtttttgctgctgcagtgctgtgcccctggctgagaatggcatcaaagcagaaattaaagtcagtaattaaagcaaggtggctctggaaagagagaacaaataaagggtaattaattagggtggctttggccccagtaatctccaaataaatgttgcctcccctaatcctcatctgctggtctccaagtcattaagtagagttttgatttgcctgtggctattttttcatcttaaacattgcaagcagtgcgtttccaagaagttacagtggggtggttaacctttacatattaaggaaagattgaggcaatacggaataagagttaatggaattctgagcgcacatggaatttaacaaacaagatgaaatctagtatgaactgtgacctcagtcttaagatgtacatttgtacacactcttcctccctgtttttcccaattattttatttttctcttttcttttttattcttttttttttctttatacttggattttttttttgtttctactgtgttaacagatcatgatcaccattctgctaaaaaaaaagtctttagcattttcacctttaacaacatgaatatagagcaggcataattgcagccatcattttggtcactggcataaatcagccactcagattttttatctaaggaataaaagttctgtgttatcccagaaatacatatttgtaaactctcttgtagtaattcaggcaaagtatcaaaagatacttcagcgtttcttatttttttttcaaagtatcagaactgtgcctggctgaagtttaatatcagttattgtgttttcttacagaaaattaatactcattaaacttcaaagtgtttttttaaacaatttcattatttcagatttagaattcttagttgtcattctctgtagttgcagaaccagcacctcccgtattttctccggggcattctggttaacaccttcaaagcccatcaaaaaaaaaaaaggttatgtgttttgctttataccacttccctgtggccaagcaaattttaccagtaagagagcaatactaagagaaatacactcctgagcccatttcctgattgccctaaaagtgaacaaaaatagaaattcctttaactatatcaagaagaatgttcttctgttctctttcttacacttgcttatcatgaaaaagcctaaagaaaactgggaatttaatcacactattgcttaaacacatggtctccaagtgttttggattatgaacctccttggtagaagattttttagtacatctgccagtaaagcattttatttgtaaattctatacaaattctcctatatgctggatactttatgaaacatgccctaaagacaggtccttaaggtggacatgcatccaattgactctgctcttcctcttgtcatggggttggtgctggagatctctgcagtgtacccataagaagaatcctggccctcagcagtgtccatgtggtcgggcctcccagtctccatgtgatggtgcgggccagtgcctggcatcctgctaggccccccacagcaaggacataggaagcacatccgggaatgtgacacccacagagcacacatgtggccctcaagcacagtgcttcccctgaggcctgtgagaaatgtcatcacaaccctacaccacctcctgtgaccacaatgaatggcctggcctttgctcaaaccacagacaaaggctgcccttcagtctgtcacaccagaagccatggccttttgatgccctggtgaattctggctcttggtttgcatcagatgagcccccactggtgcagttctccgaattttggtgtcattgacttgcacaagcttttgtctacatctctggggagctgcagaataagctgcattgtcctcatgaagcttttgttgtagtatgaagattgccaagtcccaacatgactatgatgccaagcagactatggtgacagcgggaggtgggagtcaccaggttacaggtgggaaagaacacttagttgggggatgggggagctcctggaggaattggacttaatgataggctttaaaggatgaacaagagttcaacaggcaggaatgagacagggaggagctggctgaggagctttagaaagtgggtactgcagagggggtccctggaggaggtatggacactggttggagaagaagctcccactgccctgcctaccccagctgtctcctcatgggtaccttgcttccccctcgccccttcgctgtattctgaacacagaaaccagagtacttctgtaatatggaaatcatgtcataacagaccatgctaacctttgctcaaacccccttatggctcccacttctgtagaatacaagccagggtccttccaatggctaaaggtctctcttgtcctcattcccaaccactttctccatgaccctcctccgcagccaccctgagcctccttgctgggcttgcagcatgccagattctcctgcctcagggcctccacacctgctgttccctgggccagaatgctgttccccagcatccaacggttcactcccctacctgcttcaggtcctcatgcactcgcatgtccccttctcaaggatgccttccctggccgggcttgctttcaccacttttccagcttttctgcccctccgcgctgctctgttgcccacactcaaggctgtctaaacatactgtggattgtacccatctatcttgttttgtgtcttttttccccatctggaatgtaagctccaagagggcggggagttttgtctgttttgttcatatttgaattcctagtacctagaacagtgtttagacaaatgaatgaataaatggagggatgcgtgaatgaatgtgaaccagaaggcttaggttcaacttcaggagcaaagggaagtcattgaaggtttgttttgtttaaatatagcatgttaccttttatttacttaaagtgggggaaataaaatcataattgcttttatttgattaaaaaaaccccaaaataataaaaatggtttaaaaaaatgaggttacacctaacaggcagagtgagaatggagtggacagggacagaggtaggaaaagctttctcagtgtatcctatttaagtatattttgggcctggcgcggtggctcacgcctgtaatcccagcactttgggaggccaacgcaggcagatcatgaggtcaggagatcaagaccatcctggctaacacggtgaaaccccatctctactaaaaatacaaaaaattagccgggcgtggtggcgggcacctgtagtcccagctactcgggaggctgaggcaggagaatggcgtgaacccgggaggcggagcttgcagtgagccgagatagtgccactgcactccagcctgggcgacagagcaagactccgtctcaaaaaaaaaaaaaaagtttattttgttttttatcatatgactgtattatcaaattttaaaaatatttgtttaaatgagactgataaggtgggcagtggggggttggaatttgcaatgttcgaaagtaagatccaggaaaactatccaaagttctactcatcttagtggcagggtttacacttcatttatctattcttttctagagtatctacaatcatatctatcatgtaaaaggctattcagtatttgctgatcaaatgaatggatatgtgaatgagatgacatctgtcgtcaaatgtatgaatgactcttgtgtcaaagaggaactagtttttagttctatgtgatcaaagtagaagcagtggatgacagtgacaggaagaaagacatcagtttgtttctttagctggcatttttgagagactattttgtaccagcaccaggactatcaagtggaataagatgtggctcaagccgtcaggaggttcaccgtttagaaccagggtgtcatcacataggtggtcacctactgaagtgagcacggtgctggagacagacgtaggaagtttggagagtgcttaacaaaccttggacaagggtatgagtgggtttggggtgacaaacattttttgcttggccaaatttgggtcaggtttctgaaccttttcctaggctcacctgtgcacttccttataaaacccagttttagcaaagaaccccgcaaagtcagtttaacaggaacccccccacccttaatatctgattgggttcttcatcttctaccatccgtcaggtgatgtctgatcacccgggcctgtcttcagcaagaatcctattaggtcagcttagccagagtcctctttaccccgatgcctcctcttagtaattttccaccactgaccctgacactgcttcttggccatgctgtattcggagttgagctcaatctacccccgcccccagcccccactgcaagacctggttgtggtggtctctatacccatcgtggtggtcctgaataaagtctgccttgtcgggcttcagcaggcatcattgaataatatttttttaacacggggggtcattgttggcttcctggagaacgacatgcctgcactcaatcttaaggaaggaaaggaaaggggagaaaggaggaataatccagggagagggagagcacgagcagagacttggggaagagaagaggggagtgtgttttgaggcatataagccatttgtcttggaggaacataaaagtgagagcagcactggcaggatatgtgacaagaaagacacaagacgaccttgaacagtctgcctgggctacagcaggaacagtgcttatcactgaagcttatacagcgggagaggaacgtgaccgagcttggtcagcatcagggatttttatgtgtcagacttgcacattatgttggagtggtaagacacaggccaagcgaggccagttgggaagatattacagttgctgagggctgcctacctgcagcactatgcacggtgaaggatgggatagagaacctacaggactttctgtggacctgcagggcacataggaggacatccaaggtgccctggaccacccagagagatggggaaatgagctacagtaccacagggcattggcccaaggcgggcatagttccttggaacaagcgtggaatctgcaatgaaaagcccagagtgagttccggctctcctaaacatagtgtgtgccactctgaacctcaatatctttatcgatgaaatcggaaatagaaaggcaactgatgtgctttagccgccacctgtgtttcaggcattgtgctaggcactttgccaccatcactagatgaatcctctccacaactctgaatttgatattaatccctcttaaaagttgagaataagaaccttctccttagttaataatgccttttagaccacaaagtggtaaagatgaggaagagagcaaacccttgtggggttgttttttgttttgttttgtttttgtgtagtaacttaggctggggaacaatgctccacattctatagggaatggttacacatgtgaagtaacagtaaaactactttaccactttgggaggccgaggcgggtggatcacgaggtcaggagtttgagaccagcctgaccaacatggtgaaaccccatctctactaaaaatacaaaaattagctgggcgtggtggcaggcgcctgtaatcccaactacttgggaggctgaggcaggagaatcgcttgaacccaggaggcagaggttgcagtgagccaagatcacgccattgcactccggcctgggcgacaagagcaaaactgtctcaaaaaaaaaaaaaaaaaaaaaaaaaaactatttcactatcttagaagcaaaaaactgaaataaaatgtaactgtcatcatgttcattcacaagagagcctttgcaagttgcctcattttttgctcagtgttggaagtcaaaactcagtttctgtctttggtcagttcatgttgcagacagcttcacagggggcacattcttggtgcagttgtcaactccttagagttcataatggatgtgctgaagtcatcctaatgatgctttcagaatgctgtaatgggaatgatggaattcatcataaaccttaatttttcctcactgaaaatggaaacttcctaatggaaactgtttggagccagaggaggcaaatgcaggttaaaaagactcatttatgatttttatggtgtgagtggaagaaatgcaaaacttctaaagctctcagttgactaaaacattcatttactttaacttctgggttcagttttatcatgttgagtgcaggttttagaatgcttctcaagagctctaatgagactatattagtccgttttcacactgctgataaagacaagacatacccaagactgggaagaaaaagaggtttaattggacttacagttccacatggctggggaggcctcagaatcacggcgggaggtgaaagacacttcttacatggcggcagcaagggaaaatgatgagaaagcaaaagtgaaaacccctgataaacccatcagatctcgtgagacttattcactatcacgagaatagcacaggaaagactggccccccatgattcaattacctccccctgggtccctcccacaatatgtgggaattctgggagatacaattcaagttgagattttggtggggacacagcccaaccatatcagaggtcttgctgtgggtcttgctctgctttcttcagatcactgacatccaaccagcaagcaagaatcaggaatatacttgcctccaaaaccacaaggaatatacaagtaggaaagtcagctttttaaatacttgctttggatccgtttttattctcagtggggagaatcactatttataaagtaaattcatttgcataggacctttagaaatgcaagttcacgtataatagacatgcagtcaaagacagactctcttagcaagaattgtcagataagcagatgaggaggcattgatatgagcataaggcagtcttaccctatgggtacagggacaggtgtcccaggaaaccctgtgctttgccctgttggccaaccagagtgtccaagtgccactaaggattcctgctactcagcaagacgcactttggaaactcaaatctgctccatacctctcacattttagccaaggaaaaccaaggtggcagatcctaagtgccctccccctgatccagggctctggtacaatttgtgaaccagtgatttttttgccagagaacatgcattccagtctccctacaaagtggcagccaccattttgaccggctcttactcctgatctaaaaatggaagtgctcaagtttactaaattcaattcagatagatagaaccgatcaattcaaaggcagatatagaattacatgtttttgggcaatctagtgaaagatttatcatttctatgagcaaagacagttgaataatcttcaaatacctcaccgttctttttttttttttccatccatataacgaaatcaaaattgtatattcgggtgagcccacactgttgtctcagatgaacagagatgtttgagatttgcccacaaaattgagctggaactttgtgtcatgattttaaaagagaaaagaagacagtgaaatcagcctcttgtgtctaaattagcctcttctgtctcttctgatcaccttttaatggaatttgcccaggtgcatgccaggagaagagaaaagggggagacaaagagttggagagggggagggaacatcagagaagttccaagcccctctggaggagtggaatgcaggactgtgtctgctcccctcacctctgtttccccttagcctctcctgcccaccaccacaatcttcatgtgcctgctggacagacaaaggctccctgtactgaaaatgcaggactgcaagcatacacattccctctcgaagcatcatccaggatgaccacttccccttggtgtttgatgcatgttgcattgttcagtattctacacttttttggaatacatgcgtttatgtcttttcaggttgggagttatggataatttggcaaagcaaacaccataactggtttcttacataactctacagttggcagcaaggcacagtgcgttgaaattaagcaacactcactcatccaaaaggactttgcttttccttttttggaaggctaaatgccctgctttgtttcttcctcttgcatgtattttaaattattggctgactttaatgattctttgaagttaatttttaaatgtgaatggcaggattccatttaacttctggaagcttgagagctgtccctgtgtgcccctaaatcagagaatgcttaaataacttgagtgcttttaggtgataataaaattggagagagtgagaagaacataggacccaggctgccatagggatctaaactggtaaaatacttagaaggttcaagagttgcaaccttttgaaagaactagagtcagtcttgcatcgcagagcacttctccaaaccaggcatcttccctgcatcttccctttcaattatagtgtacattctttccatttcttcttcctttcctttttttttttttttttacatttagtttatgagtctttaagcaggacctcttaacccatttatgcctagtgttccattattggaacgctaagcatgtgggagttatttatatcctattgctcaaggtcattgccaaggtctgatggcaaaaattcaaaaaattgcaacctctggcataaatgggttaatgcttctttgctcagtttcaaaggctagattgctcagtttcaaaggctagtgtttttgtatcctttgcctgaattcagtagtgctttgaaaatgatcgaagtgtttcatatccccagttctcaaattataataatgaagttttcaaatgaaaatcctaggattgttttaggttctgtttgctccattccactgtgggatacaagtagaaattgggacattcatccaataaaatgtcactggggaaaaaaattttaactacacttcaaaatgattcctctttttgtcctttaaaatttttattgaccaagacagatttcaaaatgttttctctaataccccaaagtgaaactttgattgaggttttcaggaaattccagggatcaagtatgtcacccggactttggtttccaggtttcccaaagccttgaaatttccctacagtctaattgctgtttattgccacagaccttcatcctttttcttttgtaacattttccatcttaagaagggtcgtcccattcggccgaggagcgtgttgtctgagtagctgaatggaattactaccagtggaaactatgctgcaagagaggttgataaagcagctgtgaagcaaacctcagctgttttttccattctccccaagcaaagttaattagcatagggaaaatgactaaggtgttgacgtcacctctttccagtagaaacttacactttgtccctgtctgcctgcaagcatgcaggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggtaaggcttctaatataacgtgattttctttagttttcaaagcattatgctaactgggactattaactgaatacttgggagaatgtggctctcttgtgggtttgggggttttgaaagaaatccaaagtctttcgagccttgaaaatcaaaagctgttgcctgaggaattaactgaggaaggaatttctaaagatctcaatatttgacaacatccaggcccctgaaccaactcactaggaaggcgagagttggggcatcgtgtgtttttcattctgtgtatgttgtaagtgaacttttcagaaagaggcctcttctgacagtgaatagtgttttacttttgtagccagcgttgtgaataatttcatttcgtcttaggaaataaatgttataaagatatttgtatgtttgtagtaattatgagggcctggcctcaagctcccagatttctctaacaagagaaaatgccgccagagcaaataataaaactggagaaattaagtgtgagatcagtgtgcctcctgggcagcagctctctttgatggtgattaatataatcattttaatcactacacttttcttcttcatttgattaaaatgtaagttttttcatcagcagctatccggctaattgagctttaataatactgtataggaatgaatcctgtatgctctatttgaggggtggtatttgtgcctggtggtgttatatgctttatatccaaagccatattgggacatgcgaaggtttctttttttaaaaaaaatcaaatgtaactccataattgtatataatgcttatgggctcgcaccatagtgtttggactagattgcagagcacattctatgtttttaaagtactacaaagtgagttcacttaacatgagccttatgtgagtaaaatcactattttttaaatgaagtagagatgccatccaaaagctataataactaggtatcagttattagaacaaataagattcttttataagagaaaggcatcatagtaatctagattttaaagataatgtgaattctcttttgttctggtcctaagccctgaacctgtattctaaaaatattcttcaaagtcatctctcccaaattctgaatcataacttcaaaactaaacagtgggtcacagtgcctattgatgaggtcatacaaaattccaaatgtacgaagacacacttttgccagaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggtcctcagtgagctctgtccgcgctgcctaccatccacaccctgcgccatccccttcttcctggccagccccttctgcctttcacacgggctcccacaaactgtcctaagtgtttttgcctggtaaaaagattcacaaaacccggcgactagaagcccatgcagtcttccttggagctttgactgtccaccagttaaactccctctctgaggagttgcagtggcccccagctgcccccaccgacagccacactccaggacccagcctagggggctgtcccctgagcaacctaagcttgtaatcccccacctcgagctttgcattctaagagctcaggacatctcctaattctcactagccctatggcaccagagcgaggtgtgcacagacacgaaagccaggatgcagaaaatggtccatttgcagaacattaatttttaaaccagtatcattttagagagttaaaaagtaacagactgagataaaagcgatcgtggaaatttttaaaaactacttattttaagaaatgcaaaactttctaccaactttgttatttttcaagtcagtatttctttttttcaaattagctgcagttcttttaagccttaaagaaatctttgatatatgcaacactgccctgagctgaacggtggggttggagttggctagccggggaaggctataggacagagaaaaaagggggggtgagtgggggaaggccataggacagagaaacatggggagcaaattaccaaactgtacctccctggaaaatgctcattctactttttaaaaaagtttgttaccgtaagtagtgtctatgtattggcaactgttctgctgattcgatgaatgtaataaatcataccttcttaccttcttgtaaaatcacctgcattgggactaaaggccatagtcccctaagaggggaaaggcttttctctaagaaagaagttaggagttcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcgaagaaaaaaaaaaaagtaatgacatcatctagtcaagggtcatatgcaggtaaatttcaactccttttatttttattgttatttttcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcaggtgagttgggttcattgctatgcatgcttctccctcctccctccctcccttttgtaaagcagcttatacgttgcttatgttatatgctgaccggaaactctgagacttcaccttgagaaagacaaaattcctactctgaatgttcagcgtctcacttgttttaagaagatatcaaggtgcatttgaaagcaacctcagacattgcccctgaccttcctgggttgataatgatgggggaaagaaagccttccctgttcactggggagcttgcagggtgcagcggggtaggcgtggctatgcaaacaccctaaggtttgcgcagcaggtttccatgaatttgctcaagggttggagctcatgacccactctagactgagcagaccagagtggttccctgctcatgtggtgctgggggtactcagcagagaaacaggagtctgcagaagatgcctgcaaatcagcccaggactgccaggtctggcttgaaaggaaaataggggataaccagactgggcgcagatgctaagaaaccctctggttggcagggttcccagccccagggcacccacggcagggagaggggtagctggggttgggcttgccttttctcctgcccactaccattttgaccctcctctggggaacttaggacaggtgacccaccttcaaggcagctcccagagttccatttgatgtccttaggggctgacagattgtcagggaagaagagaggagcttctagaatgcagccagctcctcagtaaagcaagtccccctcaggctctgagcacccccccaacccgcccccaccacacacacacatacacacataccttgctgggatgggagaggaccctgtccaaaggcctcccccagtgggaggaagctcatctgacaccacgccagagagccaaagtgtcttttcttcctcaaagtgaggacagcgaacttgctgggcccttcaagtataaataaagcatttgggatccccgccccacccctgacctttttgccctgggaggcacaggctgagctttgaccttgggtgcctaggccttcctgtgtgagtacactcctttctgcacgggataagattttatgcaaataattacttagtactcctctgaccttttctgtttgtaaaacaatgcatattcattgtgaaaacttggggagggcaatctggaagtgcagagaaaacctacaccgcgcagcttgagatgtaagagctctatggacagccctctcatcactggtcagcatttctaaaaccaaactaggatcgtaggttattgttccttattcttatttcttaaagtctcctgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcttacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgattctcacctggccttcttaaaggaaaagggaaggagaaccataggccatggtgagggaagggccgcggtcgggctgccctaccccagggcctgtgggctggtcccctacagagcttgctaaagaaagaggaagttcccgtcctctggagggacaaaagtgtgagcactgcggggagggggtaggttcctcaggctctttgtccaaaatgtgggccttaactggtggaattgtgagcagtagatgagatcatcgagtgaaaggcacttccatcagcacctggctcacagtcagtgttcaatgcaggatttttgaaaaccataaaatgttggtggttcctgtcctgtcctctagggtttgggtgaggaggcaggtgtgagggagagtcttggggtgaagaggtttgagccttctcctgctctgtccgtggagcaagtcaaataaatgctgagaccgtcagctcctcatttctccttgaccagcaatctgatgttcccttgggttgagggttttgttttcttggtccatcagcagtttcatattgaaaagattacatttctgaaaacattgtccaaacggaaattccctctgtgggataaagcaagactcacattacttactgctaattgtggcgtgaaggtcaagatcagaaatggccattttgaggaagcgtgtgctccccccacagcagctcctggcccgggggcatgagcatggctgagggtgtggagtcttcccctaggttaggaatgggagaaaacagggtctccacttgcaaagaggtgtccacagttccagaggcaaatgctgttaataaaaattctgcatactccagaatataccacttccttcaccgagggcttattggagaaggctttttaggaaatagacgtaataaaatcagtttgtccttggttcacttaacagtgagcttgagtgagatttcatatttcacctgtgcttttcaaccaacaggattgcggagattttgcaaattatggtcctaaaccctgagctttctggattttcgatgattagtaggtagataagagacttgcaaagaggtagatttgtaagaggctcttaaccagcattttcagcaatccatctgacctcccatgcctgaattctctctctcagagagctgagctcctttgcctttttcagtgcagttataataacattccagtcccacatgtgatagagaaaagatcaccaccttccttatcagtaaaagtaccttccaggtttagaggagtaaccagtgtggctggaggtaggaagctctcctgggccgctcttgtcgggcggaaatcacacagtggttggtgcggtgcctcctcgcttacccgaactgcaaagaaatcccaagcacaggccgggcgcggtggctcatgcctgtaatcccagcactttggaaggctgaggcaggcggatcacgaggtcaggagatcaagaccatcctggccaacatggtgaaacctcgtctctactaaaaatacaaaaattagctgagtatgatggcatgcgcctgtagtcccagctacttgggaggctgaggcaggagaatcacttgaacctgggaggcggaggttgcactgagccgagatcttgtcactgcattccagcctgggcaacaggcaagactctgtctcaaaaaaaaaaaaaaaaaaaagaaagaaagaaagaaaaagaaaaaagaaaagaaaagaaatcccaagcacaaagccctggaagaaaactgaccatgaggccacaccctgtgggtggagcaggttgaagcaaacctcctgcccctatttcagatccctgcccagcagggcaccaataacgatgcagtctccattcttaaacatctttctaggtgacatgggctggacaagcatgtggtgagccgggttctcattgcctcgggcactcactcatgctgttagctccatgaagtcaatacctttaccgtctcctttactgaggagggaactgaggtgcacagggaagcagaataaagtgcccatgagccctgggtactaaggagccaggctcagagctgccttcatgagcaccagagatgcacactcttcccgtggccagagcggcaccccagcgggaggccccagtcccttcattctacattgccgggtttttcagttgcagaaagctctccccacccttgctggaccagagtggcctgaacttggccaacctggtagaactcaggctgacatagaacagcaggacactcctggtcccggggattagaagttgttctaaggaaaagatgcccaggtcaaaaacgtttccagagcacctggctccgtgcagccacccctgcgtctgctgcagggcctcctgtggcgcccttcctgggcgtgcactgcgaccctcaaataggagctgcatgagggaggcccagggttctgtttccaaatacgtttcttcatccatctttttcctgaaccgaagtttctcacattcacacttgaggaaatgctgacagaaagggagttctctgggtagtttagatatctggtggacatgtgaagtataactagaaaaatgcattccttctatacttctcatgtgcctggactcccagaatgtttgactaaaaacagagtcatgcacaatggaaatctctctttttctgaatgagctagcaaagaaatacaaacccaaaatatgtctggctgtgtctctcagcccaatcgaatggtcacgagcagctggcccagcagagccctgaatgctcttttatgtttgccttttgactcccaaggacttgtctgagtgaccctgcgattattttccctccttaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttctaaattctgcagtttaaaaggcttttaaacctttttaaacattttaaattcagaaggagacatcctttgtcaatttgagcttagaaactcctaattctgtgctgtggttcatggagagtccaccacactaagaatgcatcacttgcaaaagaagaaaatggataaaactgaaatcagaacttcgagtatttcgtttgtacaggtagatgctactgtgatgaaacccctgttcaccagcacctccacaaaacagcaatggttttggtcatttgaagagctttcttttctattagaaaagatgtccatggaagatactaagttatcttcagaagatgcatctgtaagccttctgtttaatctctggcagcttttcccctgaaagtctcatttcaaatggtggtgaccttcctgggaagcccacaaaggcctaagtaacccagtgtttatttgctgaaatctaggaaatgacattaatcctgatcaacattagcattaggcgtttatctatgaaaattcacatgctacttttttttctctgtcttgagaaccatgatcctgtcatttccaagagtatttgcacattttcaagccatatatgttcaaggtttaatcgtgctggaaaatccacacttccaccaagttggtcaaatctgattattggacagattcaggcattgacccccactaaggacaggcaggaaatatttccaaatagagactctcaacaggtccccttagataaaggagggaaaaagtcagtggtcccactgccagtgaagccaatagaccttagaatagaaaatacaagtcaaggaaaaggctcactcaggacagcctatttcttctgagttgttctgtggaagcctcagctgaaattgtaaaaccaataatgcacaaagtttctggttcccaggctgatgggcctgaaagtaattgaatcatgaatgtgcccaggacccacgcattgctttgtaggagaggggttcagtcaaatgtgaaacaaccgacattcaacaggcagcatcatgcaggatgcacactttgccattgattgaaagtgtttcttcaataggctttgatagaatatgttactaatctgatgggaaacagcttagggccatgcaaaaaaagaaaatcagcccctggaaatgagtggctaaatcaaagcgaagggcagtagaaggagaggagcggagcaattcatggagctattcagacacaagctataaacattgatttgaagtcagcaggcatttgggattttacatttccagaatattgtgtgtgaattactgcccacagaagatttgggttttcagagagctttaattttctgtgaaatgtgcagaactcactacaaaataaatcgattttctcatatgttaagttgcaggagattaaaagcactctatggacgtgttatgatcaaaagtgaacgcgcagccaaagtctgtcacacttcacagtgcccgtagaacccgcagaaagtttgcctgggtatcataggtacatatccagtaacattcacccaaaggtcagtgactcaggtggaagctgcatacataattaccctaaaaattattcaggaagaaggtccactatgaataacaagtactcttccctcctgcctctctggcctcctgattctaaagtagaacagggagtagaacgtggaggaaacttttcaagtatatcaccactcttggcaatccttaattcacatctgaaattctcactccgtgactcaccgaaagttacatggcaatcaggtagatggatttgcttctcacatacctcattttcttccacaatccttccctgctgttcgtgaaaggtcatttcaatcatagctatgtttatgaaagacagaaggaaattattcacaagtgattgaggtgtgctgcctgtgcccaccgtttctccttctttcaggattctgatgagggactcggtgac

SEQ ID NO: 12365 - DNA, 7179 bp, Human
gcttaacataactcaggtagtcctcagaacaacctggttgttccgtttcacagatgagaaaacggaggtttagagagactaagtgagtttcccaaagtctactgggagagccaaaactgggtataattccacaattcatcaactttccactattactaagctgctgggcctcagttctctcatttgaaaagatggagtccagctcagctttttttttttttaaacaacattaagtgtgtgcttattgtgtgccaggcactgtgctaagaacttcacatttattatgtaatttcatcctcataacattccctgaggtgctatatactattagtattatttctactttacaaatagagaaactgagcctcagacagacatatgttgttaacagagcgactctgaggcccagcccgagtttaactgaagcttgttagaatcataagccagactcttgcctattttcctgtgcggcctccagcagtctctggcagcctttggagtgaggacatcctgtgttcctccagaatcagaacaaggctgggatggacgtgggatgagttcctcagtgcgtgggcctctcttcctttggatttcaaagactcacttcagtgaagtcctgtcaaagtcaaaaggtgacattgaatggacagtcggcccaggctcagagtccagtcctggcacctcaagggcttggctatttcctctgatcctgttgtcaaggcaaccttggatccctttgtggttctgtggttattctccctcttgtgtccttgtcttcctacggtttcaagagaatactttagagacagcggctccaaatggcctacttgtcactgattgaaggagatgctgacttgagataaaaacagttcctaggacccttcaaggcctcaactagaaaaggcaattctctgtaaacacgttgagggcagaggttgtctgtcttatcatagctgtaccccagcacctcacaggatgcctggaacagagtaggtgctcagttaacgttaagcaaatacatgaatgaatgaatgaatgaactgattatgcaaacgagctccctaagcttttcaggggttgaaaaactggggcagagtgatgggctaagatatgtggcagaactaagaataaaagtgcatgtgtgtgtgtgagtgtgggtcccacggcaaaggctccacaacccctgtgatgcattggcctgtgtacctccacctctcctctccacgtcttgtgagctagagctgttggttgggtatagacagttcctgcccacgccaggctaaagaagcaatctctctctctttctcttcctcccacccccgtaaattgtggcaaaatacacataacacaaaatttaccatcttaagcatttttaaacgtatgttgatgttattatgcaactaatctccaggactcttcatcatgcaaagctatctctttaatcttgtgtccatcccaattttacctactattttgaattttagctacaaatagaccctgggttttgacctctgtattgagtcttagtgtgttacaggacagtattggcgaccaacaaatgttcactgggtaattgatcttactctgtgttttatttttttcctgcgtgcttcaatttctcggtttacaagcaattttggctttgtgatgcatcccacaattacaagaacttcttcaccgccctctagtggtaaagatgaagatgtgacactcagaataaccattcgcctttcctgctgatgttgaacatggcccctttttttctgataactcgctggactttatataatccaaaattgtgattgctccaaagttggcagttcatcctcactttacagataaagttgacctgtagaacagtgcttctcaaattggctggcgaagaaccagtttttaaaagaattttaatctgcaaaccaatccattgtacaataaaaatgaattattaatactggacacattacattaaaaaacaaagatatacaaaattgaaccaaattttattatcatattcaacagacaaaattgcatttcaataaatataatcagaataaacataacgggaaaaataattgcaaaatctgtacatgtttattgaatgtgtgtattatatgattaatatataaattgctattgcatttataatttttgttgttctgcaattataactaaatgaaaaattttgagtaaaatagtgtttctctactttgaatgaacaccatgcatatcaatattgagcattcttaatggacaaatacacaagttatggcttgccaacctatctaacccagccagaatggactataatgctacttgcaaagtagaatgtgtgatgagattgcttctatttttgttgttgttgttgtaatttaataaagaataattattttatttatttgtttacttatttatttattttagaaatgggatctcactgtgtcactgaggctggagtgcagtggcaagatcatagctcactgaagcctcctgggctcaagcgatcctcccgcctcaggactgcccccctccgccacccccatcccctgcctgtagctaggaaggactgcaggcacgtaccacagcacctggcttctatattttgttttaataagaggttagtggagaaccagtctcacagagctttgttaacgggaaaggaaaaagagattttaagacaattttaggaagctcaggatttccatctttcacttttattcaaaatgaagcaaatgattctgtattttcaaaattcgtcaattattcaattgccagttccaacagtttatcctgtagagttaaattgtctttcaatgaaagcaacagattatggatctatgaatttcccatgcacgaatcttcttttgatggaaataaaatgtaaatgtcccataacttgtttgaccataacattttacagatatgcaatatcaagattatcactaacatcactgataattgttgctaaactatggggcatgttgtaacagtctctggatattctgttcttccaagcttctgtcatttttgcccttcaatcttctttgccattgaaaatcatgctgcattttttctccctgcttagaagtagtaaaagcatttaaaatgccaaaaatatcacacaaagaagcatgcctattgtcccaaaccacattgggaccttataaagatgtttgttttactttctaggaacactaagagtttgtttcacagtcaaacattcctaatagtacttttctcttcagtaagcatcgtatctcacctacaacagttgtttatgatcagcttccatatgaacacatattataataaagagaataatctcgaatttcatgcattatcctttgcataactatttttttgctatgtaactacacaactagacactgtttaattcagctaacattttttcattgtaaaactttcctgattaaaaaaagcagtgcattgatttacattcttcaaacttagtatgcttttctgtcaatgaagctgcacattaaagcatcttcctacagcagtcttaaaccacattccttgacagtgtaatcctttatagttttatacatttaggactagttgtgcttgtcatcaatgaaactgaaaaaaattcttccactatgtttgaattgcatatatactacattaattgtcattttagcagtatgtgggcattcaataacttgcaatgaaaacgactttgctagccgtgtatctgtgagttaatctgccatgtcattagctagttactgaattcgtctagttatgaaaaacgacatttgagttactttatttgccacagtcacccataatttcaaagatctttgatacagtcttgtgctaaagtcttcttttttaaattttcgcatccccaaatgctgctttataagatgctcatacattactaatgtttatatgtgaaatattgaacatctgttcttatgagttttttaaattcaacattctttcaaggtattctttaggttttgaatttacttcttttgttttctatgtaaatgctacataaggttgatggtcttatgagctttattagctagcatatctctacaaataacatactatagttttagaatattagtgtcaattatggctacaaaactgaactcaatatgtgaggaattatacttctgagtaaaactagtacaaactcttttcgtagtagtttaatttccttggaatcacttccatagtcatcatctgttttactattggtgctgctgtgcattagcaaaggtgtgtcttttcttgatgaaaacaagtctagtgaagtttgttttgtcacctctaaattacagttaaaaattattatgaaagtctgcttcctaatttagctaatatttttgttatttattttttcaatttgaaagcaatcactgtttattaactgatcagattacagaaataattgtggcacacaccatagttcatccttctaaggagctttttgatctggttgtccctgttgccagcatctccaccttctacaaaataggtggtcttttccttcattcctcctcatggagaagataatttgaaaggcctgaggaagttatttgcttctttgaagcattttccaacagcacagacctcatgaatcagatcctctgcacagatgattccatatttaccaagagatcaagccatcaaagtgttatctgtcaagacaatttgcttcatattgattttgctgtaaccacacttggagactagttcatttactgaattcaggttcggagactctcatgcaatatatggttctacaatcctcagcatgtaaattgaagcactgttgaacttaacaaagtttctgatgaagatctgacaaggcaaagaagctgccacacctttcggacccttgggctgccaccactgagacctctgatcctaatgatcaatgccaatttgggttctgcaggtacacagaagttgccagcttttcttgccattctagccattcatatctcagttctatacatctgtctatattcctagtgatagtgtttagcttcttcatagataagcttccttccttcctttcgaagcatcctttgggcaaacttttttctctggcacttgatcttcagctctgcaaaatgccttcacttttacttaaaggtttctggcacagcaggagccttctttttcttctcttcaacactctccctggttccacccagaaaactgaagattttaaaattataaactaaaaaaaattagtttttacaaaaacattatatgtaataagtaaaaacaacaaaatatcaaaagaaataaatgcttttgttttctcagatttttacatgcctttggctttcagttgaccgactaaccttaaagtaccacacactgtagcatggtcctgctgccacacagctcatggccagcacctgaactggtctatcccttgttcagtgagacaggttccctaatgcacttgaatgtaaaactgctataaaggtttctaaacgcctgctttcaattaggtactgctctcctcatgaactggtaacaaacagtttgtggactacagggttctatggagcacaatttgaatagtgctgacaagaagacctaagtggtgagtaagtgctggatcacctttctcttagtctaatgccctcttcatttcctattttaattcagttttttcatctatcaaatgggcttttgtaaagattaaatgagattactcatgtgaagtgtttagcatagagcctcgtacagagtagatgctatgactattatcactaactcactagtgtaaggtaggctgatgacttcccagacacggattcccagccttcactatcttcctcaggaccaagcctgggggagagggaccagtgcatcatcagcattcaatgagcatagacaccccccagtgctctcctttctcaatcctttcccatttgaggagcttccatctgagatccttatctatgggtccgcatatcacaccactctgggaattgtgcacccaggagctatgcagtgcagtctacacagtcatacacagcagcactgtcttgattagccagagtcaagccttggcactgaaacacagtctttccttccaaatagtagaaccaccagctttcttcccagggaagttattatggtgaccgcaaaaccagcttagatgatataatcaggaccctcactgtctatcctttatccccttaacaaagcagttcagaaggagctgtaaccttggacattatctgcagatagcagagattttatttcatgacttccaactctttagctcaatgcatttctatagctaatgttcacctggatatctggcccagggctgataagttctgtgtggcttccttttctgggatgtacaaatgcagggatgaaggcaaattcagtgccctgggcaacaaaaggcaaggtcaggtaggtataaatttcaaagcacttaaacatgtctttcttccttttctgcagaaccataattaccactttgtcaaaaatgaaaaataaccaacaaatgtataagtcactatgtaattccaagggactgtatgatataccttagactagccaacagtctaacctttaaggtgtgtgaaatccaggtgaggagacaagacaaaagtatgaggaagcattcaaaagcactggtagtctaaagaacagcaaaggaagggctacacacaagccctcagcacaacaggctgtggatactttcatgcatgttaacagactccctgcccaagtgctatgccacctacctgattttctgcctccattccttctctgaggccaaggaaatcggcacagccaagcagaggtgcaatgacctctgagggcaacctccagtcattgggagatgagaattggtggacgagagcctctgtgtccctgtgctttggtgggacaattctgaagtatttatatggtttggctgtgtccccacccaaatctcatcttgaattgtagctcccataattcccatgtgttatgggagggacctggtgggagataattggatcatggggggtggtttcccccatactgttctcacggtagtaagtctcacgagatctgatgattttacaaggggcttccccttttgcttggctgtcattctctcttgtctgccgccatgtaagacatgccttttgccttccaccatgattgtaaggactc

SEQ ID NO: 12366 - DNA, 23155 bp, Human
  misc_feature (1)...(23155): n = A,T,C or G
aaagaaggtgaaggaaagggtatgaagtgacgatatacataaggtgtgtgcaggggctagcaagtgggttcattttcctggagtcaaaaatttggccaggatatgagacaaaaggctgtaaaagtaggtagaggttagattatggggggccttgaatagggatatttgggggctttggggaatgtggaaaggtttctgagtagaagaggtatctgaatgatgttgttattctagtgttaatttggcaacagtgtataaaatggagtagaaggagcccatacttaagaccatagcatccaaggccctatgtaatctggcgggtctatgtttccagcctcacctaggactgttcctttagtcatgatggccttcttattcctcaaatgtaacatgtttattcctgccttgagcctgtatattggctgtgccctctgcctagaaggctgtcaccccagatcttctcatagccacttcatccttgctatttctaggtctttttttctggaagaagttttctctaaccaatcagaaacctctttctcgttttgttttggttgttttgtttttgtttttgtttgaggcggagtctcgctctgtcgcccaggctggagtgcagtggtgggatctcggctcactgcaagctccacctcccgggttcaagcgattctcctgcctcagcctcccgagtagctgggactacaggcatgcgccaccatgtccagctaatttttgtatttttactagagacggggtttcaccattttggccaggctggtctcgaactcctaacctcaggtgatccacctgcctcagcctcccaaaatgttggaattacaggcatgagccattgcgcctggcttcccctgtcactatcccatcactttgttttaccttcttcatagcagtggtcactctgaagttatgtatttacaagcctatgtgcttccctccagctgagggaaggtcctgagagcagccttgtctgtctcgctatcgctatatctcatgcgatatgccttatacacagtaggccttcagtatttattaaatgaattaaaagttaaggggtgaggagatctgtgaggaaccggctatacctagttctggagttctggtttgagacttactgtcttaggcatgcatgcatccacttatctttttttttgggggggggcgaggggggatggagtttcacttttgttgcccaggctggagtgcaaaggcaggatctcgactcaccgatctcggctcaccgcaacctccgccgcccgtgttcaagcgattcttctgcctcagcctcccgagtagctgagattacatgcatgcgccaccacgcccggctaatttttttgtatttttagtagagacagggtttctccatgttggtcaggctggtcttgaactctcgacctcgggcgatccgcccgccttggcctcccaaagtgctgggattagaagcgtgagccaccgcgcccgggccccacttattccgcattcaacccatttattaaaccactaccttgcaactggacgctaaggttatagggaggaatcagaactggatgctgtccttctctcgagatcagtttagtagactcagtgacagcagttgtgcttctcaagaaacactgaagggccatgttgaggtcattctcctccagggatccagagtcagacccaccctctttccccagaccatttctggggaccaaagcaatccctgcattccactcttcctggactgcagaggagtcgccgatcccacttgggtccggagtcagggccttcaggggtccgggaacgccgccatcccggtgaatctccccttccgtttctagggacccgggaccggagcgccgcggcccggccagtgggcgggaaaccctgccatctgccgcgacgccggcgcctctccgcggcggccgggggcggggcgcgccggggcggggccgcgccgggccggaggaggggagcgggcccggacgaagccctgggccgggagggccgcggccaccggaagagtcgcggtcgccagtccagtcgggagagtggggagcggaagcggcggccgcggcggcggcgggcggcgctgggacccggtagcggccggagaacaagggagctggcgccgccagcacccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcgggtgaggatggcccccgccccgcctccgggagccccggccgctctggcttctaagggatgacgcggtccgtttcgacttgcctcgctacaccggctcctagccccgctctgacttctaggggcgactcggcccatttgggcccctttggttccagccccagtagcaactcccgtttacctctgaagaggggacgttggcctcccttgtttaaggggacgtccaattccccactagcaatcagagttcctgccggtgcggtccccttacctcttcagagaccagtggcccacagagacagacacaccccccctccacctagtttcagagcccgagtcccccatcctcctcctgccgaggagccagagccacctttttccgcacagacttgggtcgtgtggccctcgttcttcgcccccttcatcttttcagcagcacagctcccagccatatttggagtatgctgcatctgagggctctgctgggactttgagctgggggaggggtgtcgggggtgctcgggcgcctggccgcgagcggggtctgcagatctgatgtttatctagctgcctgccctctcctttgtgggctgttgtgggtgttgtcaccggaacagagagcctgacccctgcggagtagtcctcactgacccaggtgctgatctttcctccaattcgggcttttttcctccagttggtggccagtggagagacgttaggaagggcctggggcctgggtgggatagccaggaagagtttcttggtgttctctatcttcccctccctggtggggtcttcccttccacccagctgcagagatctggacaggcacagtttggaagcagtcactttccctttaagaggggatggaatgttggagccggaaggttctgaagcagctggcctgggaagaggggggcctggctgatccccctcgaacccccccaactcccaggagactgggggagggggaggcgcccacacttgcctgccgcctcactaactgggcgctgggcctggaggcggtggggaaggcccctccaggcctgaaggctgcctctccagccctagcctgaggcctgcactgctctttggagctgaggccccacagccaagaggagacattcttctccccagtgttcatctgtctggcttctctcccaagcccctggcccacctagcactaggaagcaagcaccttctgtctaatgcctggcatgttttgctgtcaccttctgccctggaactcagggttggatgagcccctgaaatcatgtgtgtgagagtgctttgtacagtgggcagtgctttgtagattctaactattcttgtttctgttgttgttcctgccctggggtggggtgctcctggtgtgataatgattgtctgccttcagcccagagacagacacctctaattggaagattctgaggagggatggatctagaaggggtctgggtgagggggtggatactttggcctggcaagagaagaatagggttagaagggatcaagctactgcctccacataaggaatgggggaagatgagccagagtccagtgccctggggccacctcagatccagatgccttgagggactaagataggctgtctctccaccctgtacttatctccagacccactggacctggcccctgcctcctaagcctggacaactctgggctgctctcccaatcccaaggcctaactgcagttttaagagggcccccattacatccagtcactgttacttaatatttttctttaaatccattgtcagtccacttactgtttttcttagcttgaaccaagcaataatatgaaaccataggtctgacttttctgtttatatttctttctaaaatatgtttaacataaatatttaatgattgaactaagcaatgttaatctgtgtgccacctgaagccatcttgcaaacatcagtggtacttgaaccaaaatcagagttggaccattttagcagggttgaaaacagtattaaaaatgaagtggaggagatggattctgtttgtatccccagaaggataaatgagcaggggaactgatagagctgtcttgtcacagaggactaatagctgaagagcatatatatatgtttcatttatttaacacacgccttttatgcttagtgtgccagggactaatctaaatgcttttcaaatcttcactcatttaatcttcgaaacagccttatgaaatagatagcgtaatagtatctccagtttacaaatgaaactctgtcaggcatggtggctcacacctgtaatctcagcaatttgggaggctgaggtgggaggattgcttgaggccaggaatctgagaccagccttggcaacatagcaagaccccatctctacaaaaaaattttttaattagccaggcatgatgctttgtgcctgtagtcccaacttgggaggctgagacaggaggatcacttgagcataggagtttggggctgcagtgagctgtgatggtgccactgtactccagcctggaaaatagagtgggaccgtgtttcagaaaaaaaaaaaaaaggaaactagagcacagaaagcttaagtaacttgcctaaggtcacacagctaataagaggcagagcagagcttgctttgacatcaggaatctggatccaaaaatctaaatccttaatcgcacaattttaggtgtcattattatcaccattttactgatgaatcctctccgagggaggtggtaagccttggaaaactgtagaggtgacaaggccaccatttctccgagccccacaagaggaaggtcaggcggaggtcagtgaccctagaggaaggaaagtgggtcagaggaggaaggctgctgtctctccagtttctccactcctggctcagcctttgaggtgctagttgtgaggctcctcaagtcccatctggtctccaaaagtatttgtcaagctcagggtaggcccagccatctttttaaattttttttcttttttttttttttttgaggagttttgctctcgtcacccaggctggagtgcagtggcgcaatctcggctcactgcaaccttcgcctcccgggttcaggtgattctcctgcctcagcctcccaagtagctgggattacaggcatgagccaccatgcctggctaattttagtatttttggtagagatggggtttcaccacgttggccaggctggtctggaactcctgacctcaagcaatccacccacctcggcctcccaaagtgctgggattacaggtgtgagccaccgtgcctggtatattttatctttatatcctgacacctgtgtaacactcagcagatgtctatccattgaacacatgtgctgctcctacggctccaaccacttcctggattgcagtatatttccatgaactatccactggaccatagtctctctgagaacaaggcaggctctgggtctgatgtttcatgagaaaacctacaatagcaagctcaggacctgaaacccactgggccctcagccaaagcattttattttattttatttttatttttttattttttatttttattttattgtatgttttttgagagggagtctcgctgtgtcgcccaggctggagtgcagtggcacgatcttggttcactgcaagctccgcctcctgggttcatgccattctcctccctcagcctcccgagtagctgggactacaggtgcccgccaccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaccgtgcctggtatattttatctttatatcctgacacctgtgtaacactcagcagatgtctatccattgaacacatgtgctgctcctacggctccaaccacttcctggattgcagtatatttccatgaactatccactggaccatagtctctctgagaacaaggcaggctctgggtctgatgtttcatgagaaaacctacaatagcaagctcaggacctgaaacccactgggccctcagccaaagcattttattttattttatttttatttttttattttttatttttattttattgtatgttttttgagagggagtctcgctgtgtcgcccaggctggagtgcagtggcacgatcttggttcactgcaagctccgcctcctgggttcatgccattctcctccctcagcctcccgagtagctgggactacaggtgcccgccaccacgccctgctaattttttttttttttttttggtatttttagtagagacggggtttcaccgtattagccaggatggtcttgatctcctgactcatgatccgctcaccttggcctcccaaagtgctgggattacaggcctgagccaccgtgccctgccagtcaaagcattttaattggatgaacaatgaatgatgaacaggtttatttgctttgcccttaataatgtatacgtagttagaaatagtgtatggatcctgctaaaaatggacaatataattagcttttactgtatgcctggatcatgccaggcatttaaggatcccttttaccaggatgagacaaaggcttggagaaattaagaaacttctctaagataagagggccagtaagtggtagaattggaatttgagtcattatttgtttgactccatttggggtatgagtgtgtgtgtgtgtgtgtgtaagtgctatgtaaaccccagccattcagctccatggtgggagagtaagacctgtctgaggttccccaaagctgctgaagatcagctgattgttttgagtcagcagagccttggtggcctgtcgatgacccccagaaagagaggaaacgtgtagtgtggagcagtgtggtggggcctgccaggggagcagggaggtagggactcagcagcaatttcccccagacaggcagaccctatccaaagcaggctgtgccatgtggcccacatattcccttttcctttgagccctgtggggctgccaacctggagtaccctgtggccagagtggctggtgggtctgagctacctctgtgtcccttctttctagcctgtcctttctacactttctgccatggtgggccgcagtaggatgatttgggctgctttccgagggtcgctgtggctctgggaatgatagaggagccagagctggatgggagtggggagggcaggcttggcctgtgaacttggctgtgagtccaaaaatgtgagcatcacaagggagccaagcacattcccagctctgggcagaagctgctctaagaacaaggggggccaggcacggcggctcacgcctgtaatcccagcatttggggaggccgaggtgggcgggtcacctgaggtcaggagttcaagaccaccctggccaacacggtgaaaccctatctctactaaaaatataaaaattagccaggcgtggtggcaggcacctgtaatcccagctactcgggaggctgaggcaggagaatcacttgaacccgggaggcgcaggttgcagtgggctgagattgcaccactggactccagcctgggtgacagagcgagactccgtctcaaaaaaaaaaaaccaaagaacaagtggggactgaacttcccaacctcctccttgctgtcttccctctctgctcagagctcctggcatgcgtcatcttacccttggtcatgtcttcccatctctgtactcctggcatatttgacagtctgagggtcctcaaacttttccactccccttcctagccccaaactgtagttactgcctgacttcttgcctcaccacattcccccggccaaactacatgccccgtgaccacattccacacccttcatgcctcacatcattgtcctccagcacccactctccacatagacccacattacctctgttattatataggaaagaatgtgaaatacagtggaaagagtatggattttggagtcaagcctggggtgaaattccagctctgacatctaccagtcctgtgaccttggacaagttaactgaatacatctcagtttccttattcatgaaatgaagatcatagtctgcccactgaggctgatgtgaagattataggttctaactataggaagataaggtggtgtaatggtaagaatgcagatgttagagtcaggctaaccaggattcaaatttcagcagtttaggagaattactgaacctattgagcctagtttccccattgtacctgctgccttatagcattgttgtattaaatgaaattatataagtaaagtgtttagcatagtgcttggcccataatactcatttatgctcaataaatgacagcaatttttttttttttttttgagacagggtcttgctctgtcacccaggctggagtgcagtggcacaatgatagctcactgcagccttgaactcctaggctcaagcgatcgtcccacctcagccttccaagtagctgggaccacaggcatacgctaccacgctcggctaatttttgtatttgttttgttttgtagagccggcacctcgctatgttgaccaggcaggtctcaaaactcctggcctcaagcgatcctcctgccttggcctcccaaagtgctgagattaccagcgtgagaaagagcaattattactgttaattatcataatggcatgtggaaaatgttcagtaaatgccttctccccttctctttttctttttcttttctttttttttttttttttttgacacggagtctcactctgttgcccaggctggagcacagtggcgtgatctcagctcactgcaacctccacctgccggattcaagtgattcgcctgccttagcctcccaagtagctgggatcacaggactggtagatgtcagagctggaatttcaccccaggcttgactccaaaatccatactctttccactgtatttcacattctttcctatataataacagaggtaacgtgggtctatgtggagagtgggtgctggaggacaatgatgtgaggcatgaagggtgtggaatgtggtcacggggcatgtagtttggccgggggaatgtggtgaggcaagaagtcaggcagtaactacagtttggggctaggaaggggagtggaaaagtttgaggaccctcagactgtcaaatatgccaggagtacagagatgggaagacacccaagtagatgggtgcacaccaccacacccggctaatttttgtatttttagtagagatggggttttgccatgttagccaggctggtctcgtactcctgacctcagggtgatctgcctgcctcagcctctcaaagttctgggattacaggtgtgagctatcacgcctggcctccccttctcttttctaattttcttaaattctttgtccatacctcccacaacaatgttaggattcccacttaagaaaggaaggacagttataattgtatgcttttttccaattagggatcagagggaaagagaaagtctagcccaggagagtcatgttggggatgggtagagcactttagagattttagggagtggcatgggggacagtgatgtgtcagttgtaatttgcaatcacctgatgactgagaggatgccccgggaaggtatctggcctaggcagggctggtgtcttcctggtggtgccaaagagctgtctctgggtctccccaacctctgctttcatttgaacagtcttgtgctggtggtttgattcccagtttaggatggaggagcccctgagagttgggatttgaggatcctccatttgcaccctagaaggttctctgtgacatccccctttctctgcagagtggtgaaggagggagatctcggatgacaatgccaagctaccatgcttcaatggccgggtggtgtcctgggtaaggagccctcagccttccatccacctgcatccctgtgctgggctggacgagggaaaggcatcactgagattgtagctggtggttttaagcttcagtatctgaatctttctttagttttgcaaatgaactgcttctcaccccagattctgtaacctttgatgaaaagtgagaaattagtgggaagggggaagagggagagacggaaacacacagtggagacagtaacgtttcctatgccgttcagacacttgcctcagatttccttctgccatctgctcatctctgccttagacctctgagccttgttctttgtccccattccacttcaccaccccatgccttccaacaaccccgtcaatagcaggaagtggcagaggggccactgttcatctcagccaccctcgcacagccctgtcttttctccctcgatatttcctgcttccttcctcttaggccttcatgccttgctggaagtgaactatccccttctccttgatgctcctgtaacatactactcactcagtttctccctttcagctggtgtcagctgagggctcacacccagacccagcccccttctgtgctgataacccatcggagctgccaccacctatggagcgcacgggaggcatcggggactcccgacccccatccttccagtgagtgtgacctgagggtggggagggccgcatcagttcagcccagggctgggggagggagcccccagcctgccccctcccccatcaagtctcttccctgcagccctcatgctggtgggggcagccaggagaacctggacaatgacacagagacggactctttggtgtctgcccagcgagagcggccacgccggagggatggcccagagcatggtatatcttcctgaacacggacactgtccgcacctcacaccctcccctcactttccacccagctacccaccttcttgccctacttcccgagctcaggatatgcctggccccagtgcagcccctggcttgcctctctccctccttcacccctgcactgggcactgtgtaaacccaactgcttccatcccctgcagcaacccggctaaatggaactgcgaagggggaacggcggcgagaaccagggggttatgatagctcatccacccttatgagcagtgagctggagaccaccagcttctttgactcagatgaggatgactccaccagcaggtggggcttgagtttcatgggtattgtggggcaggtgaccctggaggagccctaaaccctgaggatgcggggcccctgggaggcttatgggctttgtgttggggacccaggccctgcagtgcctcccctcatgggggcagggctgggccagcctggtggggaacgactgtgggccccacaggttcagcagctccacagaacagagcagtgcctcacgcctgatgagaagacacaagcggcggcggcggaagcagaaggtttctcggattgagcgggtatggggtctgggaggctagggatgggtggaggcagattgtgagcccttcctacgcagggccaaggcttgttcttccttagatcccatccccctagtgcagtgttgagaaccttggggctgggggctgcaccggggactcaccttgaggaggagtcaggtgggagtgaattcctgccacctccacctgctgctcagggcctctgtctattccagtcctcgtccttcagcagcatcacggactccaccatgtcactcaacatcatcacggtcactctcaacatgggtgagtctgaggaaacagcactctcaagcacctgctatatgccagacactgggcagacttgagttcagagagcgtagaatatgttccctgccctcaaggagctctctttcgtaaacatcagctgatacataaactgatcattttagtatctcaccatcagggctatgacagagataagcacagagagctgtggaagcagaaaatggtatcagggaaggcttcctggaggaagtgatttctgagtgcccactccttcacatctctcagccattgcatccttgctctccgatttctgccctaggtactctctttatgagacagctggatatagtaaaaggagcccaactatgggatttaaatctgagtttgattcctggctctgccacttactggcttagaaaagtcatcttctaagttcactgaacctcagttgcctgctctgtaaaatgggactgagtccctaccttatagccagcaagggttccatggaagcatgtttgagcatgctgagtgcagtgcctgattcaggatcagcaaatgtcagttcagttcctgtccctttccattttctaatgggctgggaatgcgggtaggaaccttgctcccccttaaggtcttaaattactctctatagaaaaatataacttcttgggcatctccattgtgggccaaagcaacgagcgtggtgacggcggcatctacattggctctatcatgaagggtggggccgtggctgctgatggacgcatcgagccaggagatatgttgttacaggtatcagtgcccatcctaggcggtggtgtggatagagggcagggaggtgtcctaccatctgtaccctgctccttcagaggccccttcttggttgggggaagactccctgacctaccaagttgagttcccttttcatcctccccagcacagctgtttatcccactcctggtcctttcccaggtaaacgagatcaactttgagaacatgagtaatgacgatgcagtccgggtactgcgggagattgtgcacaaaccggggtatggatggaatggggcactgggcaaggggcttggtctggcctatacgcatcctgccttcactaggacacccttgttttcaggcccatcaccctgactgtagccaagtgctgggacccaagtccacgtggttgcttcacattgcccaggagtaagtggatgggagactcagtcctaaagctggtgcttacatacatgagcactgtctctcctttcttctctcacccagaacccccatatctatcctgttgggcccagcagtgggtggggtgggtagcccatgactcctcatcctccctgcaggcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgtgagtgtcccaccctgtctcctgggcccagcagacagggccaggtggggggactgatgagggtccatgtggagactcttgcttgagcatcagagagggctggagatggggctcggctcattccagcaacctcacactgcaactcccccacagcgggcactccaaccctcactaaacagtgtttgcttctgaacttgtatgagcacccagggcgcctcagtttcctcttacaaaatgggactcacgatataaactttaccaggttcctgtgggtttaatgagaggatataagtgaagcaccattgcgatgtgtggtgtaaagtaagcattcagtaaacggcagccatttcgattatcatcacatgcacatcgtacactggccaagcacctgcatttacattatttaatcctttattcaaatagccttgtaaagtagatattaaaatccccattttttacagaaggggaaactgagtgtccaagaaatcagtaattttcccagcattgatcccataattactagatggtagagctagaatgcaaactcttgtttacctaactccaaagcccctttctgcctcaccattctgcctcccacccccaggcctagacgacttccacttgtccatccacagtgacatggctgccatcgtaaaagccatggcctcccctgaatcagggttggaggtccgtgaccgcatgtggctcaagattaccatccctaatgctttcatcggtgagagagccccatggtgggatgcagggtgggtggggagtgatggggcagggcaggccggagggcccaggacttgccttggacccttcctttgatctggagccagccccagcctcatagcttctgtgaggccagatgagtccaagtcagatgggcctccccatcaactggcagccttgtccccaggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcagtatgtgcctccctcatcttcttgccctgtctcctggctgggagtggggaggtagccagggaagtggcagcagactctggggaacccaaactgggggacagcagagccaggggcccaattcaaggcctgagagttctatggtggaagaagagtccagtttagcctcttcacctggcccacatctccctcttgggcctggcattttctaagtgcctgctctgcctggtaccatgttggttgttcctaaagcatcatcttactcaatattcacaacctcccagaggcccagctcaggaggatactgccagaataggccttttccttctcactcgtcaaggtctcagctagggtgttgtaggcttaaagggaagaactggaggcctaggtagccccgaggagcacacagtcattccctcaaaacaaacagcctggaggctcacgtcatcaccagctctgggcaacagctgacagaccactgctttcctccaccaccactccccatgctggctgctggcctcttgacaggttgatggcttggctgcaggctccacaggcagcctcagagccctgtctcctgacttctctcttggaaggctggggctggctcttcttagggctgggaggaatgtctcatcttaatagggccggtggcctcaagggcagttgtagctctcttggagctctgggacctggtaccgatagtgtgtgagcagagggtgtcccaggcaggtattcagtcctggtggccccttatattctcttcaatgtagttccaacattggtgggagtagccttgccattaaggaatgtataatttccccgggggcgccaggatcgtgagatgagtaatgttggtggagtgagacagtgctatgaagagctaggcctggctgggaacggggtggagagcagtgggggaggcacctaagttgttctttccttctggccccttcccaccctactcaccctgcccagcagcactgggaaagtataatcagggccaagtaccttctatatagggaatctctggaaggccctgcactcattctaggcttttagtgggtatttagttctaggtgaaggggtgggtaacactttacctaaatttcccaaactgctccttgtcctaattaatgacctcatctgagaaggtaaggagaaagtaagctactcttcgcgtctgttctgattagtttaggctgagctgaaggtagtgttcgctattgtgcctcatgaacttcaggtgcgacatacctggtggctgtctagtatttcagccttccaaattctccagtcttgcaccagctgagtgaacggaagagaaaatggccacataagagttttgcaggccgggcgcagtggctcgcgcctgtaatcccagccttttgggaggctgaggcgggcagaccacctgaggttaggagttggagaccagcctggctaacgtggcaaaaccctgtatctactaaacatacaaaaaaaaaaattagccaggtgtggtggtgcaaccctgtcaggaggctgaggcaggagaatcgcttaaaccagggaggaagaggttgcagggagctgaaactgtaccactgcactccagccttggccacagagcaagactccgtctcaaagagttttgccgcttctagcccactgaggccagcagagaaagtgcaaaagcttggccagggccttcaagggattgggaggtacagctttggctgagaacctagaatgatgactcagggttgtcctgagaagggtctccccggggctggctctggtggtggcaaagggggtctgcagaaggggggagctctctgggctgtgcctcctctcattctagccagaaactaccacggtctctctcatccagagcccacctgacctaggctagggacctctctccggaaagacctagctccatccggccctccccttcacagacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggtaaggtagaggggccgtggaggaaggctataggtgggccccaggcttcccccgcccgctcagcctgccccaccccggccctgtttgcctcctacaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattattattttatcattattattatttactctaaattggtagcagtttagggtatttttggaagataaagcttttgcaaaggtagaagtgaagccttgagtgctggttcaaaaattagaagtgcctgtattcagtcacttaatgacttcaggccgtgactatgatgtgagagaggtcagatcttcatcctgccacatcgtggcttctggctggaggctgggaaggactgtaacatttgcaaccagatctgtcctttcttgcccttccttcctcccatgacaggcgtagtcctgcccaaggaaggcagcagtttatctctgcctacagaaagagaagagccaacagattttcttaagactctgcaagaaccaagcaggcctttcatgtgtgagggttgggtctgtctcctcagcttggatgtaaagattctgtttatcaaagaggggatttcaaatcccatgtcaaactaaattcaactcttcgaacgtcttctaagcaacatatatgcctgtcactagaaggcatacacagtcgcataggtatagctaaggagaacatcggctcgttcatgaaaagctgtagctgacctccgggaagagtgtacagtcatggacttatttgtgaaaaggtttagtttcttccaagtagtcgcctccttcctccccgctcctctccttgggtcttgatcccttggaaaaagctcatgtccggaacaaatatatgagaaaagcttgagagaatcagaggtagtgttagaaagcagtaaattcagcacaaacacttctactgcccagttgtatttatttgtgtgtaaagtgaggacagccagtcctgggactctggagacagaaaaggcctacagcaatccaaggcttaacagatgtgcttccacaaatggcattaatatcccaaagctctccagaacacaaataggaacaggaggaagtgcagggactacaattcccagagcgctcagtgaaaaaaaaaaaaaaaaaaaaaaaaaaaaaaaaaaaaaatgaggcgggtggagcggtgtatgctggaatgtgtatttctggtagggccgactaaggccacgcctaccccttcctgaggcgggggcggtttctcgaaggcagtcggtagttgtagttttgctaaacctagagcgcttcaaattgcaagcaaggaggccgcgaggcctgacgggatttgtagtcggcgctagacgccggcgcgcacgcgcagccggggccggggcggggcggcggcactgcggtgaaagccgaggcagcgggcagacgagcagggggcgggcggacatcttgggatccggagagtggccgggccggcagagcagggggccgaggacaccaggtgagccggggatctggccttatggcgtggaggaggacgctgcgggtcgtctgcctcgccgcgcagctttgtcctgccctgcactgagctggcggaaagctgcccacacccgggagtggcttcagccttcggacccgggagctagctgacggtggggcgggggcgcccggggcgcgattgcagggctggcggggagcggtgccctccacctgacccgcctggcgcctcccatgagagggataccgcttggaatcctcccagagcaggaacgctgcgcagcgccccctccctaggatcgtgccaaccccctacccctccgcgcaaggacaatttccccgtctcgtaggacagtgacacccctttgtgccgccgccttgcaccgtgacaggtctcacgccatgcggcaccccctcctcttagttcagtggcaccccgcggctcttcttccttagacctgtgacagcccccgcacccccatggcaccatcttttcccacaatgtcctccccaaggcgaaaagcctagcaccctctcattactctgcacctgaaccccaagcaggctctgtctccccagctttcccttattcaccactgtcagttcccccggccggtttttccttcttaaagccttgaccttttccatact

SEQ ID NO: 12367 - DNA, 29624 bp, Human
tagcggtaattctgctccatttgtaaggagggtgaaatgcgatatggtcatgtaccctcttggtacacaagttccataggctatagaaaaacaagtccataccctctgatatctgcattccttattcttgttatagcttacaaatcttctttagacacttaacagtgataattctcccagggaaactaaggaagcacatgagtcatgtttcttaactttaatgttgtataatctgaaaattatctatagatgctttttttttccattggtgctagaaaattccgcctaggctcaatcgatatccatttctaaacttctgcaagaaagctttaactgctttgacatgccaaaaatccaggtgtgaattaaacaacgaatgctttacctcgttttcaccactagttctaccagtcagaatcttttcaaatcatcctcagccagtgcctgtcatccacggcctggtaacacaccctttcacctcctcataccccgtgtcttcgcttttccagtcctttggctgccctccggtttcttccctcacatacctgtctgactagttcctagaagcctggcagaaattgttctccgattttaatctggctgccacaaatgaaagaccttggagtccaaatactcctctctcaaagcaaaatctaaatggatataatttataagcaaagataacacttctgtttttttctctataaacaaaccatgcatgggcttttaaaggagaaaaggaagagtggattgacagagaaaataactgtttaggatagaggttaggaaaagactgagagcaagagaaaaggcatcaatcccagttgttaatccacgaggcatcccccagacccttctgtaaaggttaatgaaggcagtaaggcagttatctctgtttcgtgcactgatgcaatccaagcttccacggtttagcacatagtagacgctctataaatatttattgaatgttgaacgatgagagagtaattaaaaaccggtaagttgatatcataaatacaacgacaacggctcccctatcaaatgtttagtgttcccagagacagccccattgttctacatctcgttatactctggccttttcccgtttttgtcattcgaactcatatacatattgaaatcgaagcacacacaaatccctgaaatgacaaacttaaatgctatccaaaggaagttacattaggttgctgctttgaaaatgaagtcaactcctaatgggttagctgtttctgcagcattctttcccgccttcttggagttgaggtgagggattaaacaatcaaccttctctctcctttctctcattctcaaagtttttctcgccttttctttcctttcctttgcttcatttcttttcccagtctatcgtttctctaggggtcgttgctttgctctttctccctctctgtctgttggtccctttgatcctttctttctaccccttattcccagcagctccagaaaataccttctttctccccgtctcacgtcacttccctcccttctcccatctccctctcctctccgagaggtgcgttccccactagaggccagcactttcttagtttcgtccttccaaccggcgagcagaactcggagagaaagaagggggtaaaaaagaggagaaagagagcaagagaggaaaaaacccctgggcctggagcgcagaggcccgggagctgcgtcgccatggcaacgggcgccggcaggaaacgagggacgcgcgggagggagggggcggagggcgccgaggggaggcggagggacggcggggggggggtccggctgccccggaagcacctccccgcagccccctcctccagcccggcccgcagcccctggcctgcggcccccaccttctcggccgggcaggaagtgacaggcccggagcgagccccggaggcctggctgagccgcggccgggcccgcacccggagcggcgggaggggcggggagccgcggtcgcgccgggcgcctcccaccccgccctcggcgcccccgcccctccaggaaggggaggaggcgaggggagcccgccgcggaggccgagcgagcccccagcccagcctggcgactggggaccccggcacatgaggtggacgcccccggggaagacttgggtgcacagccaggcgagaaggtaaccgggcgaccgagggccggggaggggcaggacctctgggggcttggctgcgcggggatgtatcctcagccacctccatctgtgtaacgccccaggtacctcccccagttgctttccctgcctacctccggcgctgagctctgcggtccttcggctctgcctgtccgagtcttctggctattcattctgctgcgcttcatgctgtctgtccgtcaccctagctgcctctgactgctcattttcttattcatttttccttctctgactttggtccttccagccgagcatgctgtctagttatctccctgctttcgtggtccgctgggttcctcagcctccagttccttgacttctgcctctgctctctgtatgcacatgtcccagctcacttgggtcagttcattcccggcgcaccactggatccacccccttcccccagtgtatttgatttctctttgaaacatcattttcatcaaggttctatatagaacgaggacccttgggcgtctactccctgttctcttgattattaccgtgtctttggcacagtcttccctgaaccacccccttctcccgtcccccttcctatgtcccatcctttctgcatgataagagtttcgtgcttagggatattgactttctccaactctcggcccaatgctaagtccacctcaatgtcccattctaactcccttcggtaggtctgtgcgcctacccaaccccatgtatgcccacatgctaccttttaagatgaccatggcttagctactctgggggcatctgtggatcagcttctcactgtcttccagtttaatttggaaaattttgatacctggtgctgcccaaactgtttgttgtctccatttttttatatttaatcttgtagtcataatgttgatcacaaatgaatacatttatgtgcccgggatccaggaatcctggttttggtggcagtttcccttgattttattgagacttttaagttggtccctttacatttttatttctagttcacaatccaaaaaaaattattaatcagaattcagttttgggaagacgaggggtcatacggtttgtattttcacatgtgaatgtaggaattatgttctctatacctagcaaaggggtctcgtgtctctgagtccagtgaactaaatccagtaatctataaaactgtgccgtgctgcctctaatccttacccactttttttcttcacatgctgataatgaggattcatgggtctgtatctgtttagtgctttgatattttggcaaaagatgtggggagaaggtagactagttgaagctgatatgatttttcctatgtactttttgggtaatatacatgtttgcagtgacatttgctagtcctaaatgaaactaaagattggggggggataatagtgtgattggatgatactgggaatgagataataagaaatatcctcagctttattgccaaggccaagcagtttgatactttgcttgtttgtttgttttggatgcaatccctaagaccagtccattcaccctaatgaaactgttgacaacacttagcagaaattctggtttgatgtttatattcttaagccagataatattttggtgacctgatatttctagtggcccagtgcctcagaagtagagaaaatagtgtgtagcttaacaaaagagaaaaacaaaaaaaaagaatgagtaaaaaccttattgtcatttagtgctgctttggaagaatatttcttcttctcatctcctgcctctttgcttggttcttagcaatgttttcatatgtgtctttttgcaaatgtaagtgtagtccccagtgggtaaattctgacatgttagtagattataaagttgcatcttactttcttgaagattttcattgtgtgtatttctatgtttcataccccggagtcatttcttaaaatgatatattacattcagtatgaagccttctttgcagtgaggaaacaggtataaggaaggaaagcaacatgcctgaggtgttattagtagcctgagctggaaccaggcagctatttgggctatgtgggctgtaggtgagctcttctgcttcctagttttatgaccttccatgacccactgaatgtgtctgtatcttaaggtcctcctccataaaatgaggataactactcactatcatagtgaatgacactgccttaattacagtttggtttgaagaagcatgtgttagtccaaagacttgatacttactagggcaacttctttaacctcagaaaaccttatgtctcaaattgtagaatgaggataacagtgttgactttacagcactactatgagagagatacagcataggtgaagtgcctagcccagtgaaaggaggcaactagtggctctccagtatatggtgactcatttggatgataacgatgcagatggagacaaaaatgagataaccaaaacttttaagtggaaagattttaaactgttaaaaaatgctatgggaatgtaaggtaactttggtattgtaaggtgccatctcacattctggccgttttatttaatgacagccatgagggaatacgtaaaggttgtttcttttgagactgcatagcttcaaaagatggtagtattgggaagacatggttgcaagagtgtattgaagatttgggagttttaagatgagaaatcatggcttatggaagaggaggaagattcttagatacttatggatttcctgtgtttttgaataataacatgagataacagcttgggatcaagatataaattttaaccttttactgcttccctctaggtcttgagtcagacagagcaccagccttggggaccctggaccactatcatggagactgagagcgagcagaactccaattccaccaatgggagttctagctcagggggcagctctcggccccagatagctcaaatgtcactatatgaacgacaagcagtgcaggtgagactcagctctgaggggccatggtctgtgagtcttggcttgtggtaggcagtgatgctggaaaataattgtactcagttctttttcaacaaactggggagagttgggttagatgatgactaagctgtcttccagctctgagaatcttaggagtttacaaatgtttaggcaagcaaacagtgaaatccggtctttcaaataaggatttaaaaaacacattcagtccatctagctagattctaactaaccctttctcatactggattgccaggtttttaatctttggccattcttgtaaatccccttgagtaatagaagtatcatggaactctttagagatttatttttaaacaaacagcaaattccatgtttttattaattctgttaggaaatgaggtcttttagcaaatattttggttactagaataactatacatatcataaaaatagttctaattattaaagaataagaatacagtaaagtccagttagcactaaaaccaaactactattttcatttcataaatctgtattagcatactgatatgtaaaaatgccaattagttgaattcgttgaaaattttacgtgaaggaatctttagaagccactatttattttttcattatttccaacccattagggctgtattacctttactgtatacctaaaatatacttttacattttctccttttttttttgagacaaggtctagctctgttgccctggctggagtgcagtggtgcgatcagtgctcactgcagcctcagactcccagttctcctatcttatcctcctgactagctgggactataggcacactccaccatgcccagctttttttcttattttctttacattaatcggcattttgtttattttcacccgatctagtctttgctatggcatgtatttccagctcccaattggagaaacaagtttgtataaattgcactgctttacttttcttaacatcctatggagaataaaccatagaattacattcacgcgtcacttaatgacaggaacgcgttttgagaaatgtattgttggacgattttgtaattgcgtgactgtcatagagcgcacttacacacacccagattatgtagcctactccgtacctaggttatacagtataggctgttactctgaccactcctgtgtatgtagtctgccattgaccaaacagtggatatgtggtgcatggctgtaattgtttcttccggtttttaaaggactatatagacttactgaggcagaaggatctctctgtttttttgagatggagtttcgctcctgttgcccaggctgcagtgcaatggcgcaatctcatctcactgcaacctctgcctcccaggttcaagcaattctcctacctcagcctccctagtagttgggattacaggcgcccaccaccacgcccagctaattttttgtatttttagtagaggcggagtttcaccatgttggccaggctggtcttgaactcccgacctcaggtgatctgccctcctaggcctcccaaagtgctgggattacaggcaggagccaccacgcctggctcagaaagatctcttgaggccaggagttcaagaccagcctgggtaacatagcaagaccccatctctaaaaataaaaaaaattagctggacatggtggtgcatacctatagtcctagctacttgggaggttgaggcagtcaggaggattatttgagcctaggagtttgaggttacagtaaactatgatcacgccactgtgctccagcctggtgatagagcaggttgactttgctctaaaaaaatgaaggaaaatcagccgttgacgatttagcccaaactcccatctcctctggtttctgtccttcccatggccccctttcacacaaatacagtgatttacatagaataggagctaggagtggtccattctaaatgttttatcctctcttttcctaggctctgcaagcactgcagcggcagcccaatgcagctcagtatttccaccagttcatgctccagcagcagctcagtaatgcccagctgcatagcctggctgccgtccagcaggtgagaggtcagcagccagctggcccgagagggaggggacaggcactacaggtgggtaggggagattttttgggcatatagcatcctatactaagccaggctgcagacagcctcctccgcctcctgtccttctgtgggaggatggatgcatcttagcttctggggttgcagtaagaaccgtaaaatcactttttaggtatagagtggctgtgttatagacctgcattgtctaataacgtagtcactagccacatatcgctattgagtgcttgaaatgtggctagtctaaatggagacgtcctataagattttagagttagactacttagtacaaaaaaaggtaaaatatcagtaatttaaaaatattaattacatgtgaagtgatattttatattgggctaaataaaataaattatgaaagttaacttttcctgttttactttttaaaactttgcatagtagaaaattataaatgtggttcatattatatttatattggatacctctggactagacttttactgactcatgatatgacttgaccaaaagatctttttctagctgggcgtggtggcttacgcctgtaatgccagcactttgggaggctgaggcaggtggatcacttgaggtcaggagttcaagaccagcctggcctatatggtgaaactcattctttactaaaaatacaaaaattagctgggcgtggtggtgtgcacctgtgatcctagctactctggaggctgaggcaggagaatcgctcaaacctgggaggcggaggttgcagtgagcggagatcatgccactgcactccagcctgggtgaaagagcgagactccttctcaaaaaaaataccatctttttccacctaaaagagagtgggagctggaggacaagttgcctctctgccccaggagggttatgtggggctaattggttagcatatgtggtaatgtgaggatcactggactagtgaatatacttttctttaccctaaagtggaatctccctgtttataatgtgaaatctctatgttttgtgcttgtgatttattactagaagactgagagctttttccttcactgtctttgctatttcttgtttcccttcccctttaataggccacaattgctgccagtcggcaggccagctccccaaacaccagcactacacagcagcagactaccaccacccaggcctcggtgagtacgccctctcccactgagaggcttctctacctgggtctttgtctctgggttaaattactttgtgccgctgatctgagagtgtttattgagccgtcagtggatagttactgcttttaagtagagaatagtagtacaaggggaaagtaaccaacattaatctatattggagtctctaaagaggaagtctaaggaagagaggaaagaaaatcctggggaagaagaggagataacaaagaaggggactaatccctggactcttcaatgagaagtaaaatctgttctgtttcaatcttttgtcttctcaactgttaacactagtggttagagactgttggttttttttcactttggtaataccctaaagtagccaggatgacagttttggatatgaagacattatttatttcccccggctccatgaaagtgaaatactctgttcttgactgtgtgactctgaatttgtcagtcacgtacctttccttttacttctcccaaatccttagtcctggttcctttctgtaccacacagatcaatctggccaccacatcggccgcccagctcatcagccgatcccagagtgtgagctctcctagtgctaccaccttgacccaatctgtgctactggggaacaccacctccccacccctcaaccagtctcaggcccagatgtatctacgggtaagccacagatgcagtcaccattgccccagaggcataattgtctggccctggcaaagacttgagtgaaagcttttttttgagacagaatctcgctatgtcacccaggctggagtgcagtggcacaataatggctcactgcagcctctgcctcccaggttccagcgattctcctgcctcagcctcccaggtagctgggattacaggcatgcaccactatacctggctaatttttgtatttttagtagagacggggtttcaccatgttggccaggctggtctggaactcctgacctcaggtgatccacccgcctcggcctcccaaagtgctaggattacaggcgtgaaccaccgcgcccggccaaaagccatttttttaaaccatggtaaccctgatgttttgagagaagctgggacctacttcccatactttacttaacctggaagtgatgttctgtgttcacaggtagcctatagattaaattgagatattatgctagaaaatactggcttaacatttgactaaattagtgttagatatagtcgacctttaaacctgtggctcaagtatacaaattctgtgttatcgctcagcctacctactttctatatataagtacttgttctaaaatcctaattttctctatttctttgacgtgtgactctttgacatcaatctgtagttttctatgcattctaggttttcttctggatggttcattacatgtggagaatatgaggctcctgggttggtgtggaagaggcagggctcagctgtttaatatcttctgtttattttgtcttgtggtccttcctttccatctcttctgtctcttctttccctcttgtcctctttgctcttcctcttcctctccttgccagccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttagtggcgatgactttacctgtgggtgggcactgggcaggatgaagggaatgaccacggacctgggtccacccttctgccccattacacttttcagaattcttactttttgtgttttgtttttccttcccttaatcaccatagaacttgaatcccatataacctttgagttaatctgagttagaaagacaaggagatttgcctgaaaatagtcttgtggatctgggaagtcttattttcaagatagggtaaatttcctcaccatccttctagtcctctgtgggtttgttttattcggagagtcttaattctctcatagtactgtcagaagagaagagattgttgagagaattcttctgttagttagatgtaaagctgacctggctgagttactggaggaatgtttggttgcttctgtttgtgagttactctagttctcaactttcagtcttctcttcctgttcactgttttttcccagtaaaggtcttcctcaccattacttctcatgacttattcccaaaatacatgtatttttgagcctggaattttagcttcttatagatgggacacaacctaggatcttacgataattatttcatccttttagtttatttatcagtaagctggtaaatgttgagttcttccttcatgtacttttggccctccctgtttatgggtttcatacctgtaggttctgcatctctggcttccacatccgcagatacaaccaactgcagattgaaaatatttgggaaaggccgggcgcggtggctcacgcctgtaatcccagcactttgggaggccgaggcgggtggatcacgaggtcaggagatcgagaccatcctggctaacatggtgaaaccccgtctctactaaaaaaatacaaaaaattagccgggcgtggtggtgggtgcttgtagtcccaactacccgggaggctgaggcccgagaatggcatgaacccgggaggcggagcttgcagtaagccgagatcatgccactgtgccccagcctgggcgacagagcgagacgccgtctcaaaaaaaaaaaaaaaaaagaaaatatttgggcaaaaaaacaattaaaaataacaatacaagaacaaaaaataatacaaaaatacagcatcgtgtaaccatttacatagtacttacattgtattagatattataagtaatagaggtgatttaaagtgtatgggaagatgtgctatgtgcacagatgatgtgcaaacactgctctgttttataaaagggacttgagtgtctgcagactttgatgtccatgagcctggaactaatcccctgtggataccaaggaacaattgtattagaaattttgcaggattaaaaaagaaatgtgagtcaggtcttcaaagagcttagacaatgaaagtgctaaattaggctgggcatggtggctcactcttgtaatctcagcactttgggaggctgaggagggtggatcacctgaggtcaggagttcaagaccagcctgaccaatatggtgaaaccctgtctctactaaaaatacaaaaattagccgggcatggtggtgtgtgcctgtagttccacctacagggaggttgagacagaagaattgcttgaatctgggaggtggaggttgcagtgagctgagatcgtgccactacactccagcctgggcgacagagtgagactccgtctccaaaacaaaaagaaagtgctaaactaaatggtgctaactttgagtgacacatgagtttggaaaagaattggttacattactttgcaatgccttattgggatacttgagcagagtcttggacgagtggatttgatttggagtgagaagaaaactagagagagaacagcaagcgtaagagtatagtcatatatttaaatacgagtatgtgtggtaggcgttggagatgaggggataaataaaatagaatcaacaggcatgatgatagaagaggtcattgctggggtagagcatataaaggaggttgtagttaacttcataggtcacagggatcattgctagctattgaacagcagattaacaagatgaggaaagtacttaggaagaactatagggagaataactgttctaacagttcctggagaagagaagttagggaacttgctaagaaactcttgtggtcatctagctgtaaggcaagtctttgttttagactctggtgatagcaatgggagccacgagtgaggttggttccatttccatatccagttctttgatttatccgctcattcattcatcagatatttgagtgtcaatatgtggaggaacagagggcagtagttaaaaatacgcatctgatgggtcagattccagctccactacttactgtgtgaccctgtgcaaatgatctgacatctttctgttatcgtttttttcatctgtaaaataggtattgtaatatacctacctcaggatgtgttgtgaggactaagtgagttgctgcgtttgactgcttgaagaatgcctggacgtagtgagtgtttaggagaaactactgctattaatatatcaaacattccttagcgttggatgcccaagaaagtcacgatcactgcatttgtggagctcacagaccattgaaacaccagacattaaactgatagtcacctgaatggggaaataattgagaaagtaccgagtgttctgagaatttagaaagggacctaacttagctttggcatggggtgtaaaagtcaaggaggtgacatttaacttggggtgtgtagaagttagccagataagaatgtggaaggagagtgttggaggcaggagaacagtgtgtccaaaggtcctgaggagggcaggaacttgatttgttagaggaattaaaagtcttgtattcttggagtttggcatagtggggctagacgggtaggaggaaccttatctttcagggctttgggggctgtgtttaggattttgggctttttataaaaagcaattggaagctatagaaggattttaaatatggaagtgtcatagagagatttggatgtatttttgttttgttttgctttttaaataccatgttgatttcctctttggagactaaacggatatggtgtgagtgtgactgtagggagaataactgttctaacagtttaagggacagacgatgttcatactgggggtagcaatggagatggacagaaatgcatagatttgaggataacttagaagaatcattgaagagggtgaactaatttagtagatgggggaattaaaggagatgccagataggaaatctgtggggtggctggtggtgctgtttatgagacgaagaatgtaggagtgtatttagagtgacgttcagttttggacatgcagacctaattagaagtgtttgtgagccatccatgaggagatactgagactgcagttttattatgtggttcttgagctcagaggagaggtctgggttggagataaacatttgagagtagtaggcatatagatgataattgaagtcccccatctactaaattagtttactctcctcagtctttaaaattgcctggggaggccgggcacagtggctcatgcctataatcccagcactttgggaggccgaggcgggcggatcacctgagatcaggagtttgagaccaacctgggcagcgtagtcaaactctgtctctactaaacatagaaaaaaaattagccgggtgtggtggtgcatgcccatagccccagttaacttgggaggctgaggaaggagaatcacttgaacctgggaggtggaggttgcagtgagccaagatcgtgccactgcactccagcctggtcaacagaggagactccatcttaaaaaaaaaggccagcgctgtggctcatgcctgtaatcccagcactttgggaggctgaggcgggtggatcacccgaggtcaggagttcgagaccatccagcctgatcaacatggtgaaaccccgtctctactaaaaataacaaacattagctgggcgtggtggcacatccctgtaatcccagttacttgggaggctgaggcaggagaatcacttgaacctgggaggcggaggttgcagtgagccgagatcgcgccgttgtactccagcctgggcaacgagggcgaaactccatcttaaaaaaaaaaatgtttggggagatagtacaggttgaggagaggaacgtttaatatggggccctgaggtaggatgaacccccactttggaaaagcagttcaaggtcgacagaggatcgtgggctgacagaggcgaatgggaaagagcagcagataggaaaatctggactgtagtgtcacgaaggcaagggaaccaaatgttacaagatgtgcatgtgtgcatgcgcgcatgcgtgggcagggggcatctctttctaatgtagagagagaaagaaagatggttttattaacagggagggagagttgtttcagttgtttggggggtggtgaatccaaagtagtatgagtttgaggggtgtgaatggctggtgggaatgaatacagtgactgtaaacagctattaagagtttagcagcaccaggaaaggaaggtggaactggggaggggaatgtgcagttcctacatggtgatgagggagccagtggagaagaagtggaagaggaggcagtggatattatatgctgcttgagatggcaggaggaggtggaatatagagtgcagagaaggactgattgccttttgataggaagaggagagaagggggaaatgatgggtgtgtatgcagataaatgtatagattcggtggtggaactgatgaagcaatgctcatataatggtttttgttttctctgaagaggtgaagagtaggaggagaaagagaaggtagtctgaggtatagggagagagtgggaaagtttgaaatagccattatggaaatgaagctgattggaaaaactgtatattaataattgccagataatattatgtgctctagcacccaatcctgatgattcttgtcaatatctctcaaaagccatcaactctttactgctcctgcctgaattcaggtttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctcagcctcctgagtagcttgattacaggcgcgtgccactatgcccagctaatgttttgtatttttagtagaagacggggtttctccatgttgctcctgctggtctggaactcctgagctcaggcagtctgcccaccttggtctcccaaagtgctaggattataggcgtgagccactgcaccggcctattgtactagatttctacatggtcttcttcacttcagtcttaacctacttgtagttcttttccacattactatcaggaaacttttactatgtttttttaaataagaaaatatatgttgttactactaattttttaatcgtacttctggtacacagaatttgataaaattgtaatccttggatcatgacactctctcactgttggtctcgtcataactgttaaaatttatttactctgtaatttttaataatgtaataagcagtgtgcagttccgtctactgccttccattacccacagtaacgagccttctgatttctaagtccattcttccctcgggtccttttttatatggttttattgcatctctctatgtttctaaaatgccctttttattatagaaaattttaaaggtacacaaaaacagaaaaagtatgaattcctgtgtacttaccatccagcttcaacaattatcgacacatgaccaatgcattcaggcccttctctgcctgtggaatattttgaagcaaaccccagacaccatgtatatattttaattgtattgaaatgtgtaaggtactcgtgctgtatgtacacttttggagagtgctttcttaataacattgtcacgatccatttgttttgttgcagtcattggagtttattaattgtagtttctatatactattccattgtatgaatatactatagtttattcatcttctcttctgtagatggccctttgagttgattccaggtcgtggttgctaatgaataatgccaccatgaacattcctacacatgcctcctgtggtacatggcaagagtttgtcttgtggaattcctgggttagagggtgtgtgaatgttcaactttaggatatgataacaaatattttctaaaataggaagtgtattgatttatacttcaatcagaaatgtataaatgtataagtgaatgtttattttgattaataagctttattggcttcctataatcagttaagcagacatcattctttccctttatccatattttggagtactgactatgtgccggaactgtgaaggtgctaggaatataacaatgaataagacagataaacttgctgttcccaaactaaagttcagattccttgtttcaatacaccaggcccttactggcccagcaccttcctacctccttatccacagcctgccttccttgctttatttctttccattccttgtaactctccccaaacataatgaaatatttataatttctaaaaatacagtctttttagaaattatacattttttttaataatattttaaaataatgtctttttttttttttctggacagggtctcactctgttacccaggctggagtgcagtggcgtgatctcagctcactgcagtctctgcctcccaggctcaagtgatcctttcaccttggcctcctgagtagctgggactacaggtgtttgccaccatacctggctaattttctgtatttttttgtagaggcagtgttgcccaggctgttctcgaactcctgaactcaagcagtctgtccgtcttggcctcccaaagtgttgggattacaggcatgagtcatagcgcccagcctaaataataatccttttttggttctggccttgcaaatgctgttatcaatatctttaaacccccaccttcaccattacctactgagtgtcacatcagtatcacttgttttaggaagcccttccttgatctccctagtcttagttgatattccttctctgtactcctatggtactgggtgcatatctatacatcttattatgtcataagtgataattttcttgtcttctgtagtagaaagtaatcattaagagcagagactgtgtctttcctctgcatttccagtatccagtgtagtacctgaagcatagtaggtttttgggaggtgctgaatgattgaatggcgaggaaagggataattgaagagatattttgaaggaataaaagaccacacttgatgataaacttgctagtgagtgaagatggctgaagaatcagatacggagccagagttcctccttaggaggtaggaaggccttaaagtatatggtaaaggcagagatacgagctgaggtattctgtggaatacgacacaatagcagtcctggctgcttttgaatctttaaccttaatgcctccagtcctccttttctcaatctgttttttcgtatctttcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccaggaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcaggtaaattgtcattcctcatgtcattattctctcagaattcatgtgaaattttcctttttttctttttttgcctttttttctttgcctttttgttttttccccgcttctgttggtccttgaatagtggaaggaatgggaataatatcagccttgaacatattagttcagggtcaggaggacaagtgacagatacagattttatctgtttctaccaggcagtagtcagcttacaagttcccctgtccgctttcttaggctgtgagttcttcagttttatcactctgtctattcattcatcacatcttactgaattgcttactgttttctaggaattactggggatacatttttgaaaagtagattccctgtcttcatgtaacttagcatttactataagggatgaattctcacctcactgtttaatgtggttacttgatccagtgtatagcagatacagtacaatgccttagagcacttaagactaatggagaggcggggtgcggtggctcagtcctgtaatcccagcactttggaaggccaaggcaggtggatcacttgaggtcagagtttgagactagcctggccatcatggtgaaaccccgtctctactaaaaatacaaaaattagccgggcgtagtggtttacacctgtagtcccagctgctcgggaggctgaagcaggagagtagcttgaacccggttggcagaggttgcagtgagctgggatcacaccactgcactccagcctgggtgacagggcaagactctgatagtttatacttgctttcagactgcgggtaagatgtagttagatgtgtgtatcttatttggtcatgttgatttttgcctttttttgtttctagtaccttagttgttgatgtatttagataatttactcacaaaaaaattaagagttagttattactatacttggtatttatatactctagcagttctatttctaaattgctttatcatcacatgctttgatctctggacaatctggtacaatatggagaagtagagtttgtcactcccagtttacagtggaggaaactgagttaggtcagagctgacaggtgctgactctcaagactcagatggtggtctaagctgatgatttgtaaaatccaagtcatttgtgggatgacgttggcatctttaactctgtgggtatctcttctttcagtgaatattaagtgcttctgcagtgtcaggccctgggctgtgttttagggatgtgaaaatgaataaaacatggattcagcctttgagaaactccaagtctaatggaggaggggctaaccattcttctttgctgagtacagagtaaaagaatacaatatttaagtatggcaaagataagagacacaagaaattactcaggatctgaaatgactgagcaaggaagttctttctctgagatctttaagactagtagtagttggtaatgtctgattgagtgggaagagtatggacgaagtgatgtccaagtttcatactgactagatttcttttcaccgcataattccaaaactaggttataccttggaaaaatgaatttacttttaatttagaatgattattattctctgctcttttttctctctgttgtattctgggattgttcctatagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccggtgagtgatgtctgatggttttgagggcactattatgcatgagagtggacctgggctaagtggaaatagagcttaattgaataggggaataaagagttaagagggttaatattggtatttatctgcttcttctgtaagagagtgacacattatataatatctgaactttatactcctaaatttgttgctgatactattctgggtttttgggtatgtaataagttagatcaagatagccttaaccaaatcagtctttgaaaaaacaacagttcttggttggtctacgtgaatacagggtctcaagacctaggtcaggactaaatcatgttacattttcttttgtcctgatggaaagttactaggaatgaccaggaattttagtgtaccatgggaagtagataaattgggaaatctggaactaagaaaattttctttgaacatatggtaataattgtggttccttattatccttcatttgtacatctttgtttctttcctattctttacggtatagggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggaggtgagtaactgacttctaatgctgttggagagcacacagagtagaggaatgttctgagtgagctaaaagataaatctggttgagtagaaaatgggccagaagttggtggacaaatgaatagatccaaaaacagggaatccaggtgaattgtcaagggtggacatagattattatggaagatcatgctggctcaactaatagatggatcaatatgtcatctcatgtctgttgcttaatctgtgtttgttttccagaaaaagctgaatcagtggctaatgtgaatgctaatgctccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgagggcagggccataaggtgggactttgaagtggggacttggtctgattgttgtcttttcaaactccagtaaaagtaaaaggcacagaactatttaatgaaagaatggttcaattacgctatttatttaattataaagaaggaaagggaaaagagtgtgtggaccataaaatgaaaatgttaggaagaggagaaaaaaaggaagaaagtaacctttaaaactgtaatgtttagttagataaactagtttgttttataatgaataaaattatagtaatgaagttaaggagctttcctagggtttgcagaaccaggactagaactgaggtgtcttgactcctagtgcattctcagcaccataggaaggaagaggacaaaatagggagccagcgtaggaacctgttctccaatggcttatctggaaaaaaagccagttactattttttttttctcatttccaaacattgtatagagaccagttactactcttgattaccgtattgaaagtgattctctctgaaccagacttggtcattaactcagagatccaagcagagacataattgatggggaaatgttggggaaagctatagagaagcagaaggggatcaggctaacttaactctcaatgttttctgggacaggtgggttgttctcagttactgaaggagtctgagaagccactacagactggccttccgacagggctgactgagaatcagtcaggtggccctttgggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtcaggagtttgagaccagtctggccaacatagtgaaaccctgtctctactacaaatacaaaaattagcctggtgtggcagcatgcgtctatagtcccagctactcgggaggctgaggcgggagaaccacttgaacctgggaggcggaggttgcagtgaagtgagctgcacgccaccgcactccagcctgggcgacagagcgagactctgtctcaaaaaaaagtaggaataaaatgaagtctgtctacatatagaaaccatattatatatcagagtatgtagaatcacggaaaaggaattacataaggtgaggggaatttatccagctaaagtaatcttttgaattattattattatttttttttgagacggagtttcgctcttgttgcccaggctggagtgcaatggtgggatcttggctcaccgcaaccagtgcctcctgggttcaagcgattctcctgcctcagcctcccgagtaactgggattacaggcatgcgccaccacgcctggctaatttttgtatttttagtagagacggggtttctgcatgttggtcaggctagtagtcgccaactcccgacctcaggtgatccgcccgccttggcctcccaaagtgctgggattacaggcgtgagccaccacgcctggcccttgaattattctttactctatagatgtattttttggccgagtgtgatgactctcacctataattccagtactttgggaggccaaggccggtggatttcttgagctcaggagtttgagaccagcctgagcaacatagtgaaaccttgtctctacaaaaaaatataaaaattaactgggcattgtggcacatgcctgtagtcccagctacttgggaggccaaagtgggaggatcgcttgagcccgggaggtggaggttgcagcgatccaagatagcaccacggcactccagcccgggtgacagagtgagactgtctcaaaaaaatttttttttccaaaagatgatctaaaataggacatttatatctttaatttccagttctccttattctagattttataatctatcttaaggactcttactgattttcccactgcttttggaaatctttgtggtagaaggatcttatatctttctaggcattagtagttcctctctcctcagaaattgaatcatatctgaaatctaagagtatgaattaggataaaattagtaagacatctaaaatggagagagttcggcttaaggttaggaagacgtcataaagttctcaagggacaagtcttcgtgattttaggttttgaactttgcgttttagggattctcaactaggttgtgtaggtttttgggggtgaaccctgagaataattttagaatccagctctgagcctaatgattgcctgaggggcagcagaaacccatggtgactgtccagcaataccttgttttttagagttagataagaaggcgaatctcctgaagtgcgagtactgtgggaagtacgcccccgcagagcagtttcgtggctctaagaggttctgctccatgacttgcgctaagaggtactctgggcaccctcctccttgccctcagcactggtatctccatctaatgttacaccccttccccaggatcgtctcatagctgatattttatgtctccctccttgcttttattcccttccccaaatcagctcataagcagaaattcacatttagagcagggtggtcttctgtggcactattgacatcctatatatgccctgtcctgtaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccgggtgagctgcttgttgtagagccagatgcctttaaactgggtctttttttctttccctgcagggcaattcatttgcccaggtaagagggtgtgagatgagaactctggtttcacattgattgcattactacaaattccaagagatcctgaccccctttgtctccagacctcttacccaactactggttcatgtttccattaatccttacactgtacttgagtacaattgttaattgtactcaattgtactcaatttctctcaattgtacttgagagaaaatctagatcaattgttaggtcatggggagaatcaaggaagtgatacagtttctatttgaaagactttgagagtagattttgggaatttgcaaataaagtgctgcttatttcacatatgataagatgagtttttcttctacgcccaacccagggtggtttgggaagaaagagagaggaataaacctttgacactgacctcattggtttgctcttttcccctatagggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggtactgaccctctcttcaacagaacccaggttgttttccttaacatcatcccacaggggccttgataagagggaaagtaattgacttttaagcagtaggagcttgaatgctaatatagaggctctactcctaatattcaagttgacttcctaatttttttctgggttgacattatcttctgtaatgtcagcaattttacagtatttgattctcatcttatgatgtagctgcatttttcactaaatttttggataaaatgtttttgtgtaattaactatgatacctcccatggggaaaaaattttttttttcagtggagcagggtattagaaactaagtggccattgttgccccactcttcaaagagggcttgtttgctagtcttcttttttttttttttttaaacagagacagggattccctatgttgcccaggctggtcttggagtcctgggctcaagatatccttctgccttggcttcccaaagtgctgggattataggtgtgagccactgcactcagcctatatgcaattttgacagagtttttttcggaaatgaaaatcaccctacccttcttgctatttgtctgaattctgggcccttaaacaaaaatatcacaaagaatctttttgccagtataaaagaaaacatgcttttatttctgttctctccctttcccctgtctctaagctatttgaatgaagttatttctgtggttgaacaatttagttgcttttcctttcttggtcttggactttggttttgttgttgttgttgttttgagacagagtcttactctgttgcccaggctggagtgctgtggcatgaattttggcacactgcaacctccgcatcctgggctcaaatgatcctcctgcctcagcttcccgagtagctgggactataggcatgcatcaccatgcccagctgatttttgtatgttttgtagagtcaaggttttgccatgttgcccaggatggtcttgaactcctgagctcaagtgatctgcctgccctggtctcctaaaatgctgggattataggcgtgagcctctgcacctggccattttttaaataccagttgctttctaatttcattttgcttttaaagcttgccatctgacttcatattactgaatttaggacaggtactttggaattaatcattgctagacctcagtttcatttagcttcccttctcctatcatctggcattacctacatgttctcaccatttcttctaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaagtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctcaaaaacttgtgaaaatgtgtttaaaaaacaaacggccagtgagcctgctacaccattttgcccatatgcctattgtaacttctgatgtcaagagacaatgcaaaagcctctgttttcacaggccctattatattaactctgacttacaactgtacctctctagagaaaaaacagaaaataaggaacaaagggaaggcagttttactagtgagaagatgcaaatcaaaagcaaactggaaagcaagagcaatagtaagggtgagatgagggactggagttgagactgcttgagaaatctggctgtgtagctttggtttgggggactgaggaagaggctggacatataaagtgcaatctacattggtaataaatggtcatccctttcttctgactcctcccccagctggtcatcccccacaccacgatatgctgcaggcacatttcgaggtttagaacggcagacaaagtcacagccatcctgtagggggagaaaaaagaaggaaataattcgcagcatctaactttaggatatgagaaagtgtacttatggtctaggaatgtggcaagaattggttttctatagggataatgagaaaacctaaaagatctgacaatcagcctaaattcaatttggggcaacaggagaaaaagtttcttcttattaggcctcaccttcttcccacccaggccctcttaaaagctaaatcagatttagaagagcccatctggtcaacagtgttgctctttcagcaatgtcttaccaaggccagaaatggatgctgtgccacttactactctgtactagggcaactgtcttgtttgctgggactt

SEQ ID NO: 12368 - DNA, 28229 bp, Human
  misc_feature (1)...(28229): n = A,T,C or G
ctggagtgcaaatggtgcaatcacggctccccacagccctgacctcccaggctcaagcagtcctctcacctcagcctctcaagtagctgggactacaggcgcatgcaccaccacacctggccaattttctttttctttttttttgtggagacaaggtctccctatgttgcccaggctggtctcaaactcctggactcaagtgatcctcctgccttggcctcccaaagtgctgagattacaagcatgagccaccaagcctggcctcaccctctcttgctcttctgccttctggcatgagatgacatggcatgaaggccctcaccagatgctggcaccatgctcttggacttcccaacctccagaactatgagattggaatttatcatgaacagaatgaaatttctgctcattataaattactgagtttgtgatatcctgttatagcagcataaaacagatgaagacactgaggcttttgtcagagagacaagaggcttgattgctggaaccctggggactgagagactagagctgctgaccccacaggcgcctcaggctgaagctgactcagaacagagtggagagctggagacacatcctttgagccctgaagctggcctgaccactgtcctgttacataagccaatacacccttgtttggattggactttctatcacttgcagcaaagtcttgacacatgaggactgtgaggactcagggaaacgagttcgaaccaatgatgacctccatggtagatgacctccatgatgaccttccatggacagtggaagcactgtccccctcacagtgcttccacagggccagacttgataagcttttggggattttattactaaatttccttcctaggcagtcaaaacattgactcctatggggaaaaaacaatgtatgacaaggatgtcttggactccccctccaatcactagaatcacttccacaaatcaggcactcatgatggacccccccccccacataggtggggtgccccctcagggagcagtggaagtgagacttattggtggacctagtatatccaagaaggctccagaactaggcaatgctgggtcagtttatgtcactgccactatactgcagcatgatccttagcaaagggcctctcttggtttgctgcccacttcttagggagttgtgaggcaatcaacataaagcactcagttcagcacctggagtgaggccagcccacagtgagaggccactttcttccttctccaagtctggggggcgggggaggggagaggagcaatggaaaggtgccccccagccctgccctcgcacagagcacgccaaacaccaccgccacccgggtgcaggtacagtttattcttcacaacagagaaatacaaagagcagagggtttgtaattcctttgtttcttgccccctttagtgttttccccccacatttgattttcatttgctccccactcccttttttaaatagaatgcaaactaccttcctgaagtgtctgaggggcacctgccctcacctccctgcctccaagatgcagactgagaagccaacagactgttttttcttttttaataaggtaactagttctaaatatggtggcctggaggtcccatagaaaaagcaaaggggtgttaacagtatgtataacagcgtatttacagggagtaacatgcggacaaaaagctacaatactgagtatcagacgacgcaagtcaaacaaagggccgggggtgggggcagagaaccccatgggcaaagaaaccccaggaaacgttaaactggtaaatcaatggcgagttaaggcttaaaaagtgtataaaaataacacagttaatattcaaaacggaactccagatacagaatatatagatgagtttctgtctagttttcttttttttcccggggggatgtagggggcttctctgggctctgtacatggttcctatatacaccgacacgcatggctttcagattggggtgtgtctgtgggggctgggggcagggtctgctcctgggacctgcctccccggggatcccttccctgctgaggggcctagggcctcggctggggattcccactccatggcagggaagacaaataacccctccctgggcactgcccccatctggaggaaattctggagggaggtcccagatccaggcccactccctccccatccccctgcccacagtctgggatggtgggagaggtagccgaaaggtttcctggccagcaccgaggtagactggggtggtcttcagggcagcaggggagggccaggtcttacccagcccatccccaccccatttccctgggcccgccacccagcccatcactgcaccctttggtcctgtggatctcccacccctctcgtttccgcctcctgaagctgccgcacccctctgctcagtgatgcccagggcacagctcgagaggtgcgagccaggcactcaggggcgaagggctcactccggctgcttcctgcccctcccacctgggggtcccctttgcagtccagaaacctaggcccgagccttccctcaagacctgaggccatggcaagagaaggtcccacattgccctctggttctctgcgtccatctgtccgattctttaaatttctcggtcttagcagcaccaacttcctggccaataaatatcttttctgttatttccaaaacaaacttaaaaaaaaaaaacgaaaaaaaaaaaaacagtgaagcaagtgaagggtggggaacaaaaagaaaactcaacagagaggttcaaagtgctctgagatcgtctttggatgccaccaaaacagtccagaatcttgcagttggcctggccgcccccggactggaccaggcagggcttctgcggaccaagctttctggaagattgggaaggtcgtgagagagcttggtggttcctggagggcccccggagggagctggggcctggtgctgcctgggtctgtgtctgccagtgggccgggtggggcggcgcctccagtgggctcagatgagagagattcgcaccgggatgccgggggactccgtcctctggggcgagtgatggctcaccaggtgctccaccaccgtgtgtttggacatgtgcttcatcaggtaggtctcctgtgggcagggatgagattcagaacagggaaccaccagcaagggagggagaagaggctgcagttcccaccagcagccactggagggctcttggtaggcggttcagagggtggaggacagccacagttttgcagggtcagatgggcgtcggccattggttctagagacactgcactgctgccagtatgagtgctggctggagagctcacccctcagcaatgcccacctgtggctctccagggccaggcccccaggcccttgccacctggatgtagctgggtatactggctgaacctcagccctgtctgccaggtgaagcactgtgcctgcatctggctggtgatcccagtgacagtgaggcagcaggactgggtctgagcctagctctgctctttcttagtggtgagaacttggacaagtcatcttgtctctctgagcctcagtttcctcctctgtaagcaggcataggggaggaacaacctcaacaggttgctgtggtgacaaagatcaagcccttagcatggagtaagggttgaagggtccactcctgccccagtctctacatttcctttccttccttttcttaaggtctcactgtgtcgcccaggctggaatgctgtggcacaatcacagctcaccacagcctcaacctcctgggctcaagcagttctcccacctcagccctccaagtagctgggactacaggtgggtactatcatgtcctccactggctctgctggatctgacctgaggcaccaggactgggtaggtgaggttgtgacccagggctcactgcaggcccagaagccctcacactaagccacatccttccaatcgcctttgccagaagcagaggcggtactcccacctgccactccttgacttcagacctcaatatgctcagaacccagcagaggaagccctcaaatgtggcggcaacatgctatccaataccagagggaagcaacctgcaaattcctagctaggaaactattcttcagtgaataaataacaaagaaaaaaagtgggggtaaggggacctagagattaaaagatctactgagctactacgatgcaggaatcttatttggatcttgatctaaaaagaataatgtaggctgggcacggtggctcatgcctataatcccagcactttgggagactgaggcgggcggatcacctgcggtcaggaattcgagaccagcctggccaacatggtgaaaccccgtctctactaaagatacaaaaacattagctggccatagtggcacatgcctgtattcccagctactcgggaggctgaggcaggagaatcgcttgaacctgggaggcggatgttgcagtgagctgagactgtgccactgcactccacctgggtgacagagcaagactccgtctcaaaaaaaaaaaaagaggaatcatgtaaatacaccaaatcatggcattcgtgacacaaatgaaaatgtcaatgctgaacgggtatttgagtatctgatgatgataaggactttggttaattactttttgatattccaaaggtattgtggatatgctcaaaaaaggagtctttatcattagagagataaagtgcaatttttagaaatagtatgatgtctggattgtacttcaaaaaataggagtatggatgaggcaggattggttgatggtgtaggaggttatggaaaacttgagccttggagagaggcagggactgactggagatcagctagccaagcgagggctcctgctcacccctttggagcccttttccctgcagattctgtcctctttgcctcctgaccctcctctgccctttgaactccagggaagaataaatgttacagactcagcacttagcaagtggcagccctgcccggcacctgacaagtactgccaacaaccccacctatgatccatgaacagcctccagccagagtgaccgtgcaaaaataccttccctgccaggcacagtggtgcacacctgtagccccagctactctggaggttgaagcaggaggatcccttgagcccaggattttgattccagcctgggcaacatagcaagaccccgtctctaaaatataccaaaaaaaaaaaaaaaacccttcctgacagtcccctccctgtagcttcccattccacctgaaaaaatatccaaacttttctaacagagccccaaggccccaactgacctaatttcctttgagttcttgtaacgtgccaagtttgttacccctcagggggttcgcactcagtgttcgcctgcatggaagcttctttcccctctttctcctcctcatccaattatccttcaaggcttcacctaagtgttgctcctccaggtggtcaatctggactcatcccccttcccagctccattgtgtcctccctgctgtctttcaaaacacacttttatcacagtggttctcaattgaggtgattttgccccccagggacannnnnnnnnnnnnnnnnnnnnnnnnnnnnnnnnnnnnnnnnnnnnnnnctgtcccccaggatgcaggactccagaatgcaggacggcatggccctgcagctcagccccctctgtgtcatccctgaagacattttttggctgtcaccacttggggagcggttgctactggcatctagcggatggaggcctggaatgctgctcagagccctgccacgtgcaggccagcgcccacagtggaaaggtccggcccaaatgtccatctggactagggccgagagtctctgctttacagcagctacacaatttcccgtcaaacagttacgtgtgtacttgtttaatacttgtctccaacagttcttaatttccctgggggcaaaaaatagatctgtctggctcatcccaatgcccgagcaccaggcagaagtgtttagtaaagactgagtgaataaataatggtactagctcaggttgatttggcaccactctgccagccaacagccctgtgagttcatccatttgacagatgaggaaactgaggctcagtgacctctatgtcggggatacggggtctgttaactagaatattagatcaaacagaagcacacactcaagcgattcgcctgggggtgaatggtatttctgggtgccaaaaggccctcgtttggggaaattcccacccagggacgggagctgaatgctctgagctttccgggctgctcaggcctttcctgagatgagggtggctatgggccatgtcactgcgccaccttgtggccacaatgggggttgcagcttcctgggtgacaggaaggcgcttctctctctgtagctctgcagagcaggtgaaaagcctcctgccactgctgtgagtactccagggcctcggagactcaggctaaaggtgagcaggaggctaggggcttggtcaggggtagctgaaaccagaagtgggaagcaaaagctctggttctccccttccctgtgatctcagggtgtcacttcccttctctaggcctcaatttctttgtctggaaaatgggaagagtcgacacagatctgacaatggggaagcaactgaggcctggaagacgaagtggctcccccggggcagggcacaggccgaccggcactcaccgaggtgtaggcccgcccacacatgctgcagcagtaggccttggcgtgcttgatggcgtgggccgagaggtggatctgcaaagaagcggagtccgaataggcccggtagcagttgggacacttgtagggcttgtccttgttgtgctggcgctggtgagactgtaggggcacagcagggggtcaggagaggaacagggctccctcaccccacccccttcctacgcttccttgtgggggtgggtgggggggcaccagagcacctggtgggcaggaggcaggcaggcactcacctggaggttggagagctgagtgaaagccttctcgcagccaggatgtgggcacttgtagggtctgtcgcctgtgtggattctgtaatgggcagcccagtaaggtcgaagtccctgacacacaccccaagaccgctccagttcccaagtccttactctggcccctaagcctctcggtccctaccctgcccatgctccccaaggaccaagagtgagcccaggcaagagctggggacttcaacggccatggctcttccttccttctctggcctccactgccagtctgaccagagcctcctacttcccacaggtcccagctgtccccagcccaccaccagagcccttgcagcaacccagtgcaggcctcggagagggcctgatttggctgcccctctctttgaaaaccccacactacggaccacgtattgcaaagaacacagatgcacagctttgtcgggaccttccctgcccacccagcctccttccctaagaagaaggagacatctccctctaattggccccagacacttatttcctgtccctaccccatgtcaggcacatctccgtgacagctgcatggtcaccccagtaaatgggagaatgtgggacagcatggccctgaagctcagcccctctgtgtccttcctgagagctccttctgtccctgccactcctgggttctcatcctggctattaaccagctgggtgaccttggacaaaccactgagcatcagtttcctcatctgcaaaatgggtataaaaatacagttcctatctcatcgggctttgtgaagataacatcagataatgcatgtaaagggcttagcctagtgttggtacaaagtaagcactcaacgtttgccagttatcgttattcattcacattcattacattgggtacccatgccccaggcactgtgctaggtatttggaatatatcatgaacaaaacagacaaaagccactgcctggaggaaataagcaacaagcgtgaaataagtaaatcacatgtagaaggtagtaagttctgtgggaaaaacaacaagatggggagaccatgagtgacgggaaggagggatacagttttaaacggagataagggcctcatgaggaaggtgacactggggcagtgacttgagggctgatgaccctgtacctgcccaacagcccaggtgaggatggagctgtggactgggtgatgatgtccacaaatggagctcagcagcctggcatgcactaatagtggccttccctgctttccacactcatgcctttgcaccatctccctgggcgtgtcttcaagcatctgtttgggcaaatctgctgtaccaagcaggtgagcaatgaaatgccagctgggcctgcaccttgtttgcctaatttgttgaggaacagaagtggaggggaatatccagattttatcaaaagggtgtccactccttccttccaaggccccagcccctctcactgactgggtttgccatcagcccatcaacaaactcatcaaagaaactaaagcccctctggccaggcccagtgttagacttagagacacagggttgagtaagaaacactccctgctaccaataagcccattggctgccattataaacactgacaaagtccaaattccttatatgtcattcaagccttcaccaggtggtccagcatcccctccctgctcgtacgcaccctacgtcctggtcagataatgattcttccctgccagccatgtctgataagtctccccacacctctgctatgtctgcatcctcagcactgggacctccccagctcttttgcccagtaaatgtcagctcatccttccagattcgttggcgagtggggctctgcggaatctcccgagcgaactgctcaccccacaggcttccagagcacattcctcaccacagagccaaccccactggactctcaaggcctcccacacttctctcccctgctagatggggaatcccgagggcagggacgggccccagtctcaggatcaaggcctggggtctggccttccacaacagctgtgccaagagaagctgggctgacccagttctgagcacccctgcacatttctggatgtcacatgtttcaggatcccatcccaggctgctgcaccgtctctacaatggaaggaccttaagggtcatctggaccaactccgcctgaggccagcatcctcttcacttcatcccatcctcattctctctagggctggggaattcgtttacttaggctccccatcacctaatccttaagggtccccaggactcacactgcctttgttttaaaccccacaaccaagtccaggaccagacggattcacagccgagttctaccagaggtacaaggaggagctggtaccattccttctgaaactattccaatcaatagaaaaagagagaatcctccctaattcattttatgaggccagcatcatcctgataccaaagcctggcagagacacaacaaaaaaaagagaattttagaccaatatccctgatgaacatcgatgcaaaaatcctcaatacaatactggcagactgaatccagccacacatcaaaaagcttatccaccatgatcaagtgggcttcatccctgggatgcaaggctggttcaacatatgcaaatcaataaatgtaatccagcatataaacagaaccaacgacaaacaccacatgattatctcaatagatgcagaaaaggcctttgacaaaattcaacagcccttgttgctaaaatctctcaattaattaggtattgatgggacgtatctcaaaataataagaactatttatgacaaacccacagccaatatcatactgaatgggcaaaaactggaagcattccctttgaaaactggcacaagacagggatgccctctctcaccactcctattcaacatagtgttggaagttctggccaggggaatcaggcaggagaaagaaataaagggtattcaattaggaaaagaggaagtcaaattgtccctgtttgcagatgacatgactgtatatctagaaaaccccatcgtctcagcccaaaatctccttaagctgataagcaacttcagcaaagtctcaggatacaaaatcaatatgcaaaaatcacaagcattcttatacaccaataacagacagacagccaaatcatgagtgaactcccattcacaattgcttcaaagagaataaaatacctaggaattcaacttacaagggatgtgaagaacctcttcaaggagaactacaaaccagtgctcaataataaataaataaaagaggatacaaacaaatgcaagaacattccatgctcacggataggaagaatcagtatcgtgaaaatggccatactgcccaaggtaatttatagattcaatgtcatcccaatcaagctaccaatgactttcttcacagaattggaaaaaactactttaaagttcatatggaaccaaaaaagagcctgcattgccaagtcaatcctaagccaaaagaacgaagctggaagcatcacactacctgacttcaaactatactacaaggctacagtaaccaaaacagcatgatactggtaccaaaacagagatatagaccaatggaacagaacagagccctcagaaataatgccacacatctacaactatctgatactttggcaaacctgacaaaaacaagaaatggggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgtggcacatatacaccaatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgaaaacacttcgatgcaggaaggggaccatcacacaccggggcttgttgtggggttatacctaatgtaaatgacgagttaatgggtgcagcacaccaacatggcacatgtatacatatgtaacaaacctgcacgttctgcacatgtcccctagaactttaagtataaataaaaaaataaaaaaaaacccacccagccacagtggccttgcactagctcctccagcactgagcccttgcccacctccaatcctttatccaagctgttccctctaccaggaacacctgttcctcagttaacacctggctaaaacccaactcctgatctgagcataaaagtcccttcatcagggcagccttccctgaccccctagaccaggtcaggctccctgcggcccacctcgcaggaaacaaagacatcggcttcccagaagtctctgcatgggtacttattttctccatgtctggtcactgtgttccttcagaggaactcccttgggctcattccccaccatcaccccagcgcctggcatgggctcagcacagaggggattccataaatagacacagactgaatgaaggaaagcaagttctttctccctgaagtcaatcattgacaagagaaataggttccacattatcagcgacttccatgctctgggtgtatttcatgagggtttgctcactgactgaccgacagtcctccagtggattcagctccttcctcaggaaccagccaagccctcttgaccagtaagttgcccctctggcctcctcccatgcacgtgcaacaactgcccggcctcccccttgactcccagcctcagcctctccccgccaggcctcggcacggctgaagctgcagggctctgacctggtcacagcccagtctggcaacctccatggtctccctctttttccaggacagagtccatatccccttccccagcttgcaaggcccttcacattctggccttggtttctaaggcctcctcctctgccactgcgctcctgagaggagcatcttaccaacctcccccaacacacatgcagatgcagcctcccggcgggcctcgagcctttgctcatgtcgttcttcctctgactggggagggctgtggacccctctgtactcaacccagatgatcccccgcaacctccacctcctacttccctctctcaaggaagtttccacatctgccatcctcctaggtcacagtggcaggggcctgcctctgcccgctcctgtgtccctgtgcatggcacccagcatggggctggctcagaaaaagcttcagggagcaactgttggataaggaaggaccaggctacctgttcttttagccacaaagctcttgtcttcagtccctgaacttcaagtcaagcctaagccctcaattctaacatcagaatcctctctctgtagggcatcttcccactaggggagcacccagccccagctcccacatctgcggcgatgggaagtccacccctgactctaggtggtcacgcctctttttttttttttttttttttttgagacagagtctcgctctatcgccgaggctggagtgcagtggcacaatctcagctcactgcaacctccgcctccccagttcagcgattatcctgcctcagcctcccaagtagctgggactacaggcctgtgccactgtgctcggctaatttttttgtatttttagtagaccaccatggttcaagaccacgtcagccaggctagtctcaaactcctgacctcaagtaatccactcacctcagcctcctaaagtgctgggattacaggaatgagccaccaccgcacccggctggtggtcactcctctttaggcagcacaaggaagctgagctgaagctagtggccctggactaccccacttcaccccccactgtcccagtcccacccaggggctccaaagacttgctcttctctcttgcctggcactgccatccccaagtgcttcttctgcagcctgatgccccagcccttccttctttctgaactgggctgcttcttggtgctctgcactcaaatcttgcttctgccacctcttagccgggtaacctggggcaggtgactctgcctccctcagcctcagtttccccctctctaaaatggggataatagactataagaatttaatgggtgttcataaaatatttttgcagtgttagtttttaatacattaatttctatttaagttaagcaacttatgaaaacagaggaaacgtattcaatgtttcaataaaattattaaggattcatgaattatcacttttatttctcagccatgatatggcttttggcatgtcgtgttttttaactaaaacaatggtcatagatatatgaaggttaaacattccttgagaggattccccctctgtggcatttttcaaattcattatctcttatgaagaaataacaaattcacactgtacagggattttatggacaccttgtatattaaaacaccttaagcaggacctggcacacagaagttctttaataaggaatagttgtcgttgttattagcattattatcagacttgaaaaaactaaaaggacactttcccctgctgcaatgatcattaggcatgtacataacatcactctgtcaggaaaagaaaaacaaaaacaaaacccctttgcaccctgaataaacagacaaatccagagtcactctgtctagttctagttccacaaatagataaaactttcagccatttcctataacttaacttcctcccaaaacaatggttggtttgtttgttgtttgtttgtttagataggatctctgtcacccaggctgcagtgcagtggcgtgatctcagctcactgcagcctctacctcctgggttcaaggaatcctcccacctcagtctcctgagtagctggagctacaacacatgctaccacactcggctaactttttaattttctgtagagatgggtctcaacatgttgcccaggccagtctcagactcctggtctcaagccctgactcccacactgtgatatctgcaggtacagacgacccttacacatacactaactgcacgagacaatgctggttttctaccatgaacagactaacaagaacagaaaatgttctattttctctataaatccatgtggtgtttattatgtagagggctgatccttctgaagcctggacttgttcaacactttgcaagtccctcactttgcttgtgccttcctttcacgctgcaggccaattaagatgctccaacgccactcaaccgcctcactccgaccatgctcccaagcacaaccttctcaactcccagggtggatcttgcttgccctcttgctaactctacctctattgcttgaccggggctggctctgttttggacatgaccttcttttatgcccttcattagtggctgtaacattgggaagatggatttgattatatgatctgatgcctggttctctgccaagggacaaataagtaggaaagggcctccgtcaaatagcagaggacaaggaatctggaatctggttgtttcttcagctttggctttgtttgtttgtttgtctaaagaatcctgggagttctgggcatgtgggacactcgcctctttgccactgagttaggacatatcagtttaattatatgtgcaagcgtctagtgacttataaactgtcttccaaatgttgatagaatcctcttttgttgtttgtttggtttcctgccattatgaactcaaattagtccaaaagagagagagagagggaaaaaaaaaattgtgccctcaggaatggagaataatccctgagtcaaagaacattctggcaaaatactctcctctccttcaaaggcctgttaattttttgttgctttttttttggtcatgttctcaaataatatttttaaacaaagtctacttcttgggaaaaaaaaacagaattcttcatcattattatcacttgctcttgtgtttattagcttgcctgttctgtcaactttgtgctgtcgcctttctcagatccaggtccccactcagaaagataaaattgtcaaggtgcaaatgcaaatacaattgctcttggcatttccagacggctgctgggcaacaccaaagatttgctcccttgttttacaaaaggagggatgcttacaatgattgggttttgtattcttctttttttgttgttttttgtttttttgttttttgagacagggtcttgctctgtcacccaggctggagtgcagtggtgcgatctcagctcaccgcaacctccgcctcccaggttcaaatgattctcctgccttggcctcctaagtagctggaattacaggcacccgccaccacacctggctaatttttgtatttttagtaaagacagggtttcaccatgttgaccaggctggtctcaaactcctgacctcaagtgattcacccaccttggcctcccaaagtgctgtgattacaggcgtgagccatggcacccggcctatgtattctccatggttttaattagccaaacactagagtgacagctgccctacaaagtttgtagcgtaagaaagttggcaaataaaaagagaaactcaacctccctgggttaattttatacatacataaacatataatatgtataacatataatatgttcttgtgcactttttaagatggaccaaaaaaacctaatctaatgcacagaggctggcataacaagcatcaacaaagacatttctttaagaagattttgtctctagatttagaatgcccttaacaattagtgataatgctttatgggactaaaagaccctgaagatgggccagtgcgcttgctgccaataacatttttttgttgttggtgagatggggtcttgctctgtcacccaggctgcagtgcagtggcatgatctcggctcactgcaacctctgcctcccgggttcaagtgattctcctgtctcagcctcccgagtagatgggactacaggcatgcaccaccacactcggctaatttttgtacttttagtagagacggagtttgaccatgttggccaggttggtctcgaactcctgacctcaagtgatccacctgtctcagcttcccaaagtgttgggattacaggggtgagccaccgtgccagcctaccatgtttttaatttgaaaaattgatcatgattataccttaatagaggactccattgtcctccattgtgatattgttgattattacaattaactaagcagaatcatttgttctagtcaacaggtctgatttttaccctcacacttgcttaattaaaggcctctgctttgagctagaaaagacaaatgcatacaggctgccacgttgacatcctcttcttgaccagacactgccagaggccaaggtaggctccaagagtccttgctccagaagtagataactttgaaagcaggctaactaacccaggatcagaggaacaggaatttttccccaggactggatgaaactgatttcacccttaatgttctaattttctaaaggtctttttttttctttattactgtcgctaatcctcaatttaggaggctgtattcaataaactggaataaaatattcctaaaatggtgccttcttccttcttccaactaactcttcagaattctgggggtgagggtgggagggggactataaaaacctaacatagatatgaaataataaatcatcaaggaaatgttcaaataatcattctattgaaaacaacaaatgtaattggccttatctacaaaactactaggaataatagctaaaaactcttcaaagtacctttgctgagacccttttcttttacgatcattagttctgtaaacaggatctgtaagaatctgtcctccttcctaacaggatataattgggtaaatcaaatttgtaaccatggctgtgccagaaatgtcacagttaaagacaaatttcatttaattaggcatgacaagcctgagagtaagaaacaaggactgcacttcaaaagtgggaatgaggcctccccgggcctccaggaaaccggactggacctgcttatggcttgtggaatttcagcctttaaggttataaaaagacatcaatctctgcttgttcagaaacactgacaaacgaagattctccaaaaaaagggtaaccgccacgttacacgttgtataggcacaatctggcagaggtgaattggatggttctaggttcctgatctctaataatataaaattttttcacatacatacacacatacacaattctggcctggaggccttacaaagtctcctaacagagttaactctcaagcttttctatcaaatgctctttaagaaccatacaactgggaggactttatcaatcaacaccttgttacatacatctctgtacataaacctggccaaattttttaaaaatcaaagtagcaacaaaatcagaaaattgctgaaacaaacttacatggtcagacttgtgccttgggaggcatggtaacgagaaaacagactgacacctggccctgctgccattgtaccattttattcttttattattttttttcttttgagacagggtctcactctgtcccccaggctggagtgcagtggtgtgacatcagctcactgaagcctcgacctcctgagttcaagcaatcgatcctcccacctcagcctcccaagtagccgggactacaggcatgcaccattactcccagctaattttgtatttttctgtagcaatggggttttgccatgttgctggtctcgaactcctgagttcaagtgatcaacccatctcagcctcccaaagtgctagaattacaggcatgagccactgagcccagcctgccatttgattcttactatcatacccacatatcatgtcccaaagtcagagaaatagacaaggtaaaacatcttgcacccagggataaaggattcaaagacaatggagataaacgaataaatgacaaaaacaaaaaaagcaaataaaaaatagagcccttctcatggtggcacacgcctgtaatcccacctacttgggaagctgaggaggcagaggttgcagtgatccgagatcatgacactgcactccagcctgggcaatagagtgagactctgtctcaaaaaaatagagcccttctgtatagtattagtcctcaaaacagaaaaaaccttgaattctttctgtaaattacaaactccacaacaaaaaccagttttatccctgacttttacaatgctgatattggcaaacacgtgacaatgctcacacagatgatcatcgtcatgtgagaaaacggtgctgcttcccctctgaacagagggactgcaatcttggtaatctttggcttgtttttaaaaataccaatggtatttttatttggtgagccagtctttctgatgtctataccctcctgcacaaactttttttttttttttttctcttgagacagagtttcactcttgtcatccaggctggagtgcaatggcgcaatctcggctcactgcagcctccatctcctgggttcaagcgagtctcctgcctaagcctcccaagtagctgggattacagacgcccaccaccacacccagctaatttttgtatttttagtagagatggggtttcgccacgttggccaggctggtcatgaactcctgacctcaggtgatccacccgcctcagcctcctaaagtgctgggattacaggtgtgagccaccgcacccagccacaaatttttcttaaagcatttatagctttgagtctccctttcacacactcaactagactgtatgccccacgaaggcagagattttcgtctgttttcttccttgctgtatcctcaacatctagaatagtgtctggcatagagtaaaagtttctataagtatttgttaaatggatgaatcatatgctctgtaaaaaccagttatatttattccaaaatatttaataattgcttattttgtgccacaaactggggatatggaaatggaggagactgagctcttgccttcaagaactcccagtagattgagtgaggtgggcagataaagagacacgggcgtgacagcctaccactgctatgatggacatgcacagagccctgtggggacacagaggtcgggtccctcacccagctagagcaatcagggagggcttcctggaggaagctagactgagagaggacaaggggatggccagagaaacagggaaaagcgggagaggggtgtctctctggtaaaggacacagcatgtgcaaagacctagagatgagaaacagtggggacggggtgcagtaacaacagctgaggccagtgaggtccacaagggccgtgaccccgagggcaatgggcacctggagaaggtccttgcccctccttgcactggctccatgtgccaggccacgggtgctgagctgagtcgggctgcagcagggcagcaggcaggccactcacctggtgtgctgctggaggtgggagagctgccggaaggacttatcacagtaggagcagtggtagggcttgacgcccaggtggatgcgcaggtgctgggccaggtaggaggcgttggcaaaggacttggagcagtgcgggcacttgtggggcttggcctctgtgtgcgacttggagtggatctgcatctctgacttggtgaaaaaggtcagtgggcataccttacacctgcggagcaagagacaggttcacgtgggaagatcccccagactgtccatctcaggggaggccttctacatcagagagaccttgcacctgggacaggtctttcctgtgatgagcccaagaagcacaggaccacctgggaaagacaggggacagtctcccagcctgggcacccttaaatctggaggaggaagctcttgcctgggggaacattacagagcctggagcataggttacacctcatagggaagacaggcctgatcctggtgagggtttgcccagggctatatcccacggttctgggcaggaggcgctaccacgtgaagtagttctcaaccaggctgctcattagaatcatctggggagcgtctaagaaataccaacgcctgccccaccctccatactttccatcctcagaaaattaactcagaattcctggagatgcagccctggcatccgcattttctgaaagctcttcaggtgattctttaaaattgttgttgttgttgttgttgttgtttgagacagagtctcaccctgtcacccaggttggagtgcagtggcccgacctcggctcactgcagcctctgcctcccaagttcgagttattctcttgcctcagcctcctgagtagctaggattacaggggcgcaccaccatgcccggctaacttttgtattttttgtagagacgaggtttcaccatgctggccaggctggtctcaaactcctgaccgcaggtgatccacccgccttggcctcccaaagcgctgggattacagggatgagccattgtgcacggcctcttcaggtgattctaaggtggccagggttgagaacactgcttaaagggaggaggaaaccgactctcacaaccccaggctgtgggggtggctgccagccacagaccacacctaagggtccaagcctctattcccctccccagcagccctccccgaactgggacttgggatgtgggtggggctctccagaaggccccgcccctctggaccctagccctgcccctcggccctaagggtcctgtttcagccccgctgctgggctcctggagcagccctggctcaagccccagccccaagcccactcggaccccatcccgccaagacccccacctgtacgtcttgccctccttggcagtctcgcccgaggccaggatgggataggggactacaaggacaggcggaccccccgggttctccgccttgatctttttgcggccgcgttcggacttgggggggccaagcaggccgtggccctggattgtcttgatggagtccaggagaggggggctggtgatccctgagatgagggtgggggacgaggcgatgaggcggctctggctggtggtggtgggtgtggacggggtgctggtacccgtgcccgtgcccgcgcccgcgcttgactcagaagtgctcacagacggggtccgggtggacagccccagacctgcgaagacaggtgggtgggggcaggggtgagcggagctgcagaggccagctcagctgcccacccagctatgtgattttggcaggcgagcatccccttaacgttcataagttattacccaggggtaactaaatgagaccttgtgcatgtgtaagatgccttagacaccttaagattaaattgagttagataacaggggcactttggaaaaattcaaactatagaaaaatactgaggcacaaagaagttcactgccgtcttatttataacagcaaaattttagaggcaactgaaatatgcaacattagggaaggattcggtaaacagcaattaattgcctctactgaactgcccattgaaaaggaggttatgtttgtttaagcaaactacgtatgtatgcacacaaaaaaataagtaggaaagaacgtgccaaaatgtgatatggatagtagatcaggagtaataaaaaaaaaaaaaagaggcttaactgtgcttgattctttgacaatgagcgttttaaaaacttctgtaataaaagttattcttttaaaaatgataggactagaaacataatatcaactgaagcaaacaaaatcatgaaaatggtacctattgtgtggttctatgtttttttaaaaaaaaaaaaactaaaaatttgtgcattgaaaaagataatgtcaagttggcaggagaatgttttatatcatacactggtggtgggagtgtacatttgcaaagccttaatgaagccttaatgttaatgaagggtagtctggcaacagccattaaaatttaaacatggccaagcacggcggctcacgcttgtaatcccagcactttaggaagctgaggtaggagtatcacttgagcccagaagctgaagaccagcctgggcaacgtggcaaaaccctgtctctacaaaaattacaaaaattagctgggtgtggtggcgtgtgcctgtagtcccagctactagggaggctggggtgggaggatcacttgagccccagaggtcgaggcttcagtgagccatgatcacaccactgcactccagcctgggtaacagaacaagaccctactcttaaaaaaaataattaatttaaataaattttaatgtatacaacttttggccaagcaattctacttctagaaatttacaataaagaaatattcccacatgagcacaaagatgtgtgtacatatccatacaaaattgtgatcagacaaaattggacacaacctgtttgtcctcagcatgagctttgtaaagagctgtggtccactctcattagggagaactgcacagccactaaaacaagatcgatgtgatacagtgacacagagagaaggtcgaaatgagctgtcaggtgaaaaaagcaaatcacagacatacgaggccatctattttaaagaacacacactcaaactacatacgtagtttggacaagatatatgtgcatgtaaacgcacaggaatagatctgagaggagacacatcaaactgctaattgtggttctctctagggaaagagaataattttttggtaaaaggagattttcatactttgtctatctgattctgtattatttgaatcttttacctggtgaatttatccatttttaacatctgtgattaaaggacaaaataaaataaattataaacatatgaaaattcttaacaatagtaggattaaggctattttttctcctttcagcttatcggcaatttccaaattttctataatgactatgtattacctttataataaaaagtggaacatatatgtttatgacagaatggtgagtaggaaaagcaagttaaaatcatgggtacagccctaccacaagctcagcaaaacacacatgaacattgaaaagccaaaaatatggcaaaggaaggaaatggaccaacagcctctctgagctgctcagttgggagctggggattatgaatgatttttttgttgctagtttctcttttttccaaatttcccttaatatgcttatattactttttaatattacttttataatggaaaaaataaatttaataaaatcataataacaggggacatacagagtgcggctggggcctggagaggtttaccaggccctgtaattcttgggtcactctgggaaaatgcaggagagaaggagagaggcagaagcacctgcctagcagcaggggcgacaggggaggaacaaaggcccaaccactgaggtctcccaagaaagcctatccaccaagctccgaggaggcctccggtggctccagccccttgacattatcccaggatgtccgcctggcaccccagcctcaacctatccaagactgagctcacatctttccccaaccctgttctttctccggggattccatcacaagggcggtgccctgggagtctccctcacctcctccctcccctcacgctcctacatcctgtcctctcttctcccacaatgtatctcagatctgtccacttctctccattcccactaccacggcattgcccaggccaccacactcctgaaggtctccctgcttccatgcttaccccctgacaaccgggtctccacctagcagccagactcggttttctcaacccatatctgagtgtttcctcccctacttaaaaaccttcagtggttccccactgcccaagggtcaagtccaaaccactgtgtggcctacagggccctttttaatctggtccctgcttcctcgaagcctcagcagaactcagcatcaaaacagagtgaagatacaggctctggagccacactgccggcctctgcctcttactagctgtaaaccgtggttgcacgtggctttacctttctctgcctcagtttcctcatctgttgaatagagacattaaggtgaactgcatgaaactgctgtttttctaagtcaaaacggtccagtgttccacctaataccaacagcacacacctcacaggctgctgggagtacaatgaacactggtgaacagacacaggcgctcgactggagctagctgtcatcaccaccatcttccgggcctccccaccccagacggtctgtcctactcttgcttcctacacacatactccctccgcctgtgcggttccctcttcctgtcccatttccctggtttgctgccaacctttcctcgccttttggctcctccaaggaagtcttctcttaccccctaaatctggtcagggtcgttctctggattcccaaagaatctcgtgatttccaaagttctctatgtgaacctaactttcctggtgagccccatggggcagtgaccggctcctgtcgtgtccactggggggagaagggtccttccagtactgggtcgttggaagtccggtgctgtggctcgtcgtggccaaccccgccaccccaagctttatgccctacccctaggccctgcccgccctgctcttacctagccgggtcccatcctcaccaagtcccccgctacgcccgccccctcctgcccagtcctcgccggccccgccggccccgcccgctcggcctacctgtgacggtgctggtggccggccgtgcgtgcagcgccacgtcgggctgcggcaccgcctgtggatgcagccccggcacctgctgcagcttgggcagcgacatgacggcctggctgctctcggcgggtgccggcggcactagcaacggctgctgcgacgaggccgacgtgggcggcaggtgaggcggcctgatcttctcggccatcagctgctccttgatcttgttaatcagaaccaggttgtccagctgcgggaagaagaggacgggctgaggaggtctggaccacctcccgccccttgtccaggcccgctggtccacccgcgagcccctcgctcctcaccccgctccccgcaggccacagccaaaacccaggggaagcgaagcagcgccaaggagggtagggcagctggaggggcgacgtcagtcttacctggctgggcatggtgggaggagggggccagaagtaggggttgttaaatcgaggctcggccatcctgcgggaagagagcgactgtcaccgggaagagagccctccccaaggcctggggcgagcacccctcagctgcgcccactcaagtcagggccagtgtctgggatccatgtccccgtgggtcccccagcctcacagcacagcaggcctcccaccaggccaggaagccacatctccaggctgaaaaacctggaattcagtgacacccccaccacccccccttagtgggccccatagggcaaaggtcacatccagaccagagtactctcaaccagctcccacccctatcaccccagtgctggccaaccaatctccatcccccaggagggccccaggctgctgtgccaaccccgtaggttccatacagaaggccccccaagtccagagacaaactggggaggactgcagcaaatttgtaaatgcccatccctgatccctgctcttctgccccctgaccccttgagtacggacatccttctcaaaatcagggggcaacatgaggtcaccagatatagcctttctgaggggcagtttggcaggacaatttacagtgacccaaatgattattgccctttgactcaagaaattgtacttctggaaagttatcttcaagaaacaggccacgtgtggttgttcaatgtcacgtgcaacatctgacctacaacgacgtggatgagaatgctgtggttatggagggggctgaagaggctgaagctagggcagtctgcggctctttggtaaaagtgtgtgacaaactgtctggtggccctcacctctggcaagttccatggcaggcctgtgcggttagaaggccttttcaaccagggcagtatgaaggatgggccttcagggctatctcagtcttccagaaggtttgtcttcctgcgaccctagagtaagtcaagaagtgacttacagggaccatgcctcacagagggtttccattaagtcttgctccctgtcaagtttctcgtatctctctcttacagaaatcacttgcctaactggtattattgcttaaatgaaattgtttattttgacaggaaagaccaaaatgaagtgctttcaacctcttttcctgattctatgagcttgagaaacccctattggaatggtagctatagggcttcgggagaaaaccctcaataaggacacaatctaatctcaatattttaagaaagaaattttagatgaattatctcttgtgatctttacttgaaagtaggcacaagaggtattattataccattttatcagtgaagaaactgaggctcagagagaggggaaggaggagacctgtccaaggccacaaagcgaaggtgccacagtcaaaactagaaatcagatttgctcaagctggttcctctggggaatttgctttgcaaaccctagtctttggaagagcaaatgcccatatgcaaatggctcaatatctatatgcaaatgtccttacccctcactcccagcctgagggccagtttgggtcagagcaccctcctcaggtggctggggcagctcctgccctctatcagcccccctgctcctccatccacaggcaccaagatgctcttccctctgcccaccaatcccttacagcccaacacaagaagtacttcctgcctggagttctccctgaatgctccagacccctgggacatatcctttcccagaacaaactcgaaacaataattatggtgaggaggctgcaagttaccaagtgcctctcttgtgccaggcacaatgacactgaaaggcaggtaggtactcttatcattcccattttatagctcaggaaactgaattcagagaggtggagtgacttgttcaaggtcacacagcaagtaagcagagagctgagattcccactctaatctgcctgactctgaagtccagctcatcagtcccttacgtattcaggggaatgacgcatcctgaccacaggcttgtgaataaaccctaccttaggatgacacggctgcgaccccacaggtgagcacccgctcacacagcagtctcaggacctgtcccaaccctgctactgtccacagggggaaatgtggaggggaccaagatgtaaagccagggtaaggaggctccacggctgggggcagggagcttgagaattggatacacctgtcctgttcatctgggtatccccagcacccaggcccagaggttatcaataatgtgagttgcataatggaatgaataaatgaagtaataataatcagaatgactttaaagacaatcccatacaattatctagcactgctcacagtttacaaagctcttctgtgcccactggcattctcatcagaacc

SEQ ID NO: 12369 - DNA, 27933 bp, Human
  misc_feature (1)...(27933): n = A,T,C or G
gttgcatgtggggtgcacctggccttcctccaggcactggagatgcatgcctgcttcatccccatgcatgggtagatagggcagacacagcatggtgctcacctcatggagcttccagtccagcaggggaagcaaatatccccaacaaatgataaactgtgataagtatgatgagggtgcaaagggggcctgatttctgacggagagaaagggttgaagactcaggcagagccctgatgtttaacttcagggctgaaaagtgggctaggggttaccaggtgagtggagacaggaatagagaacattccaaagctcctccgagcccctgtggctggcaggggcatgcatggcatcttccaggaaatgaaaggcccatgctgtggctgccgcaaagtatgaaagggcaagaacagtatgacgggtgggcaaaggccagaccatgccaggcctttgttgccatgttaaagctctggattgtatccagaaagcagtgggaaatcattaaatgataagtagattgggccaggcatggtggctcgtgcctataatcccagtgctttgggaggccaaggccagaggatcgcttgaagccaagagttcaagaccagcctgggcagcatagggagacccccatccctacaaaaataagaataaaaaattagccaggtatggtggtggatgcctgtagtcccacctactcaggaggctggcataggagaatcacctgggcccaggagtttgagactgcagtgatctatgaatctgtgattgcaccactgccctccagcctgggcaacccagcaagacctcatctctaaaaaattcataaaataaaataaaataaaaatagattggagaggcagatggcataatcagatgtatgcttttagaaagctgtgaataacgccaggtgcggtggctcacacctataatcccagcactttgggaagccaaggtgggcaaatcacctgaggtcaggagttcgagatcagcctgactaacgtgaaaccctgtctgtactaaaaatacaaaaattagcccggcgtaatggtgggcgcctgtaatcccagctacttgggaggctgaagcaggagaatcgcttgaacccgggaggcagaggttgcagtgagccgagattgcaccactgcactccagcctgggcgacaaagtgagactctgtctcaaaaaaaaaaaaaagaaagaaagaaaaaaagaaaagaaagcggtgaataaattcttaggtatctgcaaggaaaggacttttgccatctaacttccctgggctttctctgcaggcctcttgacttccccacccaaggacccctgggagacacctccctgctacagtctcattcccagcctaaagttacagaggccccatgcctccccaccaccattccagtcctttcagcacccctaacacccccttcagtttggtttcccttcatgagttaataaccccgtctccttggctagcatgtagcgatgttggtgactcatgtgtgcaaagtgctttgagatccccagatgaaaagaacaagctatacctgggaacagggttcttatcatctcagagtcctgcccctcgttagctggaaggcagagggccctagatgacccctcggcccagctaagcacgcttttaactagtggaacaattttagtggtggggatctgaagaaacagcggggctggaggttgagtttgtgaatgggagagaactgaatgatgcccacttcattgatagattcagctccctgcccaggtaatgggcaccaaattctgatgctccagaagggcattttatgccagcccaaggtaaaagaaagcccaggcagtagaaattgtggagcctccccacttctttctaccccaccaggcaagcctgcaagcctgcaagccgacctaaaataagaagcaaaacgaagtgtccatttgcagtgccatggaaggcagcctcgcaagggactttctgggtcccctattccctgggaccttctccccacagcccccaccccaccagactcagaaagtaattggcagctccggttggtgcccagggccaggataaatagaaggtcagcttcctagagcagccccaaatcgagacacatcctcccctcttctgcttttaattcattgtggctagcatgtttattttgggtaaagaaaaaaaaatcggatgtttatccttcgaggaaattatcggcttgctttctttccttcccccaaccccctccttccttttgacttgacattttgggctttgagtttagctgctggagagacccccaccctcctggccccaaaacgtgaaaaaagaacaaagctggcccaggctctaggctgaagccagccctggccaggcgatccctggaaaccacagggaaggaggtcccagttgtggagaggggaaacctagaggccatggggaccttggggaaaacccagccttgacggcgctttccgcctgcagaaccctttgggcctctcatcccttttctttgcaccacctcctccaggaagaaacaagatgaacagctaaattgctttgagatctccaatgaagcagctaagaaaaatataagggagcattagcgacccctttaccaggtaaagagaactgacattattattatcatcattgtaatcagatgcatttattgagcactttctgcatatcaggttctacacaaaatgcctaatgtgtggtatctcactgaatgcatccccacgctacttcatggccttctgggggccttcatacatgttctctcatttgattgtcacaacaccctaataaagtggatgttattcttattttagagatgaggaaactgacattcctgtaagttaaggaacctactccctattccataactagtcatggtggaatctggtgttaactcaagcctcctcaggtgtagtatttagaggaaaactggactctaattttactctcttggctatataaaataaaagccagatcaggatctagagtgggacaaagagagacggccggaatttccagaataaattaaggggactcttctccaagtgactttccttactccaggttgagccatcctgggccatgtgtgatttgtggggatggccagagttcctggatactcaagtcaatagcctggtccagcccaaggccattaccgtccctccccacctgcccacagccactatcccaacagtttgccatccttagtccattgaatgacccctctccctccccatcattcctgtataataactgcttttaggtaaggaagaaaggtagaaaagaagggaaagccacctaggaaggctccagggtgatgatattgatgatggtgatgatgatggtaatgggtgatgatgcggatgatggtgatggtgataatgagacgatggtgatgatgataatcatggtgatggtgataatgaagtgatggtgatggtgatgatgatggtgatggtgataatgaagtgatggtgatggtgatgatgatggtgatggtgatgatgatggtgatggtgatgatgatcatggtgatgtgatggtgatgataaggtgatggtgatggtgatggtgatggtaatgatgatcatggtgatggtggtggtgatgatgatgatcatggtgattgtgatggtgattataaggttatggtgatggcagtgatgatcacagtgatggtgatgatgatgatcatggtgattgtgatggtgattacaaggttatggtgatggcagtgatgatcacagtgatggtgatggtgacaatgacgatcatagtgatgggtgatggtaatggtgatgatgaagtgatggtgatcatgatgatcatggtgatggtgatggtgatgataatggtgatggtgatgatgatcatggtgatgatgatcatggtgatggtgatggtaatggtgatgatggtgatggtgacgatgatcatcatcatcatagtgatgggtgatggtaatggtgatgatgaggtgatggtgatgatgatcattgtgatggtaatggtgatgatgaggtgatgatgatggtgatgatgatcatggtgatggtgatggtgatgataatggtgacagcaatgggtccaggtgtcagcactcagcagccaagggataggaagtaaagcctagtacatgcattcagtgatgccatttaaaaacacaagttttcttactgagcagatctgaattcacatagaatttttaccattgatacctccgtgaccttggcaactgctccagacctgtgtttcaactgcaaaaaaaaaaaaaaaaaaaaaaaaaccagtataatgaaaaataaatggaaataagtgccttcctccaaagatgtgttgcaatggttaaatgagatagcagggaaggcatctgagcacaatgcctggcgtgcaggctgttcggtaaatgtgcatgttcctctctttccctgcctccacctcacctgttctcagcttggctggagcaagcagtgaggcttagggtattgggaaagaagcatctctcccagaagagagtccttccccagagacctatcagaggctcggcagccccagggaaaggaccgactgccaagggagcctcaagcctcagcccagcatccccctcccaagctaagcaaaacattgggaggcttggatcaggaaagacaacccagttccttagcaactaacaagaatttccctgtaaagacaaagacccttcactcagaatgctccctccccctagcctccccaggtgtctgatctgctttgcaggagtggggctgggggcctatccaagtccccaggacatctagaggcctcttgcctcaccctcctggctgtcctgatattacctgcaattatcccagaacacctttcatcctggttctaattaatttttccacttacccccaggagcttctgggagacacatgagatacacacacatacacacacacacacacacacacacacacacacacacacacacacgaatgcccatattttccttctgagactctccatttgaaagacctgaaaagtatggttagtgaaaggagcccattttttgaggggttctgtctgctgcctccctggtatttggaaggagaaatgagagttgaaaatggtggttcagggagaagggaggacagggtcccaagttatcttaggggatgaaggacaacaaagggcttttaaaaggaccaaggaaacccatgctgggacagcggtctcagcgccacgtgccacctcagagcctccaagcacaggtcgtcctgcttaacacagaacattttaaataaaaaaaaaggaaatgttttaatagtaaaggaaaggttgagaaagagtgggaaacagaaggaaatagaaaagaaaaacatggctgtctagcctgaaaagaaccactgaccaggagtcaagatctgattccagtaccagcttcaccattcactgctgtgtgagcccaggttagtcagccactctctctgggtctcagtttcctcattgataaaataatttgggacaggtattctctgacacctcctctagctgaatgttctgcgattctatatggggagtggcagagaaagctatgaccactcgctggggcagagagtgagtggaagccactagaatggataaaataagcatttccagaatccagaatgaaagagagccaagtgtatttggctgcaggagccagaaagccctccctagtgggaggcctaggttaaaaggagtttacatatgtgggagctgaagaccctgggagttcccagaagcagcagacaggccagtttcccccaaacccaggccagagaaaacccattcaggggcccttagcacctcatggagggaggatggaggagcgcataggcatgggtctgcacgcagagatggagagcaggatgcaggagcacaccctgtattcctcatgagctgggctccacaccattggcgtaagtcagctgggcagagaggggtgggtaaaagagaagaggctgaccgtgtcgtgaaggagcagcaaggccactgagtcctaaccttgctttccagtcccatgatggaagcaggagagcagctgagtgtgtttcccttagggactgggccataggggcgggcctgggaagcaccctggaagttcaaacaccctccccctacccccacgaccccccacacccaccagcatgccagaagagctggacctgcaccttcaaatcactgtaaagaaacaaatactttgtacacatgctgcggctgtgaagccagcgcacagtcagcgcttctgcaggacttagggaggctcagctatgagccaataattgaatgcaccacagaaaaaaaaaaaaaaacttagatctccaccttcttggccaagcgcagtgactcacacctgcaatcccagcactttgggaggccaaggtgggtggatcacttgaggtcaggagtttgagactggcctggccaacatagtgaaaccccgtctccactaaaaatataaaaattagcctggcgtggtggcaggcacctgtaatcccagctacttgggaggctaaggcaggagaattgcttgaacccgggaggtggagtttgcagagatcacaccactgtactctagcctgggtggtacagcgagactccgtctcaaaaaaaaaaaaaaagaaaagaaaaagaaacctaggtctctgccttctggaagctcttctgctcttccagtgtggtgggagagaagatggacagacccagaggtggccaagagttgtgttgatggtgacacctgtgcaagaggtaagaagagagggataggaaggctggctaacaagggaggagggaccattccaagctgggaggggacgggagtggatgtagcagcctattgagggagaagggagcttgaggagagaggcctaaaataaaggacaaaacagttgctggccccaggctcatacctgcagttcactaacctgccctcaagccctgatctgctgatggcacctacagcccagtatttgcccacatgggccctagtcaccattgtccagagcccagctgtcttccttcgccaccccctgagaggcaagccccgcctgtccacacgtagacaagtgtgtgtacacacattgacacacacctctagtctatgcaacttgcacatgcttactgtaaatacaacagcccacacaaaatcacatggtggatgtacccgctagacactccaggatatcgactctgccaagctccttctagacatccatgcaagctgtgtacacgtgcattgctcagcatccacaaatgcggacatggaatttgcatgcacatgggatctccatatatgcactcccgccttgttcacaacctgtacacaccccagcccaccactgatacagagacacacctccgtgtggattagactgaggaccaggcaaggcctaaccacaactctcactttacatcttctgatgcagcgagtggatttttgacagcggcagtggaggtttcatggaggaggggggactgggaggagttttggggggtaaaggggaggttctggcagaagaagggaactaggccttccctgaagtccaccaggaaggcacccagacacatgcccttccccccagcagccctacctctggccccttgcctgctgccaggccagggaaaggagaagctaaaagtggcgagtctgagttgctaaattggaccttggcagagaaggggaaacgcgtcagttccctggggaagtggccgagcccagagcggccacaggcccctgggcttctactccaatggaacaaaagttgctcaaatagatctgacgctttgttttcaaacccaaaataccctgtggtggccgccggaagtgtgaccgcgggagggaagtggggcaagaggggaagattagttcgagtttccattgcggcatactttttctttcgtttggggtctagaagcacctttcctaccgcttggagagagtgtttgtgtgagaggggagtgcggctctgagatttggggctgggggacccacagcgcgacggcagtcacccttcttccgctgccatctctccccacggctggcttatgaaaacaaccctgtcctcactcactgtcagaatttcatctcaggccacctggtggcagggcggcaaagcccacccaggggaagaggggctgatgccgggggaaagggacatgtcgcaggtgactttgccttcagagaccagactttcccttgtgaactttgacgcttttttttttttttaacaaaaattctgtttacatagaatttttcaaagggcacccagtacgtgaggccatagctggaccaaaacacagacctacttattcagactcggtcctttaatgactaccaatgctagctccaaaatgcaaggattgcggaagaattacaggatctcaacttgtactccccatcaccttctctgcccttatcccaatttatttatcttcacacgacttaccggcacctcacatatgtgtgtttgtctgtgtccaccctgaacactcattagacctggacttcccccccggaaagacttggacttggctttcataagtgccatatccccaatggcttaccacacagtaggtgcacaataaacaattctcaaatgttgggggaaaatgggagaaagagaggtcatcagatagttctcttgtctcacgtcacttgtaaattcaaactgcttcggcggctctaccccagcctctggtgtcatgtcggggtgcagtgggcctccagaagggagagttggggggtatgataggaacacaatacaaaatcagagctctggcccttgcggaaaaaacttttgggggagaagggtgagacagacatttatcaaaggatacacaactaaatgtcgaaaggtaactggggacgatttccggcaacctaggagaggtatttacggtaacacctggaagagggtacaccgggaagacttttccgtgtgcggagactgacggatgcttggggtttgactctgtgaaggccccaaaccctacctggcaccgcgtggtgccaggtgaggcggggggtgcctccccctggcacccggacaccatggattcgaaccagtctctgaggaggccgagcggcgccgcccgcggcccgggcggcggggggcgcctgtgaacccgggctgcggttcagacgcggccgcgcggcctcgtccctgggtgctatttaccggcttttaatgacggcagggtaatcaccctaatgaaaaacgccctcggggctcagagcagccagactgcgatgagaaaaccgggaggcatctcggagcagccggtgagtcacagtgagtatgcagcgctgggcgcgaaggacgcccgggtgccctcccagccgcgcgccactcccgcgccgcccctggaacgcggagagcgtggctgcgtgctgcagggccgcagggtctacgccccgggcaccccgacccaccctgggaaacccggcgcacaccagccaagcctcctgcagacccgacttctccactgcaacttttagtcaggcctgcaaggggttccagcactaccttcctccctactcatggcctgggctccccaggggcctggattttgaaggggccactctctggtgtgttcaagacacccctgaagattccaagctctgctgggcttcacattcgctctcctaaggaccatttttctgccagtgcctcagtttccccaactgagtaccagtagcataagattctccccaccaccctccgcaccctgcccccgggtggcaagagtattcattacagtttgttcctggctttgaagatgagaagtaccaaggatcattaccactcaattaacggagctgttaccactggagtttaggtctgattaatctgccccctgccccctgccttggagccatgttgccccctgacaccccttccttggactcccgcaggctcctcctttctcctggatttcatacctggagttagcccctttcctgttcctgccagtactctcgggtcctgaaagagtgtctgccacattcagtcttcaacaagtattgttgagctcccccagagccaggggctagatgctgaggcagggcagtgaaggtcacagacccaagccttcctggagctcaccttctggtaggtgcccaaatgtctatgtgggatccagtgtatgtccagggcttccttctgccttccacctctccctccagggttccttgttcagacaacaaacgatgggcaggcctaggcctaggccaggcaccacagtcccgggtggacagtgctaacgggttctagtttcagagatgaaaacaacaaagttaacataaagaggaggggaaatgatcacagcaccttacatggaacaccccccacccttcctctcctctccccttctaatggcctcagcccctcctcaaggtcttggtcacacgccccctcttctatagggccttcccctcgccctgaacatctctctcttccaagcctgcggtggtccttaccaactggaacttcctgcttgtacctcctctggacgtgcatcatgtcttatatgtgatatttccactgagcctcattccacacttctcattaaactgtctgctgcctgacagcagaatccaagtctcaagtttgtttccttccaccaagaatgcacgggagttctccgtagatgttgccctcattgaaatgagagagctaaggcctagaccgggaacgctgcgcccaccgcaaaatggaattctggtggtcaagaggccccccatcctgtgctgtgagggttaggagagtcgggggtcatggggatagaagtaaaaggaccaggtgggaaggacaaagtggattagactcctactccaatcaatcatccatcagaatcaccaactaggacacttgaattgggtccacaagttcttactgagtactgcttggggccgggcacagtgctaggcactgcggagacaaagatgagtgagattcagtccctgccgctagggatcttggataccatctcttgtcttcagtaactttctgggtgaccctaggccaagtaattatgagcaacccaaataattctcagcgtctgagagagatcacgcccctcttccttcgcctatgcaccatgagccctggcagggaagcccatgccatcagtcagagcttcctagccaacgtgcagccctctagtggattccagttgggccaatattggcctcaggggccagaggcagccttggttctttactgcagtggctgtaaaaagtttcattttctatgagaactacagcatgacaaaggtcaggaagcgctgcctaagtcatctggtgaaagaggatgcaaatgccaccaaggagctccaattctgggccccaaagagtcattaactgctgttccctggatcccagagttttgactgcacagaacagcaaagaagaaaccagaagtcgggctccatccagttcctcacctgggtggatgaggccagcacctgattgttttaggctgagtaggctcctgaagctgagagctgataagagacattgatctagggtttgcaactctctctggtttcccgaagctgtttctcacagggcagggagaagaggaatctgccagcctttggatcagcgtctgtcccatgggcaaagcctttatccagcaagaagccagctgtgtggcaagcaatggaggtaagaacgtgctctcatctctttcgtctctaatactcgttcttctctctcactccctctttgcttcccctgactgcgtcctgcaccgtccccccacactcacaccttttctggttcatttcaaatcacgaagttcctctttccaaaaagccccatccccagagagtcctttctgcaaagacgcccgtccctgctgactgagaaggggctctcctcggggcccccagggggaatgacaggaccttcggagcacatgaccccacttaccctccctgaacccctgagctaagacagcgaagttcccactacaagctctcatccctcctccttctccctgaagaccccagcccaagccctacagagcccctaaatttcattaggaactctaacagacgtctcctctcaacccttctgcaatagaaccagaaactcatgaacagagctgggaggaacttagaggtagtttatcccagtccaaccccttcctaaaggccaggaataagaaggccttggcctaaaatcatagataattcatagcagaacccagaactcctgattcccaggccagggctaacacctaacatttacccacacaccacactttgcacaagtctcaccttctaagatcttccttctctccctgccccagcccagccagccccaaactctcatcctcaggactacccatggcagtgactcgctgtcttggacttgtatcttagaagaagtctccaggacaatccactttgtaaatgtggatttttcagaaaagtaaatggtactttttctggccaggcacggtggctcatgcctgtaatcccaacactttgggaacccaagggaggcggatcacctgaagtcaggagtttgagaccagcctggccaacatggtgaaacctcatctctactaaaagtacaaaaaaaaatggcaaggcgcggtggctcacacctgtaatcccagcactttgggaagccaaggttggcggatcatgagatgaggagctcgagaccagcctggccaatatggtgacaccctgtctctactaaaaatacaaaaattagtcgggcatgttggcgcacacctgtagtcccagctactcaggaggctgaggcaggagaattgcttgaacccgggaggcagagaattgcttgaacccgggaggcggagtttgcagtgagccaaggtcacaccactgcactccagcctgggtgacagagcgagactctgtctcaaaaaaaaaaaaaaaaaagccctgggtgtggtggtgggcacctgtaatcccaggtacttgggaggctgagacaggagaatcacttgaacccagaaggtgaaaggttgcagtgagctgagattgcaccatcacactccagcctggaggacaagagcgagacttcatctaaaaaaaaaaaaaaacaggaaaaaaaaatgttactttttctttctttctttccttctttctttctttctttccttccttccttcctttcttctttctttctttctctttctttcctttccttccttccttccttccttccttccttccttccttccttccttccttccttccttccttccttctttctttctttctttctttctttctttctttctttctttctttctttctttctttctttctttctttctttctttcttttcctagacaaggtctcgctttgttgcccagggtgtagtacaatggcacaatcttgactcattgcagcctctgcctcccagatttaagtgattctcctgcctcagcctcccaagtagctgtaactacagtagtgtgccaccatgcccagctaatttttgtatttttagtagagatggggtttcaccactttggccaggctggtcgcaaactcctgacctcaagtgatcctcccaccttggcctcccaaagtgctgggattacaggcatgagccacctcatccctccagtaaatgttactatataataggactttttctctttggtcaccggactttacctgaaattacttaaagtgtaatcaaaaatactcttatttcaacatcattataatgcattagtttgaatttaggcacaaacaggtgtttagaagagacgtatgtaattggcttggagaggatccggtggcctccgagacagcctaggaaagggatagccaggtgcagagtggcacagtggccattgcacctactgagaggccctggcagaaacagttcctccctgattcccgtgggaatggtgagtacccttattctcctctgggcgatggcttctcccatgcctccatgctgggtccaagggcgtgctggggtgcccctctcaagcttgcctttctcccacacgttgatttctccacagacttcatcctggttcctcctcttacccacatccaccaccccttttctttcccttgacagccacaatggggacaaaggatggagttaagagcattcgttttaaagtcacacaggacgaattcaactgtcagaccagccaggtagcctccagtaagctacttggactcttaagacttgaaagggcagccctaaagccttcctctcacaggattgttgtaaagaatgaagaaaattatggcctgaaacagtggctcatgcctataatcccagcactttgggaagctgagtcaggagtatcacttgaggcgaggagttggagaccagcctgggcaacatatcaagaccccatctctactgaaaaaaaaaaaaaagtttttaattagctgggcatagtgacacccacctgtagtcccagctactgaggaggctaaggcaggaggattgtttgagccaaggagattaaggctgtagtgagccatgatcatgccattgcactccagcgtggacaacagaacaagacactatttaaaaaaaaaaagaaagaaagaaagaaagaaaactgaagaaaatgaaatgtgtccacaaggcctggccaaggcaggcatcagatatcagttgcccccatcttccatggctagagcccggaagctcctgcagctcccgggactgggctcagctccgactccaccaggagcaccagcttcaaggtcttcatgaagcatgtgggaatctgtggggctgccaacagcattcccttcctaaaacttctaggcaaaaccagcctagcctctgagctggctgtcattatccaagaaatgacaatgacctctagaacgctaggcaggactggccaggaggattccactgtgacttgtccatcgcctatgaagccctgtggcacaccccaaaatggaaagcaactgaggaccctcaagagaactgccattcaggagcagtcccaccagggtgggttccgtacacaggtgcttggtgtgattggaggaaccgagatactctctgcaccccaagtctcccactccttgactctgatatgccacaaccagatgtcatctcaccagcattcatgagcacctaccactttccaggcaccacgctgagtattgggcttgattcctctgggttatatattaccacccctaagcgttttcttttaaaatgcaaacaccctctgagaagggcaatgcattagttagattgctcacaccgcagactgaattaattcagggtatggggagttctttattataagatatcagagaaggactagatatctttagcaaacggggcagctaaagttcagagggcagaggtgactatagaaaaaaggaccaagacagctgtaactttgcatttttctacagtggatttcagtggccacatctccttcctcctttgtccttaatcaagacaaacatgcccatgcccataacaagcagcagcagtccccataagtgcagctgatgagttggactccataggagagagcggccaggggctggcagccctggctctgctgcagaggagccggcctgcctttcaccatctccaggatgaggacgccctgaatcagtgcctactcgctccccagcaagttcagggcttagagttcaggtaattaggcccttggcaatctcacctgagcccgccaataaaacagacaaacaccttcagctcctgttcaggagggagagaggaaaccaggagggaggaaaccaggagggaggaagggaaggaggaaaacttttttctattctaaggcttggcaaccggaagggagaattcatttacaaagcagccactccaacaccccactcctgctccacacccagggttgtcccctcctgccacagaaccctggactccatctgccaccatcatcgaggatgacaggggacatctttgcaggctgcaacctgaacaggcactgggcactgagggcctaaccttgtagggcaggcattcgccagcatggttccttccagcagaggaaagaaggctccctcccattccaggagccacaccacccccaaaagatgtctgaaaggctgctccagagtgttagagagcaactgagtgacttctttgaaccctgccttgtgtcaccaccagctgttgagggctcagctcagttcatgtctgggctccttcagaccggggaccattccttaaccatccctggattgggacagtgcccaggagatactaggcacacagatttcgtttccccccctaaataatcaacattattaatacttcttgcatatgatcacgctggtctgtgatggagttccatacctggccttttttactacctatatcatctaaatttactcctgccacacacgagagggaagggcatatctgtcacaaggctgggtggggaagaatagtttaacaacaattgcagtttatcgggtgcttgcttaagggactggcaagtactctatgaggattatctaatttaattattcctaaggggtagatactattatcccaatttacagacaaggaaactgaggctaagaaaaaaaaaacagacgtttgcccaaggtcacagtgaagctttaatgaagactttaattgaattgaaggctcccgttttatgcaaagaactagtagaaaggagagggaaggaatcgtgtccccagactcctatccaatcttgctgacgggtaagcaagccctggtgcaggtcagcaaaccttgccccatgctcttctacttggaagcaacaagtccagcgtgccgaaaagtgttgggagaggggccgtctcctccagttgggagtggctgcactccacagcctctggggccctggaagcttaaggatcccaaatgcttccactgcctctgcctttcccaactcaggccccagtcgaacaggataagggcttctagctcctcactctgcagcccctcctggggagagatcctgacaggtggaaagtgggtgcatcacggtggggtcctccggagttgagctgggcggcccggaggcctctcacttccttcccaccacccccgcaggctgagctctgcctcgcgcggggagacatgggcactgcagccttcgggcctgcagctcgcccaggaccgcggaccccacagcgtctcccggccccaggcaggaacccgtggagaccctccgcagcctccgggtgcacgcgcagcaggaagcactctggaggggccaggtctgggactggcgcgcccgaagctcgctggttgccgcccctccctggccctccctgctgccgggctctacggccagaggccagagccgctggctaatttttcaggcccccacccccacccccaccgcctccctgggtgacgctacagcctgtgcggttcctttaaaggctgcgggttccgttcttctttccttttccactggatgccaaaatatgcaaatcttgggaccggaatctgcagccaaatcgagaaggagaaggggcgcggccggcgcgtcaccggatccgctccttgtatggctcttcccggcttggcccgccgccctgcgaccctccccgcagccgcccgggcccctcccgcacctagcccggctcacaccgccgcccacgccccccgaccggccgcgcgccccccctaagggagggagccgggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccccccccgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacaggtaagggcggcggggaggcggcgaggcagcgaggaaggaaggggagaggaagaggaggaggggacgacctggtgatggatggatggatggatggatggatggatggatggatgggtggatgggtggatagataaatggatggagagatgggggcgcgctgggaattttgcggggggcgagttgcttttcccacccactcctcccgccctcctcgatcgagaaggctaggttggcgacgccacggtagaggcttcggttctcccgggtgggggcagccgccgaccggagggaggtaggtgcgagcggctctggggttctccctcaccacgcagggggcccgatcgccgggctacgcgcaaggcgtggtgctgtcgccctcttcccgggaggagcccggcgtctttttcacccgcgctctccccccttactccctcagcctcccacccgggatggagccatgtgcggcgtggagtccccgcggtgggagaggtactgcgacgctgcctttccggggcgttcagcaaagccgtgggggtgtggggacggcggggagaaggagggggttcacccgcggggcgagggcctgccacggggaacgatcccggggccggggagctggggaagggcggcctctcccgccatggagacaccggccggttttccgccgctctccaccctccctagctggggctaggattttcccctccagcaagagcctaaagctccttcatgcccgaggaggctggggccggggtaggtgaagggagagctccctttgagggcgacacccttctacgctccgaggacaaagcgtcggagcgctctgggtcggcgacccgggagcagcgcgcgtggggggcatcgccggggagggaaaggcgcggcgtcctggagcggacagggccaagggaagaggccgagttgtgtgcggtggagagcgagagcccagcgcgctccgggtctgaaactacctgtagctgcagctacctgcccgccccacctcgggaagaacaacaatgcttctcgcgcgcgcgcgcgtgtgtgtgtggtacgtgagtgtgtgcgcggcttgtgcgctgtgtgtgcagcagccactccacaccccgatccgtagtattttgctatatccaggttgcgcccgggagcgcggcaccgcccgctttgcgcggggctcagcgttcctcttaccccatgcgctacgcactccacccggccgcaccctccgcacctgggcaaggacctgggcgccgcggcccggagccggatcggcttcactcacccctcccctctctcccccgctctccgcagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccctctgccctcccactccttccccttctcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacgtgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcagccggcctataaatctccttattttatttcttgtttttatagcataaagctttagtttggcctgttttttgtcttggtttgtttttggctggtggtttgtttgataggttgttatgcctaattttgctgttcttcctctgaaaactctcaaagtggaaatgtggaacttggtgttattcgaagtaggtcagaattttgtgcaaggttctggtgtttcaaatagttttgagtgtttactgtggtaccaggagaatagaattcccctccacccttctgtaagcctcacactgccagagggattaggcgaacaggttaggtaaattcatgggagtcagggctggtgactgggaatcttctagaaccttctttccagcttccaatgggtatttgggggtagaagggaggagatctcccggtttatgaacaatttctctagagacagtcttagggaatgccagaacaggaccctggagggcctgtcagccacactgagtagttctcttgccaaagcttttgaagcctgaaaaacaggtggagacttgaccgaggttcttcagggttggcaagatgaccagagagattggcagctcttctgtggtcagataactggaaaaaaatcaggttttaaacttctataattttaatcccgcttggatgggattcctctaggcctcactatttggagctgcctggtaaaggtgaacctcgctgaaaaccagctcctatgaatgacccagggatccaatgccttgaaaggaagaaaggacatttgggatttggagaacacacagggaatatttgcatagcctcaaactgccataccttatgatttctacctcccataaaagcaatgcttctcctatcctccaagctgtcttccctagaacattcctcctccttaacttaatttgccagccctagagctgtctccatttctcttgaggaaaatgtaacctccacttctttcctgtgtctgcatctgcattttgcacccctcaccttgttccccatagtccttggaaggctttatcccttgaggcttgttgtagagctgtctttgcacaagtcagtctttgctctctccccttcttcccgcctgccctctaaaaaaaactcacctgggttcctctgcagtgcatttcacatatgatctgcttcacccaggtttaggggcttggtgtataatgctgcgctataccccaccagattgtataaatggcccaccagcttgtgactggaatctgtatctcagaccctgaggtgccgaccaggtcagccacaaagcaacagaaatgtcgtgtccctgctcagaaactgctcttcggcatccccaaggcagccccatcacagagaaaaatatgggtggtatttctggttggctatagttaccaagaagttgaggccagacctgggcgtaggaggtaggctgtggccctagaaaagaatgtttttgaagtgagagatgaagaaggagaatgcagtatggaatcttaaattttcccacccacacaattttaggtcaccggctgccatcttgaattcccttctcttacctcatgaaacttctaaaatttcagactgtggcttcaatagcctcatagaagtgtccttcctttttaacaaagggaatccaagatggcggaaaggtcctaacattgagcatataatccatctctttgctaaactagatgtttccttccagatttctatgtatttctcaagtgagtagtatgggaggaagatactgtccctgactgtcttcatagtcagcatccagccccacctgcaccttctccaatcaaaccaggccttcggtgttacactttcatcaacagtgtactatgctgcatgattaacaaactcactatccattggtggatattactcaacccaacctggttcaaccactgggttacttggcaatatggcagtccgccaggctggcaccaaccctgtgtgatgtaatcactgattcacactttgtagctagataagactgtcccagatagcatcacaccagctacccaacccacctgggttttgtaaatatggggagaggagactcaaccctgaaactcagggatgaagtagggagaaggtggagggaaggcctagatggggctatcatgggagggaatcagtagaggctttgcaatgaacaggccctgtgccctagggcaaaatcaggcatcaaagtagggaaggggtagaggcatagctccttccaagaacccctggggtgtttggggatgaatgaaaggatgcccccctcccccccccgcgcgcgcgcgcgcgcacacacacacacacacacacacacacacacacacaccacttgggagtagtgtactgaaagtgatgactctttgcaaaattgtacttggtgaactggagttgagtataaatgagctacttagagagaacatggggcaaggcatggcatacgtttttgtgtggtgtgtggtggaactggtagtggcgagtgtgtaagtgtgtctttattcacaagcatgtcaaaaagaatagcaaggtggattctggtgaatgaaggtaatagctcgtggccagttgtcattgatctccttttgctaatccataatttgcttgtcataaatgagggggttgtgagc

SEQ ID NO: 12370 - DNA, 36387 bp, Human
  misc_feature (1)...(36387): n = A,T,C or G
ttcagaaactcatgggctgactccacatctactgtgaagtatggcacactcacaaatacatgcatacacaaatccacactcacatgcactcatacacaaatctctcacacccacatgcacactcatacacacatctagacacatccacacaatccacaaaaacacacacagacacacactcatacccaaatcctctcatgcccatgcacacacacttatacacacatataccaacacttttttctttttttttttgagacagagtcttgctggcccaggctggagtgcagtgagtggcgcaatctcggctcactgcaatctctgcctctggggttcaagtgattctcctgccttagcctccttagtagatgggattacaggtgagtggcaccacgcccagctaatttttttgtatttttagtagagacggggtttcaccatgttggccaggcatgtctggagctcctgacctcaaatgatctgcctgcctcggcctcccaaagtgctggaattacaggcctgagccaccctgcccagtcacatacaacacttatgtccatacacacactcacacacagtcatacatacatcaacactctcatgtctatacacacgaatgcacattcaacaaaatctcacaccctcatacacatgcacttattctcacaggcacttgcacactcacaggctctcagaggaccaaggctctcctcccatcctcttggtcaaaggctttaattatccccaacgcctgtaattaacccttcctctcttcctgcaggagagatgtctggacccgcttcccaagagtaggcaccaaggcgagaggccaagatgtccacatccggcagagaagacccacgtacctgggtagcaggtcccgggcatcaaagcgaggatggggtcagagaggaagaggtaggcaaagggagtctggggcctcccaggaaatcaggcctgccacagttgctcttcctggactggtcaaatggtgattggccaacaggcagccgtgggtggctgggcaggcgggccagagcaaatttcccgtttgtttcactcacactagccgcttctgtcaggaagggagatgagctcatgtctgaggaagttttgtgaagaggccttatcaaggggcaggtggtaggcaggtgtcctccaaactgtcaaaacctatcaacccatgccagggtcgggggccaggggtgccccttgcccccttccccaaaaagaagcagtggttcaagcagagaccaccaggattcaaatcctgcttctactacccgtgagctgtgcaccctttgggcatgttgtttctgctcttggagcctcagtctcctcttctgtaacatggggatgatgacccctgcctcccagatgagaattattaataaataagatagtgcatgtctgatccattcccagaggaaatgaacctattctcagatcatagtaggcttataggcttctgaacagagatactctttttgaccatcagcagcttgatatactcttcaagggttttaggaaggagggcatccaggtctatttctgggccactctctcaggcctgctgcttaggaggcaactgcttattggacccccaatccatttcagctcagaccttcaggccagcgttgagctcagtcgcattgagctcagtctcagaggtgaagggcagaatgggtatggctcagcgcaaaaccattaaacgtttccaccgaggataccaggctcagagatccctgggggctaatccgtaggggcgctggcgctttgagacgctcaaactttggaaggcctgcggggagcccgcgagtccagagggccccaaggtcctcctccaaacccctccggacttcccctccctctcctccgggtgccagcccggcccctttaaagacattcctgagggcgggcgttggtgacgtcacgcagggcatgaatgaacaggagtcggttctcacccaacttccattaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaaggtgagtgcgcgcggcgtctggacccctggcccccgggccccagtgccccctagagcccggcgctccttgacgcgcgcaactttggaacctacctggtgtcgcccagtcccggcgaactggagtccggagggcgcacgggctgcgatcgaggcgagccctggcccccacccggggtcataggggctccggagaataagcggtttcagcttggtcgcacgggcctcggaggctgcggagaagaggacgcggcgcaggccacgcggttgcagtccaggcggcgacttcgggaacgcgtcccggcggggggcgtggggagtcccctagagaagggggtgtttgggcagctttccgcgggctcagcttcttagtgacctgaattcactaacccgcttgccgaggttttgcggagaaggcatactgtgcaggcctcgcattttggggagggggctcgggcgggcgggagccccctgtcgaagcccctgttccctgagattttctccacgccccccttcacctccagtcccgggggagagcgtggagataggttcgggccaatccctgctcacacactcctttccctccttcccaagccgcactcccgggctcccggggcaggttaggggccgcgagtgcggacaggaagtcccaaagtcaagcgttctgagcaagggtgactcagaacgaggaaatgcggcaggtgggggtgcggcctcccaaggtgtggagctgtcagcccagggccaccagggagtcaggacacccgggggtgggggactgaatcacccacccccgccccagtgttcccggagccgcgccgagtgaggggccgcagactttgctcatggcgcagcgggtgcgtggtggggggtgttgtccctccgctagggtcagggcgaggatgggggctcctgccctggccgaagaccttcctgtccacccagcccaggccagcttcaatttccaacagtgagggcaaggcttcccctcctgcctgggcagagcgaggtttccgcaggctccacaagggggaagccgggaggaaacttgggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttgagacggagtttcgcacttgttgcccagactggagtgcaatggcgcaatctcggctcactgcaacctctgcctcccgggttcaagctattctcctgtctcaagcctccctagtagctgggattacaggtgcccgccaccaggcgcgtctaatttttgcatcttttagtggagacgaggtttcaccatgttggccaggctgattctgaactcctgacctcaggtgatccacccgccgcggcctcccaaagtgctgcgattacaggcatgagccaccacccccggcctgtttccttctttttctgcctcccaaactgggtttggaggttttgctgttctgtgttgggaggaaaagaggccggatctggagccgttgggcagtggcaggtgttgggggtggcatcctgtctcagtctctggagtgacagggcccgggttggggtctcaaccgggacttctggttgcaggagctcatggcaaggatttctgccaccctcaatatccgccccaccaacgtttggtcctcccccttcctgggggactgtggttggagagaaggggagagacagctggaatcactataggcctttctcctcggctgcccatgggggggtgggggattaggcgggtgctttgctgctgcagtccccaagctggcctggaagcctggagctgccttgtccttgtcccctgtgtccacctctccccagcctgtgtgattaaaccccacccccacaccccatgggatgcagggggaaaggcttgtgtattgcactggggtgggggtacatttttgcttcgactctgagtccccgtgaaagagtccctagagaagtgtgcctaggtgggggtgggcatgatggcctagctggcagctgctggtttcagttcctgggaatcaggctgtatgtggtgggtctgcctgggggtggcttagggggcaggcaggaggacacaggtgcctttttcacctacccccaggctgcttcagacttctttcttgccccctcacccctaggctatacttggttgcccacgtggctcctgttaggtcatcaacagccactgaatctgccctcatttttacaaatggggaaactgagggaggcccgagcccttgccaaccagggccttctggacagaggaccagacctgagcatcccgcttcttggctgccagagccaaggccctgcctgctttgtggttggtgtcatggtagattttcctgggaagcaggcatagctgggcaggggcctgggcgggtggcagggggtgctgagctggggtgctgctgatgggaagagggctggagagtgccaggaagtccttggtttctggttctaccggggccaagtctgccctctgtcccctttcccttttctttcatgttttccccagagtccccacctccctgcttcctttagggattagctagtcttggttagagaggaatgggggaagcggggagggaaccacagcctcggaggctgcggagaaggaccggagaccgggagtgggtggcagtcctgcatttgtggaagaagctgtggagcaatgtggacccacaaagatggcacttacggtggaactcatggcaaagaaggaggtgttttttgctttttttttttccccccagaaatgggaaggtaaggggatagagagctcatggataagccctgcttagcctaagcctctccaggaagccgtctgggtcagccgaggggctcccaggctcccaccctttccagagaagcgggagcctctgtccctggaagaacctggggaaagagccgcgcccgcgtcagggcggagggacccagcgctgggcgcctcctgttcctggtggttggttcgagggaatttccctgggagggggccggggttggaaacccctgcagggggggctccttcctgtgtgagggcttcttttcttctccgattgagccctgtgctacttctagagccaggcctaggctggaaagggagggccctccatgccaggttaacccttcagaagcctggtagcggtgagccctctcacttgggcacagacctcagcctcctgtcaatctaagggggggctgcaggactgtgaggaacctttgtccttctacccacccagctgaaatcaggagcctccagattccttcctgtgtagctggaacattccatttgctagtggggttagtgagtttcaaagccccggccctgggcatgtctgaacaaatccctgcccctgcccaccccgctgcccccagccaccctcccctatccccacagcctctgtcatggggccggtgtcacattggatttcctcttgcctgtctgggctgcctgacccttcctagagaggtttggccccggtcagtagtgggggtggcagcatttcacgccccagcctgggggccttcagcccaggtaggagggccatgtcacttcaggaggcggtcttcaagaccaccctcagagcccagctcccatctccacaaaccaggccatccctgctcccagcctgcctggagctctgtccaccctttgagtccttctccggtcctggccttgaggaatggggcttctgaggcagatccctcatgctccagggcccaaaggaagcattgacttggtttctttacccccaccttagggctttaccctctgaatccatcttgcataggttctatgccccggtttctcctatctccttaccctctagggagggtagcacttattggcagctacctggactttacttggaaatagagtggggacagtacctagggtcttaggttttgtctatggcctctgagcctggcagagaacctggggtggatcagtgggaggtgcccaatggcaggactaggtctagggaagaccccgggagtgtatccctccgccaggctccagttgcctctctgggaacaggatggtcctgacacctggtctctgggcctagaatgtcccctacaagggcttttattcctgatcccccaggaacctctggcacccctggcagggcagtggtcaggatgtgaggggcaggggtggtgggagtgactttcccagggaggggacctcaccagctgtgtgtatctttgggcccctcttaggggccctatgggtccagggctttatcctgcctgctctgtggcttttgtggtgagaagatcggtttccagataccctcttccctcctccaccctggagctgttcccacctgttcacagcactctcttcttggagtaccgcaagatgcacgtgtacatataggtgcatatgtgtgtgctacatgacctgagtggggttggtgtgtttcctgctggggggaatgtggcagaagcagacaccagtgtccctaaggcccacatgcacgtgaagtgctgccaaagggccttgttcaaggaagcagagggggcggtgtggtgtcacttaataccctgctcagcccagctctctgcccagctgctgttctcctgccgggctgagctccctggcctgctctgcccagctggggactaacggagggggacaggatggctggaatcctggcctgggagactggaggcccagtcctgaccccagcctgctgtgtgccttcagctgggttccatcctttttctgggcctgtttccctcatgagtcgagggatgattttcttggatatggtgaccctgtgtggtggggtccctctcgctctgtctgagagttggggttcctggagggatcctcacctttcctgccatggtctgactcctgaagacacccccaggctcaccccctctcccttctccctttcagtggtactgctggactttgctgcagctggaggggagctcggctggctcacacacccgtatggcaaaggggtatgtaagccttcggggtggggagaggtgtgagaatggggctgctggtcccctgtagagatggagaaactgaggcccagggagcgtggggcctggcttcaattcagcagctcagccaggtctcaggctcagggtccagcttctcacaccaggctcagagtcagccggcccaggccagggctggatgggcgtgggaaggtacgagggtgtgggtgtaagcctgagaggtggggggaactggggagacagagaaggccctagcggagctgggccttccatgttccagaagggctgacagtcagagggatctctggcaccacccatccacctcttgggagggaaggggttaaagatgccccctgtcttgaggtctcagcccaggaggtgaggggtgaagaagagacagggaacaggaaaacctgatcaagttccttcctgcccgcccctttcccacctctagctgttgcttccccttcctgtggggggctgcatttctctgcctcattctcacccaggtcttcccctctatgccgtcctgatgtgaccaggaatgggggcaggggctgggggttcttcccctggctgtgtgtgtctgctgtgtgatcttggggaagatgtggctctcggggcctcagtttccctctctatacaatgggcccttgctgagtttgtcctgggaccctgagctgagaaagggggctgtctcccaggggctacttggaatagttcccagagctggccagatctgcatgagtcgagttcttgtccccggtcaccctagctctgggcaggcttggctggggtgtagccctgagcaggtttctaggatcctggaagtctagctgggagggaacacgggtcacctaatacaacccagtctttatacagagtgggaaactgaggcccaagggcatgtagggccttggccaacgccacacagtatagcccgggcctctgtcctcctcccctgtgctttcattcattcttttgtttattcattcaacaaacgcttccctgagcacctactctgtctcaggccggctctcgggacacaggacacaggtgaattagatgcagactctggctgaggagctcagaatctcatgtgggagcccagatgtgggtgtccccatgtgccgtgccaagtgcactttggtaaatggcaaggggtacagggtaaagggaacatggcaactttgggagttgggtggcggggggcacctggcccaactgtagcctaacctgggaattctttctggagaaggctgagttatgatccagggagggaggaacatgttcatctgctgcaaagccaaattctaaatgacggagagcatcatccgttgtttttgacttaatgccactcctgcgtttgccaacacacatgggtgcatggtgaataataccaagagtaacaataatcatactggctgcccgtatgcctgttaccttgtgccaagcactgtgttcagccagtgtagacattctgtcctttatcctcacagcaattctgtgaggtagggggtcttgctcccattgtacagatgaggaaattgcggcttagagagcataacccacctgaggtcacatggagtcccggactccacctgcaggctcacaacctaatagagaggtttggcttccagacatgtgccagaaagaccaggggccagattccagctcagccacttatggatgcagcccccacccgcctcaggcctcagtttccttcaccgtagaacccggagagcacgaactggaaagcatcttcctagtgccctactctgccacctgggcctcagtttccccaggcacctgcccacactaacctgtatcttccccccacagtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccagggtgagtgacggttctgggttgcagggaaggggttctgcattcccaggttctggtctttagctttggaatcatggaatcttggtaagctcatccctgctttgacacacattagttctgttagtggaaattatagatccttcccagacatcagtttccttattaaggctggattaactcattcattaagaatgaatgaattgtggctgggcacggtggctcatgcctgtaatcccagcactttgggaggctgaggtgggtggatcacttgagcccaggagtttgagaccagcctgggcaacataatgaaacgccgtctctaccaaaaacacaaaaattagctgggtgtggtggcatgcacctgtaatcccagctacttgggaggctgaagcacgagaatcaattgcttgaacccgggaggtggaggatgcagtaagctgagatcgcaccactgtactccagcctggggtgacagaggagatgcttgtctgaaaaaaaaaaaaagaatgaatgaattgagaaacagcagaatgtggagtttatgattgatgactctgaaacaagaatgcctgtgttcaaatcccaggtctacatttttagctgtgtggctttaggccatttccttgacctctctgtgcctgggtttcctcatctgtaaaatggagaggatcatagcgtctatctcgtagggtggctgtgataatcaaatgacttaatagtaaagtgcttaggtcagtgcctgccacatgagtacttttaaatgtggctgttatttttgattcatcccacgaatgtatactgagtagctctggtacagcggcactgtggtcccacggtggagtaccaggagcaagttccatgtctgttatcagctcactatgtggccttaggcaaggtacttaaactccctgggcctcaaactcctctttcgtacatagaagtgactgagttggacccggggtgcacatcccctggctgcatatcaggatcacccgcggagcttttgggaaatgcttctgttgagggagaggttggaggggggccaagggtctgcctttcttgtctgaatgtccccagggccacaaatttcccattgggacctctattgattttccactggggcctctatagatgacacactgggcccagaaaagggccaattcattcagactctccttggggaatgaggcttgggcattagtgagttcacatggaggaagccgtggcgtggtgtggccagggcctgtgacagcggaaatctccacagcaatgtggattttcaatgggtgactttttctggaaatggccatgaggcagagcatttgtggaatgcaggccaacctttggagggctggctcattccctctctctggcagcttctttgctgagataagcgggacgttaaggaattggaggtttagtggctgcgttgcacacaccttggctaactcccccctcatctctggtcttgggtttcctttgagtaaaatgagaaagttcaacagcaccagcagactttatgcttgttttctagccatggatcctgcagcccctggagggggttgaagggttggaggacactgaagccctttgtgatgggccctacttgcctcctaaagcaagtcctcagaaccttacttaacacggtctgtaaaccccccgatgagaagttccctacgagctttctggccataagcctgtggtgtaggctctgctccggcccatgccatcgcccccttgtcttcccagctcccctctgctgagcgagccccccttccccaggcggcccctgctttaggtgacctcgaatgcatactctcagtttcagacaatgagtgcggttgagggggccgggacgaggcagcccagtggggcgagcaggctcctcccacatgacatcctcgcacaagaatgcgggggtgggggtgaggggcagctgaaaactttccacaggctggtgaggcaggccccgcagagataagtggacggttggggtgggggtgtctctccaggaagcggggcagccttccctcctctagaggtggggggtcagggttctggcagattttgtttgcagagagccgagcagccccctgttgggaagatcagcccagcaggaggacaagtttccaagagcgaaatttccgacttagttcgtggaaccctgtcaatcgctagtcacctactgccggattgttcctcctcgggatcctcccaccaaaattcctttcagtgtggctgggtgccggtgcgcgagatgccaggaacgcccggctggctcctctttatacctctagacttctctcagcagcccctggccatgctgctgctggaagtgatgacagtcgctaccgtagacgggtgtcgtccgaggggcaggcgctgagccaagcaagcgctttatcagacatgcgagcggaatccacaccgcctttctgcgtggcagggactgtgatcaatcccatttgatagaccaggaaactgaggttcagagagctaaagaggcttgcctgaagtcacacagctaggatgtggctgcatcaggatctgaatccaggcggtgcagcggcgcccaggctgcaggatgggtcaggaaatggggcgggaagtgaccagttcctttggaatccctgactcagctcctggccctggggtaggctctctggccagccctggggatggcagggtctgttgcaggggcttgggggctctgttggaggcaggggtcctggagagggcactgctgggtacattgagggagaaccagagggaggcacagggtctgccctccctgccggaccctccccaggcctggagacccagattctttcactggggctcctgctggtgacaaaccagacccagagcgaggcggggcaccctgaggtcacctggcaccttgtctaggttattcccagtttgtccgtttctcctcagggttctttccccaggaagcccagagctcaggaaagagttaagtgggcagaggaagggaggcacctcccaggtgctgtgtgcggcaggtgggcacgctgcccggagcgctcccatgaactatgtcaggaatgagccagcttcccttggttcccccgccctgcccccggccctgcctgcggggacagtggagtcgctcgggctgaccgctgtcccccgggggctgctttgtctccatgtctccgcttcctgtgctggcctcagcagctggcggggcccctgctggcgcctcagccctggggaccgctggtcaggtgagcaggtggccagcagccttggccagtggctcagctgaacagctgggaggccagagctggggttgtggggagttggagattccctcctgagaggctcctgctccctcaaggggcccagccccttggggaggtcccctccctactgtagtttcatgatcccctagttcatagggacaccgcattccaggcaccatgctggacatctcataagcagggctttcttccatcttcacacacaacccagagaggatgaggacttgatccccattttacagatgaggaaactgaggtccggagaggaagcagtgaacagtgaccaaaagaacgggggcctggcacaggaaggcagttgcccctggtgtgtgtccttccacccacaggctgtatgaccttagcaggtccccttggggtcccacccccatctgtaaaatgagtgggctggacctgtggccctgaaggacgctgtcaacctggtgatccgagcttccctcctgtggtttcccactggggctcagtctgaacaccggggaagctgttgactgtgtgacacaagtgtggtgaggaggggtcccactgcttacagccccagtggcctaaagtccatagctgacagggaggagtcccctggccagggtatgtctgtggttaaggtggtctttagacagggtggtctcgggccatggcaggggctgctggcaggattcctgtttcatcagatcacagttggtcccccaggtggaagactctgggagctgctggctgtggctcgcaggctttgtcccctgctgggaagtcccaccaggccttatttctgtgatgtttcttctggcctacagaggtgggaccacggtggcagcacccccagccccccatggtggctctcacctctgtgccctgtctgccccaccctcagctcacactgggggcaaagctaggcgctggcatctccgctgggcgggcaccggcttctccctccctccctctctccctcctggaggtaagtgggtccccagaacggaaggaaggaggcgagggaaagcaaacagaagatgaaaggctggaggcaggacaggagcggtaggcgggggctgaggtggggagtggtgcttatcaatggtggaggaatgtgcctgcagatagctccctagggtgtgtgtgaaagggacagggtgctggcagccgtcaggccctgggggcagccccccttctgcagagacgacagggcctgctgggagcaagaagccaccagggcctgaggttgtcagctccctcatttgctgggtcagtaacccataggtcgccatttgccgtctgtcagggcccagagacaaagtccaagctccacatccctgggccaaggtggttcctgcggtcacctgctgggcctggcttgggcggtgactggccctaggtgaattgccaccatgacctcttgacctcacaaccttgccattgccagcctgggaggtggctgtgccttgggaggaggggctccactgggggctggacttgcgtcacgataagggcgtctgtccctgagtcacctcatgctgccacctgaggggcgggcatcaggaactggaaaaaccagggtatagccggaggtgcagccactgtgccccagttcccctgctcggagtagcccaggcctgccagacaaccggggccagaacagctctccacaggtgtgccacaggtgtgccaaagttaggctcttgtgtaaggcaggtaggcatcctggtggaccttctccacagtgtctctctgggcgctgaaacactgctcatttctctggccctggagtgcatatttcacatgcacatggtaggtttgccacccattctctctcccactcactcttccatccacctgtccacccatccactcatccatccatccacccctccacccatccacccctacatccatccatccattcatccatccatccatccatccatccatccatcatccatccattcactcgtctacccgccaacccaccaaaccacccatccacttgtccattcatctatccatccatccatccactcatacccccctccacccatccatctgcccacccctccacccaaccacccacctatccacccatccatccatccatccatccatccatccattcatccctccacccacccaccctcctgcctatccatccctcatccatccatctactcatccatccgtccacccaccaacccacccatccacttgtccattcatctgtccatcctccgccccatccatccatctatccacccctccacccagccatccacctatccatcccgcatccatccatccactcatccacctgtccacccaccaacccacccatccacttgtccattcatctgtccatcctccccacccatccatacatccatccatccaaccaccactccacccacccacccatccatccctcatccatccatccactcatccacctgtccacccaccaacccacccatccatttgtccattcatctgtccattcatccacccactcatacccccctccacccatccatccattcatccacccacccatccatccacacactcatctacccatccacccaccaactcacccatctatccatccatccatctgtctgtccatccattcagcaaacattaactgagcaccgctgggccatgggacacagataaattggtctccattcctgctcctcaggagctgctggtctcacggaagctcctgatacatgcaggaataatttcaaatggagcataaaagccaagttttgaattcccctggagctgaaacagtgtttatctgtctcaccatcgcatcctagcacccagcattgtgccagacacgtatgaagtgcccatttctatttggtaaacataagattaatagatgccctaatgggggccggggggccaggaattgggcagtctgggagggctgtgtagaggagcttaagctgggtattaaaggatgcataggagtttgctggttggctaaggaacagtaggtatctggtgtatgtgggtgtgtttgagtgtgtgtgacccctgtccccacttgcccgcctagaatgccaggaaatccaactagataaagtcaggaagaacacaggggcttgctggtgtcctactcatgaactctgggacccctgagcacttggaaactctggcggggccctggagacagcccctggtagctttgtggttggaggaggggaagcacatctcgtcaggcaggcacatgccctgttgacgctgcctctctgctgtattatctggcacatccgcagcggaaatctctccaaattccctctttcctggcggcagcaggcaggcaggccacccccgggcgctggggccaaagagcccatctcttcccccacttcctcctcttggcatagaagcagccacacggtggggagtcggggcattgtgagggtttgcaggtggctaaagcctccagtgggtccgagcctgggctgtgggggtttatggcccctgcctggcctgagagcctgggctgggaacgcccccgagcttcccaagtcagctggccctggaccacctgaaccagcactgagccaggtgaagtctcctccacagacaagtcagggcatttgggggaactgaccccaggataaacatggcccagctttctggagtctcagttttactcacagatctggtggaggagagagctatttttgtatcatgcagatatgttatggggagggatgcaatatactcatgggtttccaaatacaataggagacttgaagacattcggggcttgaaggagaccacttcagccaccccaaccaacccccctgggctggagtctacacttttctgctcacagacacaaaagtgcccagtttgagaagatctgtggtggggaataccctcccctcctccacaacacatagacccacagctgctctgaaattcgtcaggagtttctggcttttgaagtgggtcaggccttatctcctctctcttcaggcttgtttcagaatgttgatttatctttgctccaaattgaagtgttcctaagaacagaagtgggaaaggaggcccggtgaggtggctcacgcctgtaatcccagcattgtgggaagtcgaggtgggaggatcacttgaggccaggaggtcaagagaccagcctgggcaacaaagacacaccccgtctctaaaaaataaaataggccggacgcggtggctcacgcctgtaatcccagcactttgggaggccgagacgggtggatcacttgaggccaggagttcgagaccaggctgcatctctactaaaaatacaaaagttagccaggcttgatggccggtgcctgtagttccagctactcaggaggctgaggcaggagaattgcttgaacccaggaggcggaggttgcagtgagctgagatcccaccacttcactccagcctgggcaacagagcgagactccatctcaaaaacaaaataaataaataatgaaaaaggagtgggagaggagagaggctgaaaatcaggcatcctaagtttgagttctggtttccttcttgggagcttggtgaccttggacaagcttttttgtctctcctcacctccaaagtggaaccagcgctaatagtgcctgtatatagcaggtctattgcgaggactaaatgagggtacagtgcttagcccgagccctgcgcatagtaggtactgtcattgggactccaggctctgtgcagagcaggagtcgggtcccgggcctcctctgtcctgctgcatgacctgggacaagcccccttccctgccctatgtgcctgagctcttgcagggccaatgctgagggtctgcagaagcaggatggaccaagggggtgagagcggctgtttgtgtggtccctgggccagggttgggaggggacagggatgcagcctggctctgagagcagagtcatcagcaggaggtcactatctggcaccttacagagctgggtgtcctttgagtcctgttcccctgactcctggtccccctctgcacctctgctcacacaggggactggatgacgagagtcttcgctccagattctgtccctgagagttagcaggtttgcttgggtcagggcacttgaaattgcttccctggagggggttgtccttaggccattaggggccaggttgtccccagggtcttggacaaaagctgcctccaggcacagatttttcctgacggcaggggtctgacttctccacatcagacctccagcggctttccattgcctccaggataaagtcccagcttcttggcctggcattgaaggcctttctcaactgttttattgcttgctgctccccacatttgtgcccacaaacccactcataccttccgtattagtcatgcactttctcactcctaactccctctcccaacatctatcattcccctgctgaactcctatgcagcctctgaaccccagccaaaatgtcccctctgtgacttctcagactcctggccaaggttgtttccccttctccacccccttagctgttagcttgtttcctccctctgtcttgcagaccttgtcaggtgcttctgctccctgagatcaggagtttgttttcatcttggtgcatacccagcactgggggtgggccaggcacagagcagaggatcattgtgtgtgtggtgaacacggtgctgaggttggaggtgtctcaggaccctctcatcagaacaatctgaaggattataattgtagggttgttggaggagctccctagggtgacctctacccaccctggccacttcagcagctgcccaagccctggacagccctgcaccgtgagccctgtgtctgggcagcttcctgcctgtagggccaggaaggggcttagggcaggggcgggatgagacaggatagggcggtgggaggaagaagcccccggagtcaggtgcctgagcccccagcctgctgggccaggacaggactggccactgggggaggaagagtcacttcctggctgtccttgtgagtggcggatatgactcggtcctggaagcagagccagagaaaatgccagggggcttggcctttcctgcttcctggtcagccccggatggaaaggagggcaggtcctgggctggaggtaacacctgcagggatggcatcctgaactgatgaggctggccagtgagtcagggtggtggtgacagtcaacaaacacacatggtcaagaagaggcagtcattgccctgggcagctctcagctacccaggtggggaccggacaggctagtctgcatggaggaaaggggatgaggccggtgggcagcgtgcttggtcaagtgctgagctaggctgtgatgggattcttggttggctgaaaggcgaggtatggccttgaatgccaggctcaggggcgtggtgcttcttgcaggagccagtggggagtgaagcaaaggtttgcagcatgtgtgtgaagcacttcctgggtgcccggtacatgctaggcccttgccatgcatttttccatcacaagacattttgccgatgagaaaacaggtccatagagatttactgacctgcttgcagggcaggggtccctggtgagggaatgagacagtcacgtggggtggaagcagattgaactgatgtccttgtgctctgtctgtcctgtgtccaccagcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgtgagtcttgcagtgggtcagggtggcgtgactgagggtgacgtgtccgcctgggtccagcacagcactgactcctcctgtctgtgcaggacccccttccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacaggtgaggtccaggggtggcagctgtgccctatggggcctgcccaggtggggcttaaggaggacggccatctggggctcgggtgtgtttagagagaggcagcagagcaagtggttaaaggcacagtgtctagagcaagcttgtccaacccgtgggccacatgtggccccagccgacattgaatgcggcccaacacaaattcgtaaattatcttaaaacattatgatattatttttgcaatatttttcccttttttttgagacagagtctcgctctgttgcccaggctggagttcactggcatgatctcggttcactgcaacctccacctcccaggttcaagcaattctcctgcctcagcctctggagtagctgggattacaggcacgtgccaccacacacagctaattttttgtatttttaggagagacagggtttcactatgtcggccaggctggtctcgatctcctgaccttgcgatccgcccgcctcggcctcccaaagtgctgagatcacaggcgtgagccactgcgcccagcctgcaattttttttttttttagctcatcacctgttgttagtgttgctgtattttatttgtggcccaagaccattcttccattatggcccacagaagctgaaagattggacactcctgctccagagccgcttctgagctctgtgactgtgggcaggttacttaacctctctgggcctcaatgttctcccctgtaaagtgggataataattgagaattgagactgggcgcggtggctcatgcctgtaatcccagcactttgggaggctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattctcctgcctcagcctcctgagtagctgggattacaggcatgcgccaccatgcccagctaattttgtatttttagtagagacggggtttctccatgttggtcaggctggtctcgaactcccaacctcaggcaatcctcccgcctcggcctcccaaagtgctgggattacaggggtgaaccaccacacctggccttttattattattattattattattattattattatttatgcactcgtaaatatggggcacctctgatgtgccagcccctgtgatggggccagggtggaggcctggggctctggccctgtgctctggagctgaaagtttaggatcctaggttgggatctaaagagcctgggagctgggcgtggtgaccacgcccataatcccagcattttgggaggttgaggcaggaggattgcttgagctcaggcatttgagaccagcatgggcaacatagggagaccccatctctacaaaaaatacaaaaattagccaggtacagtagcatgtgtctgtagccccagctattcaggaagctgaggcaggaggatcacttgagcacaggagttcaaagctgtagtgggccgagatcatgccactgcactcgagcctgggtgagagagcgagatcctgtctcaaaaaaatgaaagaatctgggctgtggaggatgtggctccacgtccacttgtccccccaaaccctgcctgctcgtaggcagcttcttacccacttcccccactgcctgtcctgcccagagccccccaaggtgaggctggagggccgcagcaccacctcgcttagcgtctcctggagcatccccccgccgcagcagagccgagtgtggaagtacgaggtcacttaccgcaagaaggtaactcccagaggggcggggctggctctagctgggccgacagcaggggacaggctggtcacatagatgatcaccaaaccacccagccatctgaagaagcacccttctgcagatggggaaactgaggcctggggtctgccagggggttacatctcccaaggcagcacagcagagatttgtacgagagaagacatggcgtccttggaagaggcagtcagggtgaggacaggggcagaattttgggaccccacacactcagtttgagtcctggctcatgcatttagtggttctgaccttgagtgagtcacttaattccgagcctcagtttcctcctctgtaagaagagcctcaagtttgctaacaaaggcaagccaccttgctagcttggggtggtctccagcgggctgagccgaggcccctgccctgccctcactgcctgctcctccgccggccacccacccacagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtgtgagttgggggaccctgggcatggaccaggccagggcccagaaccaagcaattgagacatcttgggaaaggaagtgaatcaaataacttagaaatgcccctttctcggtcaccggcggcctgggacagcccttcggggactgcccccaagcctggggagggggaagcatggaaggctgaggggtggaggagccgggatgtggattcacgacagtggtgtgaggaagttcaaatccgcatctcagaaaaagccagagctttgagccccacatacctgcaatacctcccgtgagaccttcgggaaggcctccgcttgaccgtctatgaaatgggactaagtaccctctggagccttcccaagtgcaagcacccagcacacagtaggggcccaggtgtcttgggtgcagcgcgggtgttgctgtaatttgtgggggaactcccttgtcatcagctgatttcttccaccagccccggagggatctggcaacttggcggtgattggcggcgtggctgtcggtgtggtcctgcttctggtgctggcaggagttggcttctttatccaccgcaggttcgtcagagcccataccctggctccacatgggcttgggtgggaaaatggggcaggaacctccatttcctcatctgaacgatggggcccacaggatgctagtcgagtctaatccctgcctccggatggtgcgaggatatacgagttagagtgtgtagcgaagtgcctggcacgcggcggggccgggacacgggggtcattacctctgctcttgttattaatgatgtgtccacacttcctctggacacgcaggcaggaatccccgagtagctctaatgggaatgccttcgtcacgactgcttaaggggccattctggggcctagatcctggagagggagtcctggctcgctcacttcctccctgttcctccacccgccttctccgcaccctcggccctgagagtggagcttgggcagcaaaagcggggactgggccgcattctgagcaccccaggtcctcctaggaccaaagtagggccaggaggcttccctggccggagcagacctcactgacctccctgcatttggttccccgtggggctctttcaggaggaagaaccagcgtgcccgccagtccccggaggacgtttacttctccaagtcaggtgagacgcagcccccgctccaggcccagccctgcccgcaccgtccccagctctgtgggggaggtgggggcagccagggtgttcccagggcactggggtggggccacaggcttccgtgggcagctctgaggggtccgtcccccacagcctggtccaagtctctgaagatcacgtgaccttctcctctgactccagagcaccccccatggggcccctcctgagctgcctgtgaccccaccccttctccttccagaacaactgaagcccctgaagacatacgtggacccccacacatatgaggaccccaaccaggctgtgttgaagttcactaccgagatccatccatcctgtgtcactcggcagaaggtgatcggagcaggtgaggttggccccctgccaaggggccctgaggaggcagcggtggtgacacagtgtgggagccctcatgccggggctgaccagggcactcccctgaccctgtctgcccacaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatgtgaggcttggggcctgcccacactgggtggagaggggccacttagcaggggctctgtctgtgactgtgcccacctcccctatacctgtgcccaccttccccccacacctgcacccacctcctctacaactgtgcccacttctccccaatacctgtacccacctcctaacacctgtgcccaccttccccccatacctgcacccacctccttacacccgtgcccacctctccccatacttgtacccacctcctttacacctgtgcccacctctccccgatacctgtacccacctccttacacctgtgcccaccttccccccatacctgcacccacctccttacacccgtgcccacctctccccatacttgtacccacctcctctacacctgtgcccacctctccccgatacctgtacccacctccttacacccgtgcccacctctccccatacttgtacccacctcctctacacctgtgcccacctgtcctcaatacctgtgccctcctccccaatacctgaacccacctctccccatacctctgcccactcctccgcctgtgcccagctttccccacacctctccccatacctgtacccaccctccccacacctgttccacctctccccacacctgtgcccacctctcctacacctgtgcccaccttcccccatatctgtgcccacctctcccacatgcctgggcccacttacctctcacctgtgcccacccccctacagacaagcccatgatgatcatcactgagtacatggagaatggggccctggacaagttccttcgggtaaggatgtgggttgtagggggcggggatgcctggccattgagcccggggctggcctggcgggttcagggctggcctgcagctgagcgcctgtgctccggcaggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtgtaagttggggaaggggacctcaagggagaagcggccttcgccctgcatggtgtcctctcacctgcacacctgggcagtgcttcaggaggcagaacacctgtaggagtccagggaggggtcgtggggcttggctgcaatggtcctggggccagccagagggcacagtggtgactgggcctgggttccctgcagggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgggtgcccttgccctccccaggcctgtccggacctgaactcaagccctttactcatctcaaactgcaggggctgggcagaggacagtttagatgaaccttcttaggcttgctccataaatgtttattttttttttttggagacggagttttgctcttgttgcccaggctggagttcactggcatgatctcagttcactgcaacctccacctcccaggttcaagcaattctcctgcctcagcctcccgagtagctgggattacaggcatgcgccaccacacccagctaatttttgtatttttagtagagacggggtttcactatgttggccaggctggtctctagctcctcgcttcaggtgatccacatgcctcagcctcccaaagtgctgggattacaggggtaagccaccgcacccagccccgtaaatatttcttgaggatctactgcgtgccaggccttgtgctgggttccaggagctgattcagagagtgcagagatgaaaaaaggagtggggtgtacgtgtgtatccgtgtgtccatgcatgtgtgtgcatccgtatgtgtgcacatgtgcatgcatgcatgtgtgtgtgtgtctgtgtgcttggtgcctctctcagcctggtggcctgggaggcttctcagaagaggtcacatctctgccaagaccaagggcactgtaaggcagccagatgagagggaggggaagagagatgggagggaggctgggctgagggtacacagtgtggctgctgcctggtgccctgtgagggagcagggtcccttctagctgggagcaatggcgcatgcctgtaatcctagcactttgggaggctgaggcaggagtatcgcttgagctcaggagttcgagaccagcctggacaacatgacgaaaccccatctctacaaaaaattaaaaaattagccaagtgtgttggcacgtgcctgtagtctcagctactcaggaggcggaggtgggaggatcacctgagcacaggaggttgaggctgccgtgaggtgtgatagcgccactgcactctagcctgggtgacagactgagaccctgtctcagtcaaaaaaaaaaaagtcccttccagtgaactctggacacagacccttaggcatttgccctttgggcagctctgaaggttgggtggcagctcaagaaaggcccttcctgtctgtttctgggatgttcctgttcccctcccctcccctgcccacctccataggctggaggctgcagagggtttcagtggctttctgcaacagcgcccctgaccttcgtgccccgccaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccggtgagttctatgccctctgcccatgatgacctcaattttccttctgcagactcttgaaccacttcggtagagtggccacccaggtgaagctggtagggggggtgctgggggctaagaggttatgtgtggacttgacttagactggacacgatggcccaggaaatcctaatagaagcaaccagcttatgtgtctgtgtgcagggcactgcgtgagcacttaatatgttttcattcatttaaacaacctacgagatgagtcctccagtgatcctcattttgtagaagaagaaactgagacacagggcgattgaatatcttacatggctggaagtggtcaggctgggattgtgacctcaggatctggaatctctgctcgtagcattttatgatgtggtagttattggtggtggtcctgttagtaggagtggaggggcagcagtagttacagatgctgagcgctcccaacgtgccaggaggtctcattgaaccctacttgactgggcttccctgttgcccagataaggagacggaggcacggggcagccgagtcaatcatccaggttagggagcagcaggtgcagggcccagggtggactgggtgctgcagcccctcacctgcagtgcttcctgttgcagcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgagtaagtcaggcccctttccgtcccccctcgcctcccgcctcccactccagaggctgcctccatgccccccccagccctcttccctgcccctcaatgctcctctctttgttctttctcttctgggaagaggctccttggaagagaagggcagaactccgccagcagctggcagctctgggtgcccactctcagctctctcctcttcctacatcctttaccagagtggggaaataatagtaaccgtaatcataacagtagctactgtttactgagggctatgtgccgtctctgcttgagcactttgaatgagaacccagcggggtgagtcctgttaacaggtgagaaacaggtgcaggtgagaaacagatgcagagaagtgcagtgacctgcccagggtcccacagccatgagggggagagcaggattccaggcccagtcagtcgggatcccagagcgcagggatcggagaggtcattggtagagaaacaggctgagatgttaccggcttgcctgaggtcacacagccagtttggggcagtcttctccaagatgccctgactgctgcccaggagagagaacccctggcctaccccgggcacctctctccacttggttggctctcagcctgcagtcccacctggtgagaagtgccacttactctctgctggccctgggtttgcccctttgtcaagctgccccttggcagctcttctccccttcccaactccagcattgagacttttcccggcatggccttggcacagacacctcctcctgtcccaggaagggggagaccctatcctcttagccttttgtgcctctaaaaatagtggccagtttcaacaacccagcttgtgcatggtcaaagatcatggcgggaacagaccgggaggctgggaggttttgggaaccgtatggaggggatgacctgggcctcccatggttctaggtcacagaagttctgggatttgagcctgttcatgaacattctctagggcctttggaaattgctcagctgggctcccaacctgctggccaaggccatagcctccctcaggggacagtcggtgatgggaagcaggcaggaacagagccgaccagaggggaggcggggacacgtagggaggggagatggatcacaggatgtcttttgctgcccgccagcccagcagggccacaggcttgggctctgcacacatacctgggttcaagtcccgcatctgccacttcctagcgggtgaccttgatcaagtttgatgggattgcatgggtgcagcgcagatgacacgactggtatacagtgggtgctaaatcctcattgctctcctcttttcctccactcccttgctttcctcccctagcactgtgcaaatgccccctccttttctcctttttcctgggaacatccaccagaccctttgctcctccaggggctcccaccaaggacaacacagcctctcttctggggaccagagctgagggcacggagaagtgcttatgggaaacacatgttcttagaagcttccctaaatagcccagggtgctcctcgccaattcctttcccacgagcagggacggggcagtcttggatggatggaggctgtgtgtgtgtgcgctgcagtgcgcgttgttgtgaaagggcctggataaaggcaggaagtcattcggcgccccccaccacccaccacccgctcctcccaccagccactggtgctcagagctggggcctgcatgcctcctccttcccctctgcctctttccaaataaatggggatctcaaaggactttttaaaacctgaagcctgggtctacacacgccatgggtcccaacgggagacttggagctggtagcaggggaatgcgtgcctttcccaatgggatcaggatttaggcttcagtgtcccacctcctccccttctcagcctcctgccttcttgactccctcccaggggaccagctgcctggtcccctggggtcccacagccactgtctcttctccatttgtgctattttggagtcagttgggtttctagctagactagtggtcccagatgttttgtgagcagctgacgaaaggcgtggatgttgcaccccagaaaaatagcccaaccccaggctctgtctagagctgggactacagcatttgcatcctgtgtgggggtcgagggcacaggctgtagatcttagggtctccagtgcccttggcataggcttggcactgaaggaatgcttgctgaatgaatgaatgatctgacacgtgaggctccaggagccatttcttactcccgtctccctgcacccagggccagaacacagtaggagctcaccgagtatatggccttggagttttctacgcagggcctccaaagcaaactgtgctcccatcctgtgagattaaccactaccatttgcaagagggaccagaggtggcccagcaacggcccaacctccgctaaagcattcattcgctcatgcattcatgcagcagacacttcctagggacctactatgtgccaggcctatcctggaccctgggcaggggtgggggcgggagcaggtgctgtgggggtgatgggcccagatgacaaggtctcagcacttgtcctcctggagcttacaacccactggtttttaaaccggatgtcaggtttcttctgggattcaaccaaatgcagactccttgccccacctgcggaactgcaaatcgagtgaatctggggtcaggccgggggtcctgtctccttcaccgtggtctgagcgcttttccagggaccacaatttgagaccttcaagtgtgtgggaaactgctgctttttcagcacctccaactgtataggttagaaacgtcctgtgcaggtagcgtaggaagttctcccaaatgtcccaaatgtctcggccttcctgctgctgtgggagcaccagcctctgcgggaggtcctggagtccccccaactcacctgggtctgcccttccctgctctgcgcctgtgccggggctcccggagcctgtgggaaagtcatgtctgcagaactgcaactaggatcttgcatcatataattagctccctttacagccaaaagtcggcccataaaaacttgggtgttttcatgggtttgggctagtgggtgaggacggtggaggagaaaactcccaaagtgagtaataaatgccctcctcacaggttcctgggagcataagtgatttcatgaggggacggaggggcatggaagggggccccaggagagcgtgtaccctgtgggggtgggaaagcagggctgtgggctcctgggcacatctgtccatctggtactgatgctgccttccccctcggctgctggttttgaggtctctcgccctccagatggacagtagctcccattttacacgggaggaaactgaggtttccccaagggaagacatcttcctagtcactggatctggtgacccgcaagcctcacccatgaagactcgcaaagtttaacccttcaagtatttcccaagtccttccttcatgatcagcagtgggaacttggaaggagtgagggagaaatgaggcagcaggtgggaagagaccttgggcagagaggctttgagcgacatccctagagagttcctgggaaggaggcctgagctgggggcactgggaacagactaggggtgaggggagggaaggcatttgttcatagctggtttgattcccagctcttccacctcctagctgtgtgacttcaggcaagtcactttacctctctgacctcagttctctaatctgcaaaatggggatgaaaaagagcacctgcctcacagataattcagaagatttgatttatttttatttttttaaagcatcgtacagagttgaggcttctgtcgttttcctaactttgttgatggtgggccaccttggcaagcttctaggctgtggctccttctcccaggcctacctaaccagagctctcttgccctacaggtccccaaggcaccctctccaccctcctcctctgcctccctccactcccctccccagccgcccaccgagtcctgtccccacccagcccggccccctcccctgctccagcccctaactctccctctctccctcccggcccacagcgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatgggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccgatcttggctttcagtcttgggaaaagcagtggggtcccagagcttcctgggtgggagttgaggggctgagggttccccccaaacccctagtgtttaaacagagattcgtgcacaaggcagacacgtcacttaaccctgggagcaggggtgggtgggaggtgggcagggggccgggaagcaggttctgccgagcccggcctccatgccagcaggccccaatcacctttgatctccaggctgctcagagtcttcgggagggctgggaggtaggagaacagcaagagccgccgtcagcttccctcccacggctccccggagctgtcgaaatagatccttcaaccatccatgtacagctctgaggtttacacaagcttttcacaggtttcggcttgtcggaacctcaacactttgttatgagttttgtgggcggccccattttacagaaaaggaaaaccaagctggagcccagcaactgggtttgttcaaggccacacagcaagttaggggcagaggccagaattgaaagcaaggtcagaaatctcagtgggatgcttttctcatagatgaggagatggaggctcagagacatgcagcgacttgcccaaagtcacacagcagtctcaagaaaagccagagttctaatttcttttttttttcttcttttttttgagacggagtctcactctgtcgccaggctggagtgcagtggcacgatcttggctcactgcaacctctgcctcccgggttcaagcgattctcctgtctcagcctcccgagtagctgggactataggcgcgcaccaccacactcagctaatttttgtatttttagtagagatgggatttcaccatgttggccaagatggtgttgatcacttgaccttgtgatctgcccacctctgcctccaaaagtgctgggattacaggcgtgagccactgcgcccagcaccagagttctaatttcaaacctgagccttctccactctaccgggttgcagccctgcatgtcagaggtcgttcatagtgggggttaggaaggtgtcaaacacaggtcaccaggaacgtaaccagggagcagagatgatctgaggcccaggaggaagacttcctggaggaggtggtcccagagctgagacctcagggactactaggaattaaccagcgaagccaagggagggtgatgcagagtgaggcgcgggggcgtgaaaccacatggttgtgcaagggaaccacaagcaatttggtgttattaaggcatgacgtgaggtgctggagaagtctctagggccttgtaaagcaggcccaggagtggggatttcaagttgagggcaataaggagtcattgaaggtttcaagcagggagtggcatgattgttgtcactggtagaggcaggtctgcaacccagagctcctgactcagcctggagctttggggagatacaggagaggcgctggcaaaagtcgagagggtgttcggcctgccctggggtctcaaagctggcatgctctgccctggcccctgctgctgcaggagagctgccaccctctgggtcctggcccactgggcatccatgagacacctgactgtgtcaggtgcggctggggttggtgagctatgggagtgcagggagcacctggctgggccttcctcccattagtgttgggccacctgagtgtgctgggcatgatggctgagtcaggccttcctggtgcctgaccctggcctggcctgacccaggtggccactgtagctctgtggctgggctatggctactgttgctaccactgacaaagctgttggcccagcagggaataagcctgcagcttgcaaatccacaaaaatctgggctatgagggcacatcaagaccaggcctgagtcccattcccaaagcaactcagccatggccctgctgatgagcaggaatgaactcaggaagtggctcagcatggggggaggtggcctcgtgtgctctctcccttgaagtcctggacataagacc

SEQ ID NO: 12371 - DNA, 152145 bp, Human
aatgtccttctctctcctttgtcaaggctgtaccccagcccctgtccgattttctattctcttctttagagacttcatctacaacccctttgctgacaactcccaaatctcaattctttctctccagttgctacagggcacttctaattggaggttgtgctgtccccgcttgaccttcctgtctttccagctgtatggtcctatagcaacttccctctggccggcccttggtgcctcatttctggagcactgcagacatcctgggctgttccagcaacaggccgcggcccctgcagcccagtcggcaggcagacccagctccctaacacagctctcaacagtggcctgcctgcgtgaaccctccaagcgttcctccatctccccccaagtctggttcaggctcctctgcagctcttggggcctctcttacctggccccttgccctcagtccagtcttatttcccacttgtctgcacaatgtctgcaggcaccgttccttctttcctcactagcagtgtcctgcccactgtcctccatccaccaagtcacagtcaaacccgcagcacctgtggcccttcagccttcactcacaatgtatcttcccaattaacaatcctgctaggacaggaataagctcttaaacttctccctctgcccacagcatatagcaccagtccttactaacccatgcactaaccgtgccgcacgcagagtgacagagccctgtccctcacctgccatctactgatgtccaagctgggcttctggaaggacaggcctctgagcccaagcgagacctacgagttttcctaattttaacttactcagttcttatttcacctactctattcaacctgcacaagttagtacctaccatttcagattttggcatggaactgaattatgactgatgcaacaggaagtgtaaacgttctgcagtctctttgggaccaagctcattcttgggttagatgatccattttatatattctaatttattgcttcccactcgttatttggcgcatctttacttactttactccatgggtataaaatgcgaaccattaacagcatttatacgtgtatggcctggaaaagttacaaactcatagatctatgtgtttctccgactgcgctattttctcctaactcttggtgtctttctgatgtagaataaatactgatttccttagtcctgtagcaagttaacaagcctgtaacgtgacagatctgtatcccaggggctgatcatagagaaaccacaaagcgatgttttagctgcgtcgagtcctcaacacgggggacttccagcctggtaccaggatagcctctctggcccagtgtgagcgaaggttcgagctgacttgccagtcccgtgctaagtctcactgaggcagggccttgctgccgcggaaaaacgtgtggacagaggaacgcgccggtcggatgtgggccacagtgagccgcggcgtggaaacggccgaaatgtgcgggcgcgttgtccatgtttggtcgtggagctgcccgcgggcgcgggaacagcgcgtcgggggcgggtgggcttgggtgtccgtggcggaggttaccccgggccccacgcgcccgctctctcccggccttggtctttgtccccgcgcccccgcaagggccgcccgccgcgccccgcagcccctgagcccccgtgcgcggaggcggggcctggccaaggggacagcgggcggcagacgcgcccctgcggctcccaggccgcccgggccgcgctccccgcggggaaagaggccgcaggcgcggggaggctcggccccgccccgccacgtccccctcccggcccgggccccgcggccgccgaggccgccccctcgcgggcggagcgggcgctgggctcgcgcggctgcggcggcggcggcgggcccggggttgccatggtaaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtttggaaatgactggatgaagaactcgggaaacaaatcctttaataacaaaaccctcctgcgaggatgcacgcagtgtttggacccccagaacccattcaggtctactttaatgaaatcatcacaatttaatacaatctagagctttttaaatggaaagccaaagtggacctggcctcagtgttgcttcttattttgtttatgggataatggattcttttttctttttttgtttttgcaattttacaggaaggaaacattcatatccaccaatatggcatctttttaaaaatatgaaatcctacatgcttgaaagatttcagtctcattggcagggttgaaaaagattttcatagcacactgaatattttatcagaacatgatgtgtgataattcacgcacaaaagttaaccacacttttttttttttttacatgttggatttattgctccatcaaagggccccaaaagtttgttaatgggaaaaaaaaatgtgtatttgatagaatttgcttaagtgcagtcggaataattttgaattctagaccctttgacaactggagcaatttattttgctattgtattgtgatttagggaaagttttcttgttattcgacacctgtttgtcactgtagcagtaaagagtaatgagtgtgttgattcatcctctgtagtggtattttttatctctggtgaaatttatcatcttgttcatggtagaatgtatactctgatagcttttgcagcttatactttacatctgaaccatttgtgggccttcatgaatttagtaattccctcttcagtggaattaaagaaagtttctgctttttctctgaatttaacgccagtttccaagagcagaacacctgtgtttttgagcctcagaaggtgttgagggcaggtagaatgtatttggtatgctggtggtccctggaatactttatagtatagagtcatgggaacggttttgctctccagtaggttaaatagattcctcaattaacattttgaataggttccttaattgacttataatcaatcatatttgaattattgtttttgatctaaaaagtagttatatgcttatggtagaattctccctatgcttagttggaaagatatgtggctgaaatttgtattaaatgactttgaggcatcaggtcttacaaatttaatctgtgggcgtattattgacagcttgatttgcgatatgaaaatgagcctagatatttttattggagcagttgtttggggcctggtcatactgttcctaaatagcagtttagtcatgaagttgacctacacgtctgttcatgaatgttttcgttttctgcattttccttttaattgccagcctagagatattggcatggtattttactggtggtgatgtccagaagaaagtaaaaaccaactcttatattttgtagaagtattggtttaaagaaaaaccaccttaactagaatcaaacaataagatcactttataactattgaattacttttctcaaaaagttctcagctctgtatttgttattttttttttaggttgtctaatgaataaagtttaaagcaagagtggcctatggggcagaagtcaatgttaactggtgatgtcttaggcaacagatgttttgatgtgaaacattttaagaggctttcattaagtgaagatataaatgaatacaagtcagttaattactatgatgattcaattaaagcagtggatcacagaaatgccatttcactaggaactaaattaaacatttggatatttcattagctacattggcaaacaattttttctttttaaatgagagacttacattacaatggcaagacagcagcataatacatgaactcatacattttcatatgttcagtatgcgtcatgctgttaatagtgacagaaactaaaaaatcatggttacagctttagaaaatataattcacacatattatttggatgactgtcatagttaatttccttctggtcaaataaagacaagatcaagatatgcgaagttgaggcgggaggattacttgcagccaagagtttgagagcagcctgggcaacatagcaagacccccctctacaaaaaatttttaaaagttggctgggcatggtggcttgaacctgtaatcctagctactcaggaggctgagatgggaggattgattgagcccagaagtttgaagctgcagtgagctatgactgtgccactgtactacagcctgggtgacaaagtgagaccctgtctcaagagagagagagagagagagagagagagagagagagagagagagagagaagataatgtgtaaatgagaagggagaaagagaaaagtttgttctaatgaatgaaatttctgtcttctcttatacttctttcttggtgtctctcctcataatttgtagtggacattaaatgcaaagttaggcagtatctagcctcctgaaaaggctcatcctcatctttcaggaactgtctttctcatttaagcagaaaatgtgtgcattgttttcttcagagtatttgaaatctgtaaagtgagctagaaatcacaagcttttttttttttttttctttgagccacaccttgctctgtgacccaggttggagtgcagtggcatgatcacagctcactgcagactcaaactcctggggctcaagcagtcctacctcagtctctcaagtagctgggactacaggtgcgtgctatcatgcccagctcacaaacttcttttaatgctgggaaaaaaaaaaaacctgaagtgttttaaaaagtgaacagtagctatcctttataagacaatttatgatttgggaaataactccatattttcttcgaggcctcattttgaagtaggtggtgttaccatccttcctttgtgcctgagaaaacggaggctcgaagagatttggcaactttatcaggccacagaactaggaagggcttggataccagtctaaatctttgtgtgtgtatgtgtgtgtgtgtgtgtgtgtgtgtgtgagagagtaatagctttattgaaatatttacataccataaaaatgtgtttttaaagtgtaccattaagtgcgtgtagtatattcacagaattgtccagttgttaccactctctgattttagaacctttgcatcactccagaagaaaccctagtacctactagcagtcactccatgttcccccatcgccctcacccctggcaaccattaatctactttctgtctttatagattctgggcattttatttaaatggaattatagaatgtttggtattttgttcctggcttctttcacttagcatatgttttaaggttcatccatgttgtagcctgtgtcatcatgccattcctttttatggccaaattatattcccttgtggagagataccacactgtttaaatctgttacttgttgatgggttatttgggttatttccactttttgactcttatcaataatgctactatgggcactcacatgcacatttttgtgtggacctatgttttcatttctcttgggcagatatctaggagcagaattgctaggtcatatggtaactctgggcttaacatttttaggaaccagtcttaactttttgaaacctaaatattaagcttgttttattatacatttttgataaaagaataagtaattaaggaaatggatgaaagagggaaagaagtgggagcaagtaacaaaatgttgctcatgcatttccatgagtcctttggatcctttgatcaatcacagctcaccaaaacgagtcagtgcacaactgcacgtggttgccacaggttataagaatctcagtgcctgaacggacctggcaagtaatctcatctcatggtttactttcttaagcctttgagctgtttcttcaaagtaaaggttacccaggaacccaatggtaaagcagatagatacagagctggcatagctgacagggagtggggagaggatggtgctttggccctcctctccttcccccacccctccagcttgaaatctctgccctgtgggggaagctggaaaggctgttcaaagctagaaaggctgttcaacctgtgcatgagcattttcaagagactggaaagtaactacctctccaggcaatccattttttctccagacagttcagactgtcagttcctacaagcagtgaaaaatcagccgaagttgtgttccttgggtccgtagagaataggtttaatatcttatccatatattaggtcatcacatgtttgaagacaatgattatagttctttctcacatcttctagctcttaagacgtaattttagacccttaatcatcctggttgcttcatctacacctgtttccttttgtctgtatttctttcttaacttgatacaactgaatgtggtattccaggcatgttttctacacaaagaagattagaattggatatgtcacctcccttattccaaagtctatactttttttttttttttttcgagacagagtctcactctgtcgcccaggctggagtgcagtggtgcaatcttgcctcactaaaacctccgccccctaggttcaagcagttctcctgcctcagcctccagagtagctggaattacaggcgtgtgccaccagcctggctaatttttgtatttttagtagaaatggggtttcaccatgttggccaggctggtctcgaagtcatgacctcaggtgatctacccttctcagcctcccaaagtgctaggattataggcatgagccactgtacctggcctatacttctaataatgcagcctaaggttatatagactccatttcttgtcacatcacattattaccttttactgattttcaagtaaaattcttgtgtactttacatgtactatggctaaatcttttcttaaatttaattaccttttttttttgagggtaagtttcctcgaacaggcagagccctatcagattacaacaccattataatctgtgttgtaatgctataaataatcccagcacttactaagatatttcagcattatagtaacattgaaattgaccattgccttacagggttgtgattgtggttaatagccttttttcttcttgccttggaaggtgtcatgagagaattatcagatgccctctaaggcctgactggagcgtatctgccatgtcccagatctggcctggcttcttctcctgcaggtgctacttgttagtaactacagcgggtcgagtccatgggacctgcccagtcaaattttgaaatcactataataatcctttgagcgactgaagtttattttttctagttttgcaatggaatgttgttttaatttctaaacatttatattttggaaattaacaataatttatttaataatcttaaacatcttttgacatctctaatactgatgacattctcttaactatgattacagcaggattttcaagttgacacctcgatggttataaacaagtagttggatttaaaaggaacacctgtaaggaaattatccaaactcaacgctccgaagtattttcaggcctcttttgcattctcatgcagtgacagaagactgactgaggcattctgtgatagcaaaatcggaggaaaacgctttcatggaaaagtgcaaagcaaaagcacccacgctaagcgagaatttctaattagtatacttggtgctccagccaggaaggaacttatagccaaaccacaaccatttatcacattataaacaaacccacgcattttggtggaaaaaaatcacaaaactgtgcttaaaaagtaaccattaattggttattgtccatttctgggatagtgtaaaccttttcacatattctcttaaaaaacattttagttgagtggaggttggataagagaggagaaataacatctttgtttctagtgttacagcttgttcatgctataaaactagtagcgtgaaaaccttcatcatggataacattgaaaacggaacatgaaagcattgctctctctagtaagacagtctctccaaggacttaaaatcagtggcattttgtactccttacaaaaatttctttcaggaacaactattcatccttaaaattttatcaagctcattaatagagggtttctagtattagcaaaatttttaaacaccttcagaagcattactaattacaaacaaaaagtgtgctgtaaactctaaaagctgtataattattattgataccacccgtcacccccagcttcatgtttttctcactagacgtttggcacatagatttcatttctgctgaaggctgcacattcattttaatctggcccaggactgggggtgtgcgaaggtgtcagcaggagcaagtgcatactctctttggtttactttttaagaaatacctcttcagaagagtttttctttctttaaaggacttgttttttttttaagtttaattaattatttattttttatttagagtcagggtctcactctgttgcccaggttggagtgcagtggtgtgatcatggctcactgacctcgaacccttggactctagcaatcctcacacctcagcctcccgagtagctgggactataggcatgcgccaccacacctggctaaattttaaaaaaattttttagagatgcagtctttctttgttgctcaggctggtcttgaactctcctcaagagatcctcctgccttggcttctcaaaatgctgagattaagcatgagcccctgcacccagctaatttttaagattcagtttagttagatacatttccatttttgtttactctaaggttctacctttactggcaaatactgttggcggggaaaaccattttttgcagagtactctcagttgtgtgttaaaatgcagtcatttatttattctgccagctttctggaaaatatttaaactctctatctttaataaaccatccccacagtgtaggggcaggttcgacctatagacttgggtgatgcctgagggcacttactccaagcccagggcctgcccgaggtagggagtcttacaggagaccttcccacctgccgaggccctgctgtcagagggaggggaagcagaggtgactggccccctgaggccagcggccagatccatgcatttatcatggtgtggtccaggactggtggtacccttcactctgcaaagcccctgtaagggagacccaccgtcctggactgcagattcttcccacaaataacctttgaaggacaatgggcagcccacagttaaagataacaaggatagaaatggttaggcgaatattcatggagagacttgagtccgtttggcaaatcgggctgatttccagtgaatacctacagtgggcgtaggacaattaaacatgtcaaaaatgtagtctcccctgtaaacattagattctcctagtaattggccgggcacggtggctcatgcctgtaatcccagcactttgggaggccgaggtgggcggatcatgaggtcaggagatcgagaccatcctggctaacacggtgaaaccccgtctctactaaaaataccaaaaattagccgggcgtggtggcgggcgcctgtagtcccagctactcgggaggctgaggcaggagaatggcgtgaacccgggaggcagagcttgcagtgagccaagatcgtgccactgcactccagcctgggccacagagcgagactccgtctcaaaaaaaaaaaaaagaaattctcctagtaatcattttagactcttctacccactgccccatatctcagttggctcagtggattctgcaccccaaacgtctcatcatccatcccttcctccctggctcgggccctcatcagttctcatctaggctagggttgggtttggttttggcagcagacctaaagcagtcttcctaactctagtcttccatccgttcctttaaacaagcactcaagtactcacagcgtccattattacactgttttaggggttccagcgaaatgcgaggatgacatggtccttagccttaggaagcctaatttgtttctcaggagctaaacatccagtgttattttcacactcacttcatgacaacagtgataggttgttctaagaagtgtaaggaacaatggtagggtattgcagcactggggggcatgtatcagggcgggcttcctaagagaggcatccgtgagagcgtctttctagtctgctcactgcaggcgggtaggtgggagtggggagagccattcgggccagggaagcgtctaagaagccctgggtgggaaagaacctttagagaactgaaagaaggttgcctgtggtgaaagggaaaggagtagcgtggcttgcagtaggactgggagcgtgttttggggacatggtaaggagtttggtcttcttcctaggagcagtgggaatacaggggagaattttgaggcaagggagcgacttgttcacattttttgttttaaaagatcactctgcttccagggggagggcaggtgggaagggcagtccagggtggaggtaggagggtagaggtggggggccatggcagtaacccagggagaggcaatggtgattcaccctgggcggggtgttgggagcaagacgcaggagatacttagtgggtaacatcctgtatttacattaagagtggggagagggcagaatcaaggctgacgcccaggtctctgatgcctgcaactggagatggcaggacaggccagggggcctgtgcagagatggcagtccaggccacgggggaggtggtttgggcttgtggggtaggaggacatatgggatacaagctgaggtgctgagcaggctgtcggtgaaggtctggagcccgggagatggctgggctggacataacatttgcgagccatcagcatccagatagtaatgggatccatgggcaccgatgagctcacccaggggaaattagacatttcgaatgtgcctcctgcaagacagatccaggcaaaatggcctcctgtttaaaagctgacagcagccctccctcccactttagcacccagggccccacttatcttcatccctgagtgcccccaggtgcccttccttcgtcggtggctatgtggtatttagtataaacctctgtcatcatgattatcccagaggcctgtcacggaggtttattttcagtctcccattagatataagctcctctgggcagactttcctgggatcgtctctgtgtcttttgcacctcagcagtgcctggcacgtggtgagtttcctggtgaaaggtggttgaatagattcagggtccatcttatttatcttatagcacctcctcaaacacacgcaccaggcgccaccaggcaccatgccacacatgtgacaggtgcatgccaaataaagcacgcccaccgcttccctgtgtgcttgaaacaacgtgtatcaatgtgtatagtatataccacatgtgcatataactgtatgtatacctgcgtatctacgtgcattatacacacatgcacacatgtgacattgaactctacccttcagcaaagaactggtagacttagacattcagaagagaaggctttccagacgagggaccttattggtagaacccagaaacatatgaatgcaggcccaggagactggcttagtacagagacaaaacttgccaccacagttgctgctgaatgcctctcgctagacaccgcttcactggaatcaataagtagagacgtttgcaaaaagcatttggtggtttcactggcttaaaacaaattattttcagccaaagtaattgacacaatgaagtggtttttggcaactccagcatttttaacagtaaaaaggatttgacttaaatcgccccccaaaaagttatgtaacatgaattttaccattcttagaaaaatatgttccagttgagaaacgattgaatggaattaggactctcttatactgcagcattactgtgcactttagccccagctgtcttcatcacaaacacttgaaaatccttaggaatagaacttagtgatgatgctttatctactattgagtcgcttatgcttaccaatcctgtatgcaaaatgtggcagccgctcccaggggactgtatggagctataataaagataatgatctgttagctcggcttcaccgaattagtcctttagaaagtaattaagcaggattgcccacactccactgctcccaaagactgaaatctggcttggtgtgtcatttctttgccttccttgaaaatggccttttattgagttgatataatttaattatataaaaatacgtgttcagattgcatcttgtacttaattatatcttacgccacggagttatttcccagccagagcttgtgctgttagaaggtggggtccatgtctcattcatgcgtgtatgtgtgtgtttaggtgcaggagaggaggggagagaaatgctggctttaaagagtgctcaccaagcatcaggtgttgggctgagcatttttaatgtattcttttgtttaattctcacaacacccttttgaagtgggtcctattattgtctccattttgaccgacaaggaaacagaggcccaaaactttgagtaacttgttcaagattgcctggccagtgtgtttcagagctggggtttgaagccaagcattctggctccactgtccatggtatactaagtactcagttatgctcgatgagtgaatgatgggaaaaaagatgggacagctatagacctgaaagggacttaggagattgttctggtctgcccttgcctgtaggagaggccacacatggtttacaagtgcagagcaaaggcctttcccttggattattggaggagtctctgaacagatttccttgtcttcacctgtttttcttcaaatcctacttcttcagcacttttaaaaatggaaacctcatttatctctgaattgcccagcatcccccggaagttccccatgactcttggggttcagggccgattctgggaaccacttgccacctgcttccctgaccctttcctcccagggccctggatgcagccaccctggacttctggtagcttctgaaggtgccaggctgttgtgtacaggattccacatgctgagcgcccttgccttccctgcagcgtcccttcctaccccttcttcacggagccgctcccttgtccttcagaaccctgctcccatgccacgggaaacctcagggcaggtagatgtaggcgcagctcactgggtgccccttaggccccaggccacgtgtctcagggcatagccagctccacttaaccgaccagaccaggaggacctgtaggatgtcattctggctcatgtgactcagtgggctctcagtactagtttgttgaacaaaagagttcagagtggaaatattaaatggtactttgagtcgtgcctacttaggacattttaacttttctctgttagcagcccgcaccaactgctgtgacttagtgtttgtgaaactcttccgtctttctgttaacagttgtagttctttcagtgtttcatcagcagccatattctatttacttattctctttcttttcttcttcttcttttttaaatcttttgaggtagggctcagtctgttgcccaggctggagcgcagtgatatgagctgggctcactgcagcctcgacctccccagcccaagcagtcctctagcatcagcctcctaagtagctgggactataggcacatgccaccgtgcccagctaatttttttatttttttgtggaaatggggtctcgatttgttcctcaagctggttttgaactcctgggctgaagtgatcctcctgcctcaacttcccaaagtgttgggattacagccatgagccactacacccagccctagaaccctttttttttcaaaaaaaaatttaatcatggtaaaatacatataaaatttagcatcttacacatttttaagtgtacagttcatggcgctaagtacattcacattgttgtgcagccatcactgccatccatctgcagaacttttcatcttcccaaactgaaatctgtccccattacataattccccactctcccccgccagctcctggtccagcattcgactttcttgtctctgtgcatttgactactttagatatctcatgtaagtggaatcacacaatatttgtctttttaggagtggcttacttcagtttcagaatgtttttttgaaaacaatagtttcatgaagttacagaatcctaaactgaatgtttaactaaaaggttcaaagccctgggcaagaagtgggataattacctgcacatttgaggctgtcagaacgcctgaagatgtgtcaccggatcacacccacgtgcattacaagcagccctgctcagcctcctgtgtaaagttttggtatccgatctccagaatcttttttttttttttttttttttttgagacattcttgttgcccaggctggagtgcagtggcgttaatctcggctcaccgcaacctctgcctcccgggttcaagcgattctcctacttcagcctcccgagtagctgggattacaggcatgctccaccacacccagctaattttgtatttttagtagagatgaggtttctccatgttggtcaggctggtctcgaactcccaacctcaggtgatctgcccaccttggcctcccaaaatgctgggattataggcatgagccactgcgcctggccagtctctggaatctctaatggaaagtgtgctccttcccccaagcaagagccagtacaagaccactctcaagaagggtagtgccaagtatgaggagacagggcatggattcagagctgcccttcacacccaagcacagcaacactggctgctctgacaagccaagaagggtgacaagtgtctaagctcttttaggaatggagagctgggaaaaaatttagagctgtttagaaaaatgatgaggggcatatgtttgctaaagaaatttcatgacatatgccttctgatcgccaataacatgcattctctcccaattagctaagaatctaagaagagaaacagcagatgcaggacccgggatctaggaaggatctggactggagtcttggaatatctctgagtttttgtttttttttaaggattgcttttgtacgtttggcaccgtttgatgccgtgaacgcctgattggagcatctcatttgcaggactgtttaaagagacaagcaggcacaggctgcacacgtgcagacgaataatgaactcttgagaattagcacaaaagattacgtgcattctttcgtgatcctctgtaatctaccaccaaattactttcccagagttggagtgcataggctttggagacagacacatctgggttgcagccttgattctgctgttcaatgaaatgactgtgtgaacttggataattacttattctttcctggcctcagtttcctcagctctaacaaggagagctggctgcaaggcgattctagagagtcctggcaggaagcaatggtgccctcaatggccaatttaaggcgattgtgacaaagtcactgttgtgaaggttggtgcaaggtatagggagaccacaagggctggggtagtggccaggactggtacagcaggcacagtcccaccctaggcctgaaggggcagaggggcagttaccagacctgggttcagagagggctgggtggacagagccgccagacaggagctgtgacagcaaccctaccccaggaagaaaccctgacctcactcccctccctccttcccctccactgctcctacccaaggggaagcctgttgatgcagcccacgcaggggagagagggtggagacggggtctgcagggcaggcttgagagctccagcacagcgttgtctagaatcaagatgctaggacttagtagtaagtgtcaccttagtgttgtcttgatggttacagctgggttgacttatcctcattcctgatgcctagtaggtatctcataaatgttagatttgtggtcttaccacacccctctgcttactgtgtgccaagagtttccaggactctgtggtcatgctttatcagtcacgagcccctcctttttccgtatttaaatactgttcatgccttaagacccggcctacagactatccctggggtgaagtcttccctcatctgtcccggattacttggtctttcctctgcgtttctgaattatgatacatacccctctgatcactgctggtttccctctgccctgcaccgtggtcagctgtgagggcctttgttgccaccatcagctagtgagttccttgagggcaggggcgctgtgttgtctttttctttcgtttgcttctttcccctgctctgcacagtgcctcgcagggagtttgtctccagtacattcttgttgaatgaaaaatcagatgctgaaattatgcaaagagctgtgttatctttaaattattataagagacaaggagagaacttctggatcctgagaagcttttcagtaataccagaaacatttcttcattgtgtacggtaataaaataacacacagtcataggtggcaaagcctcctaattactgtaggttggagtcagagtgtaagaacttccagcattcatggatcacatatattatatacgtatttagtgaaaaacaatatatattatttaattttgtttatttttctatttttgttcaaaatggtctctaaatgcaggccaaccacggtgtgtatttaactccccaaacaggaatctattccagtcttggagggatttgctgagagatgatacagtttacacaaaaccacgtatgctccacactgtggactatctggggaatttttcaagagtaatttcaacacactctattttccatccaattcactgcccttagaacataaccccaatataaaatgatctcctttctaatattttacagtttttaaagcaccttcagatctgtttctcacttaattctcacaaccaaactctaaggtaagtaaaatactactttatcatatttatcttacatgtaatcagggaagctgatgggtgctgagtaacttagccaaggccaaatagttcagtgaggaccacatctcgatcctaggtctcccgaaaaaaaccccaggtttctttgaactataccaagtggctttctatttgttgtcttcatgttagcatccgtgttgacctggtaatctatacctttataaaaagagaaaatacgctatagataattgaatttttgcaaattttgttatttttttccctgcaccttgaaaattgttatgccctgctttaagaaaccccgacattctgtaacattttctgaacattttcaattcccctatctgcttaaatatcatatttatcaaactttgaccttgttcttcaggccacattgtaggtaaagtggcttgttttttattttatttatttatttatttaattcctcttctccctcaaagcacaatctgctgtatgttaaaggggcggggaagctgctgactttgcagtagcgcatacttactcacgcaattttccattctggctgaagtaagggatgagacagcatgcccagaagctgtgtccagcacttggacaggcgccctggtcggcaccctgggaacctcggccgtgcactgccagctttctgggtccatcccagccctgggtgtatggcagatgccttgagatttaacagcccttgagtcaggcctgcaacgtcttatctgcgatttcaacatccagaaagctgtgaaacccagatgttttttggtaacttgtttgctagttggatttggcctgatctgaaatcatttgatgggtggggagaactcctctgaattgaaacatgtggcttttaatcgtttgtgttcatttcttttagtgtgaaagttctgcttttctgtagaggtatttttgaatgtgactatgggtcttgtcctaggcccttctgggatattggctaatgtatggtgtatgccctggacttccgttttaaagtctgaatctgagttcaaaaacatttcaggccccagggatttgaggaagggtttccagaccagtataaccagacagccgagccggccctgtaccgcgtctggttcctgggtggttcctgctgcaatgcggcccagtcagggcactgctgctgacttgtatctgcggacactccccagtgtttgagtgatgtttacgtggaagcctggcgtgtaggaagctggcgcccctgggggaactgcaaggccattttacagcattcacctgtcaccgtgtccttcagaaccagccagatgctacagagccaggctgtaccagagtccaggcccatgaaaacaaagttcagggagactctgttgactttgctaaattcatgggttccttccttccttcatttctttgttcaacaggaatttatgtatctgccataagaagacctgtgcttggcttgtgaaaagtaacagtgacacttcacatgagtgtaacatctgcggtttatggttttgttgcagtgtttcatttcgtcctcgcaaccattcagtggaccagctggtgttggcccttttcatagatgaggaaactgagggctaaatagcttctccacatctgcagattccaatcctcgtggcttttcctgttctgcggctttcataggccctctgcattatttgttaagactcagctattttctaaccccaacccacttgaagcagtggctttttcagatacccgggacaaatcacgtgaccttgtggctcagttttctatgccataaagtgggattccttcctaatccttgcaactcttaagtgaaataatctatgtgactgctttgtgaattgtgaaactcaatctggtgactatagttaataataacatattacatgtttcaaaattgctaaaggagtggatcttaaatgttctcagcacaaaaaaatgatacatatgtgatgtgatgggtatgttaattagcttgatgtaatcatccacatacatatacatgtatcaaagcattgcattgtaccccctaaatatatacaattattgtcagttaaagaaaaaactctgatcacatggtaaagtatttctgattcttcttcctcttttcctacatccagatatgtctgtctgggatcccatatggtggttctccccgtctcttatgatgttcacctcatacacggttgacccttgaacaacgcaggggttagggggtgctgagccctagcacagttaaaaattcatgtataataggggttttttttttgtttttttgggtttttgttttttgaaacagggtctcgctctatcacccaggctagagtgcagtggttgatcacagctcactgcagccttgactcactgggctcaagtgatccacccacgtcggcctcccaaagttctgggattacaggttcgagccactgtgccttgtgttgagtgtaacatttgactcctcaaagtcttaactactaacagcttactattgaccggaaccttaccaataatacaagcagtcgattaacacatattttgtatgttatatgtattgtatactgtattcttacaatacagtgagctagggaaaggaaaatgttactaagaaaatcaagccgagttgggtggctcatgcctgtaatcccaacactttgggtggccaaggcgggaggatcacttgaccctaggagttttagatcagcctgggcaacacgacaaaaccctgtctctaccaaaaaaaaaaaaaaaaaattagccaggctttgtggcacgaacctatagtcccagctacttaagaggctggggtggaggattgcttgaaactggaaggttgaggctgcagtgagccaagatcacatccctgcactccagactaggcaacaggaatgagactatgtctcaaaaagagagagagagagaaaggaaggaaagaaagaaaataaagaaaaatcataaggaagagaaaatacatgtactattcataagtggcagtggatcatcacaaaggtcttcaacctcattgtcttcacattgaataggctgaggaggaggaagggttggtcttgctgtctcagaggtggcacaggtggcagaaaattcctgtgtaagtggatctgcgcagttgaaacccacagtgttcaagagtcacccgtacttatttctctactctcctgtctgacatctcaagagctaagcccccttggtattcattcatctttgagaactctgcattgcctagtttaataggtgaacagtacgtgtgtgttggagtttgtacagtggggagatgtattgctggtaattcagggggttagggttgctgatgcagtcagggaggcctgactgtgcatgcccagccccttcatcaccaggcgccatgtgggtgcccaaccaaagacattcatgaggctgtctctctgtgataacgaaacagctggacatacactgagaaaggaagtcagccaaatgaatattttctaacctaactctaaaaaggtagatgccaggcagcatccaggtgacgatgcttttttgaggctgacatagtggtacacagcattgaggtgctgtcagatctcttccctgccgtccacctcccagtgaccattcctcggctgcacaatgcgcctccccacatgcattgtcccacggccctccctgtacaatcggctcttcactttgcctggctcagaggtgtcttccataccaaagaggctcagagtgtcaggatttaggggaggttggaagcaggtggggtagggaggggagtcagccttcctcctctgcagggttgcagaaagtttcaggggtcaaggaaataataaacacctttgaatagaggctcagaattgtttgtttggagttcccagtgactagtatctcagctgccaacagctttggtgcaatttacttttctttagctgaacattcttacgtggttttaaaagcaagtaaacagataaagtgtttctaagtgtaataattctctttcctgatgcatagctaacaagcagtgagcaggcagaggggccctaaaccaaaggctctctcatttactctgtaaaaaatctgttccacactgcgtaacctccacatccttctcctaaggctgaataaattgggtgccaccctttgaaatgtagtactctgtttggcccaggaaccgtagttagccgtctttcttgaggaaagctgattaatcttgttttgccaagcagaaggattatgggtatgcctgaaccacttttgtacgctttgaaatatcagccctgtcaattttgtgtttctcagtgagggaggaacaggggacggtctcacgcaagagaaatcctggcttttgatttaaggaaaaaacccccagccacttagctttttttctttttaatcattatcttcaagacaaaaattcaaataccctaacatgtacaattatatagtgttttggttgtagaaaatatcatttggtagattatcaagactgacaaaaataactatctttacctattaaaaacgattgagatggccaggtgtggtggctcacgcctgtaatcccagcactgtgggaggccgaggcagaaggattgcctgagcccaggagtttgagaccagcctaggtcgcatagtgagacccggtctctataaaaatttagccagttgtggtggcgtgtgcctgtagtcccagttacttgggaggctgaggtgggaggatcgcttgagcctgggaagatagttgctgcagtgagctacaatcatgccacagctctccagcctgggaggcagagcaagactctgtcttaaaaaaaaaatttttttttaactatagagatggaggaggactggctattttgcagatcattataccaatcctaatcaatagctagttatcaacaatttcatcaactcaattggaattgagacttgagtttagacaagctgaatatttatttttatgctccagaaaacctgacccaagaatcccttttacatctgccaggaggttgctggtgcctgggtcagctgcccggagcacactgtgcctgcgtggagacctttcttagcagacgaaggccagcagcatcagagcagtgcaaattgcaagcccaagatctaaaacagatgatgaagagctatgtatttgtcactgtatccttccacggtgttttatgctattgtaacttcaagagttgacacagttctttccccaacactaaaacatgaaagggtcaggtagagctgttgccattttcatggaaacctagagttgtaaaggacctcggaagattcaggactagatttcatcttaaaagagacattgaaaaccagtaactcaaaaggaaggtcaaaggaacttattttatttttatttaaatttttttagggaccagatctcgctttgtcactcaggctggagtgcagtttcttggcatgatcctggctcactataatctcgaactcctgggctcaagcaatcctcacaagtagctagactacaaatgtgccccaccaagtccagataattttttttctaaattttgtagtgctgggatcttgctgtgttgcccagaccagtctcaaactcctggtctcaagtgctcttcctgccttggcctgccgaagtgctggggttacagacatgagccactgtgcctggctggaaagtattttattgtaaagcattttaaaattaataggtcatgaaactataaaacaaagaatagattgcataatggattgtgtgaaaatacaagttaaagctattttacagagcagttagaggcttgtctcatacctcatctgaggctccagtgaatcccaccccaaatggaccagttagcatgcagccaataagacatcttcctgggccacagacaggtcctcttgtgcaggacagctgtcatgcacatggggctcaatggatgttattcttacagcgacctcgtgccaagcactatgctagcatatatgctcttcatttattgcagtaatccttggagggtaggttggattaccttggatttacagatagaacagctgagctcagagagggaaatggaattactcagggtcacacagctagggaggggcagagccagtattcagcctggtttgtgtgattccagaaccttcctgtggagcccatactcgtggcttgagcattgcctagtcattttgatatctgcgagcttgagtttccccttatgctaaaactgggatctgtgaggcttggcttttttttttttttttttttgagacagagtctcgctctgtcgcccaggctggagtgcagtggcgcgatctcggctcactgcaagctccacctcccgggttcacacttttctcctgcctcagccttccaagtagctgggactacaggcacctgccaccactcccggctaattttttgtatttttaatagagacggggtttcactgtgttagccaggatggtctcgatctcctgaccttgtgatctgctcgcctcggcttcccaaagtgccaagattacaggtgtgagccactgcgccctgctgaggcttggcttctaagaactgcacaccttctaatagtataatgatatgcccccttgttgtgtcatgactaacattgatttattttagagaaaattgtaattgatctatttttcttctgcaaacaatggtttctttttgactttgttaaaatgaagatgaatagctttttattttagagagccaaattgtagcagctctttgtaaatactttctgcattctagaaaaacaactttgattggatggcagaactggagattagtagaattaggaaaatttctgagttactctttgttgggtttttgtgagctaaggggatttttagggtgtttgtgatgtttctttatgacttgaaaggtaaattgcgtcggtgacatcagccttgattctgtcataaagatgcttacaagatgagcatcttgtgtcatgctcagaggtaaagggcggctcctggaagatagaaatctgacaggggtaagaatctgacaggggtaagaatgtggagattcttgtgaagcaagcacttcagttacggcagctgctgttgttcagagcacagatgtttgcacattgttttactttctagtcactggctttcatcaatggaatccttccttttggaggattattattgatgtcaaatgttgtcagatgaaactcaaggcatggcctggggtacctctgtggtcagagagatccgactagacgtactttcactcatatttgactttattattttttttagacggagtctcactctgtcgcccaggctgcagtgcagtgacatgatcttggctcactgcaacctccacctcctgggctcaagcgattctcctggctcagcctcctgagtagctgggactacaaacgcccactaccatgtccgactaattttgtatttttagtagagacggggtttcaccatgttggtaaggctggtcttgatctcctaacctcaggtgattggcctgccttggcctcccaaagttatgggattataggcgtgagccaccacacccagcccatgtttgatttgattcccacaaccacagtctgtctgtaggcagataggcctcgtgctacagataaggacatcaggagcttagaggctggatggatgcttcactcagctcgcctggtgacagtgggattcctggtccataggtcttcttctgacccacattgcttcttagtttggtccaactttgaaagttgcatgtttcatttgaaatgaagaaggcctaagccagaatggtacagctgtcacatccaagtgtaagatccatttctaactgccagaggcatggcagatgcctcagagaagggaggagtccatttggatggagctgtgtgtggctgacatcttcctactccatgtccttcactttggcacgtaggttagcagttctcaagctttttggtctgtcttgcgtttaaatggctgttctcccaggcttgattttgtaacaccgtgctttgattccttgagaacattgattctctgagttatgcagaccttccaaatgtgacatatttcattatacaatatcaaaaaagcacatgggttaatatcaacccccaatgtcatcaaaacagcatgtaggtgttggggagctgtcaggcttacagaggctggtacaagttttccaaagttctttcttttttttctggaaagctcaaatttatccttggcagcaaatgctgttgtttttcctggagtgacgggcttactacattcatttttttgagaaaatgattatagaacactcaggtgtgaagaaccctggtttgtccatcagttgttctttcaagtgaaaatgatgttccctcagaagaagctcacagcttgactgcacagtgctcagtttggctggtgtgcagcaaaagtgcttcataaagagacctgtactcaagggttgagctttaataaaattaatattgtttacagcgtcatcaaaggcctttgtatatgaacttggcatctttcttgtaggtggcagtgaagaagagcacagcgacgtggtgcctgtcccggctggtgctgaggcagcccaggtgccgccaccatggctcccgcagtattagtgcaggtgtcacacaacgacaaaggaaattagagcttggcattgttaaggacgtaattctgacctcagggacttcctgaaggggtctcagggactcaggggtctgtggaccacacttttagaactgctgctgttgagtattggaaagttccccattcggcacattccttgagggccgactctgtgccaggtgttgtgctaggtgctggggatactcagatgaacggcacagtccctgactgcaaggagctcacggtctaatggagaagggggtcaagtaaacagatgcttgcaaaaccttctcgtaagtgccatgatcacagtaagcagaagggatgctctgctagagtgtaggtggagcccccagcccagcttggtattctggtggtggtgataaggggtgtttcctggaggaagtatcactgagctgagtttggaagggtagaagtagaagtaaagccagttaaagaagatgggggaggtgttccatgaagatagagtggctcgggaaaaggcttggaagcaggcgaaagtgtgcagtgttcaagaaaccacaaatagttcagtagggctgcagtacaagagttgggggtgggggctcagggataagagggggccaaagaagtatctggaggccagatcccaaagacaatggagatccactacaggagtttagcagggatgtgaggtgatcaaatctgcactttggaaggatcactcagacataaagaagaggaatgggatgcggagtgatgagagtgatggataaaccagttgaggttgttgccggagtccagaaaacaccacttaggcccaaagcaaggaggtgacaatggaggtgaatgtgtggatatttagaagatatttaatgtcctatatctgcagatattcgaataggcaggatttgatgattgattcaatgtagagggcaaaaaatatggaatcagtcaaagatacaccaagatttgtagattgatggctgcacggtggtgctttcatagaggtgaggggtgtgggaagaggattagaggcaagatgaccatgcgaacttcatgtatcatattcacacacacgtgtgcatcgctctatcttcaggcagaagtgtccagaaggagtcagagctggagcttgagagggttctggccttgaggtgtcagctgaggagtcatcagtgtaggtcgtggttgagggcccccttgttgatgagatcacccagaaggagagtgtggacttgccgactatagtcacagggctcaagtcaggagagaagtcaaagcaagccacgggttttaggaggagggaaacctgaggcctggatcatcctggtccttcacgtctgcagaggagagcagagaagaattttaaattattaactcctcaactaaactacatatcgtcagaacatgcttttcaaattaatttaattgttgattttatttagttttttagagacagggtctcgctctgtcacccacgcttcagtatagtggtgcaatcatagtttactgcagccttgagaaactcctgagctcaagtgatcctcagcctcctgagtggctgggactgtaggcatgcaccaccctgcttggctaagttttttaaaaagttgttttagagacagggtcttgctatgttgcccagattggtctttgaactcttggcctcaagtcatcctttcaccttggcctcccaaggtgtggggactacaggcatgagccactgcgcctggccagaacatgcttttaaatgtaacatactaaacatgatattttatgagaatacagcctatataatatacgattttgttcctgagctcacacagactttaggtctgtaaaggatggtaaaaataccaattacagtttatatttccttttcccaccagaacatttttattttaaaagtagggtggtttttccttcccatctatggtttcatagttctcggaaatgttaacccttctttctctatacgaataaggtgtcctggtaattttgcaagtgatgatttccattatggtgggtggccacgacggaaatgatgttagaagtgccagcgtgcacgtgaagtttagacaagatctgttccttggccctgcggtgacgggaagaggggagatggaggtgttcactctcgtcttagagcttggtgtcaggaagctctgtctggaggtttccctccgtggtgggaggggtgaagcagacatgggagggggaaaaggcgggtctgcaacaggagcccagcctctcgcaccgagcatccctcagtgaagcgcccaggcccacaccacgcagccagcctcactgggctgggggagggctcacgattactttctgtttctctgcgtttgaaaatcttgtgtaatgtgcttctgcacttttaaaatcaagaggaataaaataataaccaaataaaatgactcttagccctgagcttgtgacacacaggcaatttgcttatcacctaggccaccaattaatagtacttccctataactcagggcctggggggttccaatggaagagctgagcatgtctggaggatgttcctgtctgataccagccatcctaacttccagaatataggcaacttggcagcaagagttttaaggttattatcaacctggtatgtggttgtggaagttgatatatctttacatatttttacttaaagctttttagctctacctatacatgggagcaggggctaacacagtattttgttttattgatatatttttcgttttgtggttactgaaagtgaattgtatggcacgttgctctcacttgtaatcagtgacggtgtagcctaagaaacctggtcactcaactgcattgctcagcggagaggaagcttctgtacgtcttggaccttactattggtagcccgtgctcagcagctggcctcttgcaaagggaggactattgaggatgaagagaagaatcttgacatctcaacctcttctcaccctggtttctgcatcatagttttaccatttggttagaacaccagttcaatgcacagtcagatatacagtgcaggcaaaatacgaaaccaaagatacagagtaattacttttccattatcccaatgtactttttctgtgagcaaatgaattcctaaccacagcttgtataccggtgtcttaacgtcaggtaaaggatccaggggcaggttccaaattgaagctatattttgctttagttcacctccattaacacttaggtccaagtgtcgtctctagtcggttgctgtaaactgaactgaagtgcctccactacaaggagatgaggaaaagcatggaaggaggagccatgtggtgggaaggtgcacggaggcccggtggcagatttcagctgagatttttcaaaagcctacacactttctaacagtggaaccacttgccttagaaagtgcccgcccccaattgcatttgaaggttcaagcagaggctggatgatgcctaacatggttattgcagcaggacttcttacatttactttttttttttttttttttggagacagtgtcttgctctgcccaggctagagtgcagtgacacggtcatagctcactgcagactcaagcacctgggctcaagtgatcctactgcctgagccgcccaagtggctaggaccgtaggcatgtgccaccatgcctggctaattttgttgttgttgagacagggtctcacttggttgcccaagctggtcttgaacttagtcctcctgcctcaacatctcaaagtgttgcgattacaggcttgaggcaccacgcccagcctcttactttaacttttaaatttttcctgcttttatatagagctttttaaaatttgagcctctccaagccgggcaaagtggctcatgcctataatcccagctgttgagaggctgagacgggggaatcacttgaggccaaaagttcaagaccagcccgagcaacatagcaagaccgtctctccctcccttttgtctcttaaaacaaaaatgcctcccagtagccttgcaaaacaagaccattatccatatgatacaggtgaggaaattgggtctggctgagtgacttgttcaggataatttgactccacatcttttgacatccagggctctttccatttgtcacacctgctgccttctgctccaggagaagcagattgtgccactgcactccagcctgggcagaaggaaggggacaccggcccttttgactctagagtgtctgtgccatgtgacaacacatgatgaaatggaataggaatggatctaaaaatcattgagattaggatctacagatacatttctacgtgctaatatgtcggttttataatgtacttctgtggctaaccacagaccactggcagggaatgtatctgtggttagatagctagagtgtttgttcactccctatcaggagggcagtaaatcaagaaggcaggttgaagcacagcttcaaatgctgccacgtggctgtggaagactgtggaataagcagcagccagccagcctggtgtgtgagatgagggatccgatcggttgctcgtgttggaacaaaggcattttgcagccctccaggtggttgcagatgattgcaaggggaagctctgatgtcctaccagagggcaggttgcatgtatcttcaatatagttaggagtccttagtatcctaggacatatgtttttttttagttccaccttttgagaccatagctccatcgttaatggtgtttttgaataccaaatgcaggcactatatatgagaatacatgtgcatgtggctgtgtgtgtatgtgtgtgagagagagaggggaaaccctggtaactgatgaataatcatttaacaacactcagctgtttgaataacaatagtaataattctttgtatttgtaagctccattcacagatatgatttgaatggtaatataactagggttaaaaatcattattgttctcaccagtgctctgaggaagttgagcccccagctggaggatgagggcagggaaataaagatcttgtactgcaccttctctgtcttcctttgatttatctttttcatattcatttatattatttctccacaccccctccatctctctcattttctttcttagcccctcttgtaggtgatacctcttggactgggacttgcagagccagtgattgtgccaagaaatgccgtttcttttttctttattatccccatgccccacatgaaaggccattgaacttaaacttgcctgcagggggtggcagtagaggaagcccacttggaggggctttgccagccaaagccacactcctcctttcttcagttgcgtttcttatttccatttctttggttcccgctcaggctgctgaagcgtctctccagtcttttcctattttagcacgccttctttttggcctgctttgccccaccagacatgctgttgtcaccagtccaatccatctgtgttttctggatacacactgggtgtcaatgctttgacaagtgtgggttccagcaagcctaagcgccgggccctacagagccatctcctccgggaagaagacccagccccctgtgcccttctggtttgagatgcgtgatcctgccgtgccctccggttccagggtggggtgggacggccagcttatgatgtgtaactagctgcttgtcgtccagactcagttgcttttaataaaattgccacttaagagaccctgctgctggcagagtagcttcttttcttctgcttgtgctagttcccggctcacagcagcatctgccctgcacgtgggtggtgtcggccttgccctggccgcactgtggctgtgtccccacttagccatcagaaccaggcatttccagtggagtgcagtgttgcaggagggtcaccaggcttagtgtgatgaggcctggattacacttcgggtctggacgtcctctctgagcctgaatttctgtgatctataaaattggataaagtatcaaataataccgatcctaacagtcttgatcattgtagaaacaaatgaaccaatgtctggttagagcctggactgtgaaagtgctagaacgtgttcattcttcctgcgtagattgagtgtctccagggtgccaagcccagttctaggctctgggaaagagcagtgaagacaacaaaccaacaaaacaagtcctcacattctagtgggagagggacagtgggcaagcaagcagataagtgaacaagagagttccctggagggttgagtatggtgaagaactaaaacagtgactgaagggacagagtgtgtagcctggctgtcacttggtatctctctacttaaactggagtcaggcgccatttcctccaggaagctttccctgattcttccaggctaaagtaaccacagctgtggtgcattgtgtagctactaggccccaaggactttcccatgcatcatctctctctcttttttttaagatggagtctcgctctgtcgccaggctggaatggagtgccgtggcgcgatctcggttcactgcaacctctgcctcccggattgaagggattctcctgccttagcctccctagtagctgggattacaggcacccgccaccatgcccagctaattttttgtatttttttagtagagatggggtttcactatgttggtctggctggtctcaaactcctgacctcaggcgatccacccgcctcagcctcccaaagtgctgggattacaggcgtgagccaccacgcccggctccatgcatcacctctaatcctcattctcctctatgtgctaagcgttattctcaccatgtttcctctgtgtcttatttatttattttttagatgcatcacgtttttattagggaaatgtaaatcaaaatcacaataatacagcatggatccctgcatacacatactatgtacacacatatgtatgtcagtaattggcctcggaaatgcaaatcaaaatcacaataatacagcatggatccctgcatacacatactgtgtacacacatatatatgtcagtaattggcctcaacacagtaagtagcttttcaggtcttatcagtgaaaatttcttttttttttcttcttgtaaaaatcgctttaggggtacagtgcaggtaggtttgttacatggacatattgcataatggtgaggtttgggcttctggtgaacctatcgctggaatggtgaacactgtaccctgaacagtggaccccatagtgagcacaataggcgattttcaatcctcccccctcctaccctccacccttttggagcctccagtgtctattattccactgtgtgtccatgtgaaccactgtttagctcccacttatgagtaaggacgtgcagtatagaattttctgtttctgagttactgcacttagaatagtggattccagttccatccatgttgctaaagaagacatgatttcattcttttttatggctgtgtaatattccagggtcatttttatttttttgagacaggatcttgttctgtctcccaggctggagtgcagtggcacagtctcagctcactgcaacctctgcctccagggttcaagtgatactcccacctcagcctgacaagtaactgggactacaggtgtgtgccactatgctcggctagtttttgtattgttttgtagagatgggggtcttgctatgttgcccaggccagtcttgaactcctgggctcaaatgatcctcccaccttggcctcccaaagtgctgggattacaagtatgagccctgtgcctggccaccacattttgtttatccagtccttcattgatggacacttagattgattccatgactttgctgttgtgaatagtgctgtgatgaacatgtgggtgctgatgtctgtttgatacaatgatttcacttcctttggatagatacccggtagtgggattgtgggtggaacgtacctcagagagatcaagctactgcccgagatcacatactatcaaggggcagaactgagtgtcctaactcgagactcagccctttctaccacatctccttgtcttctctgtcccaggccttatgttcacctctcttcaacctcaccacagtctggaaatttatgtttctgtgtttttcctgtcagcctctgaactcctgaagggctaggaactgttattgtcagcacctggagccacactaagcgcttactaggagtttattgcaagtttactgagttcataactagccccagccccttgccatgtatttccacttagatgccacagatttctccttcagagtgcttgtagactgcaaagggagcagtcgaggtgaatatgcttggagaggacataagggaaggttttttcatgtaaacgaactcattttagatgtaaggcatcacttttcagtgaagcagggactttttacaaagtcttgcctctgaactttacagtaagcaagccgagatccatgcttaccactgcaagaaaactttggtgggccgttgtacaacagtaggcaattgtgttggcttaatgtgagttcttgtgaggttgacctttgtatgttttgaaagtctttagcatttaaagtctgcttctgtgcattgatttttttttttttttttttttttttgagatggagtcttgctccgtcacccaggctggagtgcagtggcgtgatctcggctcactgcaacctcctcctcccaggttcaagcaattctcctgcctcagcctctcgagtaactgggattacaggcatgtgccaccacgccctgctaatttttgtatttttagtagacacagggttttgccatgttggccaggctggtttcgaacacctgacctcatgtgatccgcctccctcagcctcccacagtgctgggattacaggcgtgagccactgtgcccagccctatgcattgattttgagcaagaaagggataggactaaattatgtggatgcactgtacaattcccaagaagggttagaattctagtcttgccaactcactcctccaagggcccaagtttgatcaccggaggattattccttaagcagcacgccacagccttctgcagttccccatgggcctggtgagaatgagcccctgccccattgtgaatggacacttctttgttcattgactaacgccactgctgtgtaacaccgtggtagggtccaattttagtatcatcttgcttcttgggaaaaaaaaacaaaaaaaaacaaaaaaacaccttaggtcagaaaaagacgagactattgaagaattccatgcatgttataaatgtgattaagtccacactgctgccaaggagtggaaacaaatcaggcacagaactcatggtaggacttcatcaggactggaatattctacacaacaaaggacttcatcttgactagggacagagcaggatggagctcagcacatggagaagactatttgaggcagagagtgtcagtaaactcatccattaatttttttcattcattcagcgccagattttgtacacgtactaagtgctgaataaatacagcagtgctgcaggcagtcccagggagccagtcactgactgtaaatacgctggggggtatttacatgtagagggggatgaccacctgaagacatggggagaagacagccagtgagagaggcctcagaagaaactaaccctgggccctaatccagtctggctagtgtccttataagaagaggagattagtcacagacacgtagaggaggatgaccacctgaagacacagggagaagatggccagcgagagaggcctcagaagaaactagcgtaactggaccttgccggttttgagtatcgtgagtaccctggcagcatagctggtatgagtactcgaagtaccccggcagagtagcggcacctagtagccacaagtaaggtgcaaatacccttgcagcgtatccaggcccagtaggcacgagtactataaataccctctgttatgggcttacttgtgttaccccaaattcatgtgttgaatctctaaccctagtgcctcagagcatgactatacttggaaatagagtctttaaagaggtgattaagttaaacgtggccgttagagtgggccctactccagtctgactggtgtccttataagaagaggagataagacttagacacatagagggggcaaccacctgaaagggagaagacggccagcgagagaggcctcagaagaaacgaaccctgctgaccttgatctcaggaagctaaacttgatctcagatgtccagcctccaggattgtttaagccccccagtctgtagtactttgttatggcagccctagcaagctaacatgccgctgtagagtgtgcagacccgcaggcatgggtcccgtgagcacccagcagggtgtctgggtgcagtagatgcgatggttggtgtataatatgaacactgtctctgcaggattcttgcctgtgaatgaaatggagggaattgaagatttcggtgtgcttgcagtctaggtcttgatctcaggtcatttcatagatgtttgagagttagagttctttcttgttatgattctagtcatgtatgtgttacccaacaatatttcattttatattaaaattacagatgcttgttagctcttttgttttgaatatttctgttcgctattcttatacagcagtcttccgttattcagttttgctttctgcagtttcagttacccacagtcagctgcagtctgaggatattaaatggaaaatttcagaaataagcaatttctaagttttaaattgtatgccattctgagtggcagaatgaaaccttgtgccgtctgctttcatccctttgtcccatgcacccacactgtagacgcccctacccatgagtcacttaataggagtctccgttatcaaatgactatcatggtatcacagttcttgtattcaaggaacccttattttaccagtagtggcctcaaagctcaagagtagtgatgctggcatattgttataattgttctattttattattagttatttattattacttaatctcttacagtgtctaatttatgaattaaacatcatcataggtcaccataggtatatatatacacttgacccttgaacaatataggggttacgggtgctaatccccacacagttgaaaatctacttttgattccccagaagttaactacaaatagcctgctgttgaccagaagccttaccagtaacataaacagttgataaacacatattttgtatgttatatgtattatatgctgtattcttcaaataagctggagaaaagaaaatgttattaaggaaatcataaggaagagaaaatgtatttactattctgttagtggaagcgggtcatcataacggtcttcatcctcgtcgtcttcacgttgagtaggctgaggaggaggaggaagaggaaagcattggtcttgctgtctcaggagtgacaagcagaaaaaaatccacatagaagtggatccacgcaattcaaaccagtgttgttcaactgtctaggaaaaaacacagtgtatatagggttcagtgctgtccacagttccagtaatcccctgcgggtcttggaatgtatctcctgtggttaatgggggggccactgtacagactgggcccttctttgggcgcccctttttctctgtttgaccaactcctttttattctttaaaacccagccaccagtgtcacctggaccaagaatcctttcctgtgtcatccagggcccctctcagtgcctctggaggaggctctgcctttttctttgctgttgcactctcatgagtgacagcatctgtccctcaccccacaaagtctctggcccagaaggttctcttcattattgctttttgagtgaacacttgaatgaatatatcactttcttgaaagccagtctttcaaaatggttgaattattttgttatttttaaattgtggtaaaatatatgtaacaaaatttgtgattttaaccattttaaatgtataaattcagtgacattaattacattcacaatattgtgcaaccatcaccactctctacttcaaaaattttcatgaccccaaactgaaactcagtactcaatgaagcagcacctccccatccctcccgcctcccagcccctggtaacccacagtctgctttctgtctctgaatttgcctactctgtgtatctcaccttactctgtagtagtgacttagatgaaatataatatttgtctcatacaatactagtctttttgtgactggtttatttcacttagcataatgttttcaagttccatctgcttaccagaactatattcctttatggccaaataatattcgattatatggataggtcccattttgcttatccgttcatccatccatggacatttgggttgtttctaccttctggctattgtgaataatgctgttttgaacatagctttgaaatacctgttcaagcctctgttttcagttctattgcgtgtctacctaggagtagaattgccggatcatatggtgatcctacgtttaactttttgaggatctgccaaaactgttttccacaatggctgtaccattttacattcctaccagcagtgcaagagggttctaatttcttcgcattcttgccaatgcttgttattttcattttttttatgatagccattctagtatgtgtgaaggagtagctcattatggctttaatttgcgtttctgtaatgactagtgatgttgagtgtcttttcatgtgcttattggccatttgtatatcttcttagagaaacatctatttaaggtctttgcccattttgaaattgggttgtttatctttttgttattgaacaaaatggttgaaatttaaaagaaaaaagggtgctacttgaaaggtggacccttcctaatacctggctttccaggaagcttattctctgatggtgctagattgacaatgttattttaatcatcgtttcctcttccctcctgctttcttggctttttttgcactttttggagcattcatgttttgcctttttgttttttttgttttttgagacagagtctagctcttgtcacccaggctggagtgcagtggtgcaatctcggctcactgcaacctccacctcccgggttcaagcaattctcctgcctcagcctcccaagtagctgggattacaggcacccaccaccgcccccagctaagttttgtatttttagtagagacggggtttcaccacgttggccaggctggtctcgaactcctgacctcaggtgatccgcccgcctcagcctcctaaagtgctgggattacaggtatgagccactgcgcccattttggattaaacttcaaatagtactcaaagaatcagactgccgataatgtaggacaactgtccagaccgggccctttgtcagatgtcccttttctctctttgaccaactccttttgattctttaaaactcagccaccagtgtcacctggatcaagaatactgtcctgtgtcatctaagggccctctcagtgcctctctaaattccaaattttcactctggaaaattcaacaactcaaatgtattttcaagtgtattttaaaaattagagaactagattgtcaattcacgttatgtgaatgctctttaaaaagtggtaatgttttataaacgtactctgagcagtgttttccagtatattttggtgtgggatttggagcagggctttgaagtggaaaggcaaatgttttcttgggtagatctgaatattccgcaaaatgattccattgatcatccggtcgtagtctcactctctgaactataatgaaaagagagccaggggagagtgcagctgctccagggacccgggacaggtaccctggaaaggcatgggtagaggttccccccatcgttgggcccactggcatcactcctgttgctcccatcggcagctgtgggccagggcctctcatcctgtgtggaatctggcatcaggaattttcagtgggattttgaaagctattctaagagagtaaaatggtgggaggcatacacttctgtgctggctgctgaaatatgtggtatactggcctggaatacaactattttctctttttttaaatgaacgagttcattaagaaaaaaaatctgctgcaacctatagatccaaacacagttcaatacatcttttttttctttgtccaaactgaatattttcttatttttaatatcctgcctcattccatgaaggatttatgatatcttccagcagttgagtaggtttgctgaaatcattaacaaatatacaatttttttcttttcattttttactgaatgatgggattttttttttttttgctgcttcctccccttaacaaaaaagctttcttgaggtatcaacctataataatctgagcatatttaaatgaacaatttgataagttttgacatctgtatatgttcatgagaccataaccacaatcaagataatgaagatgttcattgcccctaaagtttcttttgtgcccctttgtcagccctccctgcccccctccactccaactactgacctgtcactattgattagtttgcattttgtgtaatcttatgtaactggaaccatgcagaatgtactctattttctggctgctttcacccagcacaattttgatattcatccgtgctgttgcttgtatcaatgttaatatgtttttatcgctgggcgccattgtatggacctaccacagtttatttatccatttacttgttgatggacatttgggctgtttcccaaatgtcccagtagtttttggctattacaaataaagctgcttttaacatttgtgtccatgtctttgtatggatggaggctttcatttctcttggggaaatacttgggcatggaatggccggactcaatagtgggtgtgtgtttagctgtctgccaaagtggttgtaccacctgacatccccacagccatgtcagagatgcaattgctgattcacatgctcaccaaaacttggtgtggtcggtctttttattttcagaccttctaacgggcgtgaggtgataactcatttcggttttaatttgcatttccctaatgactaatgatgttgagcaccttttgatatgcttatttgccatctgtatatcttccttggccaagtctctgttagatcttttgcttcgttttaaaattgggttattcactttcttgttgagctttgagaatgcttcatatattctggatacaagttctttatcagatatgtgatttgtaaatattttctcttgttctgtggcttatcttttcactctcctaacagtgtcttttgaaaagcagaagttcttaaatctaatttaccatttttttcttttttaaaaaataatttcaacttttattttagattcaaggggtacatgtgtcggttcttacatgggtgtatttcatgatgctgaggtttggggtatgattgattctgacacccaggtagtgagcatagtactcaataagttttgttttgtttttatggattggggttttgctgtcatatctacaagatctttgcctaaccaaggttataaagatttcctcctcagttttcttctacaagttttatagttttgtttcttacttttaggtttatgatccattttgaattaatttttgcatatggtgcaatgtatggattgaggttcttttgtgtgtgtgggtatggatatgcaattgttccagcctaatttgttgaaaagactgtcttttctctactgaattgcctttgtacttttgttaaaaatcagttgcccataaaggtatcggtctgtttcttaactctctattctattctgttgatctgtttacaccattaccatgttgtcttgatgactgtcacttaagttgggcagtgtaagtctttcagctttgctctttttcaaagttgtggctagtctaggttcttcacatttccatgtgcattttgggatctgctattgagtttctacaaaaatcctgctgggatttttattgattgcattgaatctatacattaaatttttctgtagggaaaattgttagcttaacagtaatgaacagcaatgagtcttccaacccacagacacggtatatctctctgtttatttaggtcttctttgctttctctcagcagtgttttctgagagtaaaagcagtgttactttttggtgtgcagatgttgaacatcttttgccatatttatccctaagcatttcatatttttgataatgtaaatagtcccaattgtttggtgcaagtatatagaaatacaattgatttttatgtcttgatcttctatcctgaaaccttgataaacttacttattagttccagtaacttctttgtgtattccttcgattttctggttggacagccatgtcatttgtgaacaaaggcagttttacttattcctttctaatctagagagcttatatttctttttatttttcactgactaaaacctccaagataatattgaaatgtgtgatatttgttgtaggtgttctatagacacccttcatcagattgaggaagtccttttctcttcctagttcactgagtgtttatcagaaatggatgttggattttgtcaaatgctttttctgcatttattgacctgattacctcatttttcttttttagtctgtaaatacggattacattgatatttgaatgttaaaccattcctagaataaacctattaataggtcatgatgtattcttttttatataagactttcatttcctaaaattttaagaatgtttccttttttttttttgagacaaagtcttgctctatcacccaggctggagtgcagtggtgcagtctcggctcactgcaagctccgcctcccagttcaagcaattcttctgtctcagcctcctgagtagctgggactacaggtgcatgccaccatgcccaggtgatttctgtattttaagtagagatgggatttcaccatattggttaggctggtctcaaacacctgacctcaggttatgcacccgtggcctcccaaagtgctgggattacaagtgtgaggtactgtgcccggcctgcatttattttcatgagggatattggtctgtagttttcttttgtaatgtgtttgtctgattttgatattagagtaatgctggcctaatagatgagttgagaaatatttcttccttatcagttatctgaaatagtttgtgtgaattaacattattttttcctgaaatatttggtagaattcaccagtgaggttatcagtgatttgtggaaagattttgtttttgtttttgttttgttttgagaaagggtgtgactctgtcgcctaggctggagtgcagtggagtgatcttggctcactgcaacctctatctcccggcttcaagcaatcctcccacctcagcctccctagtagctgggactagaggtgtgcaccaccatacccagctaatttttgtatttttttttgtagagatggggttttcatttgttacccaggcaagtctcaaactcctgagctcaagcaatccacctgcctcagcctcccaaagtgctgggattacaggcgtgagccaccgtgcccagactgtggaaaggtttttaactacaaattctattctttaataggactctttagatctatttcttcttgcatgagctttggtacttttttttctttcaagaatgtgtatattttatctaagttactgaatttattggcataaagtttttaaaaatatttctttatccttttgatatctatcgatctgtagtaatgtcagttctcttatttctgatattgatattttatgtcctttctctttttttccttgatcaatttggctataggtttgcaaattttattttctcagtgaactagcttttcattccattgattttctccagtgtttttcctgtttcattgatttttgctctaatgtatattgcttcctttttttctgcatactttgggttcctgaaggtttggttttcttaagtggatgctgagatcattccttccccatcccctacttccttctcctttcttcgtttctaatgtcgatgttgggtgacataaatttctttctaagcgacagctcacaaattttgatatgctgtgtttttatgtgcattcagttagaaatactttctaattttcctttctgtctaatttgagttagtatttgtgaaagttttgtgtctagatgcattattttgcatgtggacattcaatatttccaacaccatttgctgaaaatactcttctttctctgtttaattgcctttgctcctttgtcaaagactagttgactgtatttgtgtgggtctatttctggactctctgttccattgatctatgtgtctgttctttcaccaattacatgacgtcttaattactatagctttataagtcttaaagtcaggtagtgtcagttctccagctttttactcttcttcagttttgtgttggctattctgggtcttttgcctttgcatataaactttaaattcactttgttgatatttacaacaaatagcttgctggaattatgattgggaatgcattgaatctgtagatcaaattgagaagaattggcatcataacagtaatgagttttctaatccgtgaacatgggatatatctccgtttctttagaacttctttaatttcttttattattattatgttttagttttctgcatttaaatcctgtaaatattttggtagatgtatatgcacctatttcatttctggtactattataaatgccattgtgttttaaatttcaaattccaattgttcattgctggttcgtaggaaagtagttgacttttttgtgttaaccttgtatcatgtaacagtgttacgagagggtttttttggtcaattctttgggattttctacatagacatttatatcatctgcaaatagacagttttgtttcttccttcccagtctgtataccttttacttccttttcttgactttttgcactagctaggacttgcagtatgatgttgaatgtatatagtatagtcataataactatttaattgttcttgtctactaatcctattgtctgtgttatttctgggttagttttgcttggttgattcttttatttattttgggtcatatttttgtgcatctttgaatgtccagttgttttttcgtggaggtcagacattgtgaattttgcctcgttgggtgctggatatttttgaattcctataaatatttcgagctttgtactgggtgtagttacttggagacattttgatccttttgggtcttgctcttaagtttgttagggggaccagagtaggatttagtcttgggcaacatcctctgagtcctctccttccatgaggctgtggattatgaggttttccactctgcctgatggtgtcagggtatcaagaactattcccagctctaggtgagctctggtaattgttctaatttttttttttttttggatgatttttttttcagtcttgggtaatttcctcacatgtaaatgctgataagtactcaccagaagacttgagggcagggtgtgggagggtaatctttccagatctctgaagttttttctcttggcaatgctctcttccccattaccctctctgcgaaccccaatcgtcttggctgccctggacttacagccgtgtgtctcagcaacttagggagactcaggctttacctgggttccctccctgtctcacatcctggaaactctccagactatctgctgggctagtcctagggttcacctcttttgtttaccatctttcattgatcactcttcctcattgtctggtgtccaggtgtttgaaagctgatgtttaatatattttgtctgttcttttagctgtttaaggtaggaaggtaatctaatcactgttactccatcttggctggaagcagaagttgatggcactttttaaaaagtagctacagaatgtcaaaaaggattaaaaatttttttacagtaacaacgaatgtggatgggaggttagaactcaaactttcctttagattctaaccttaaaccgttgtagctccaccttttgataggaacctaaaagacaagttctaccataaaaacctaggtattttagtatcttccatagccgaacatatctattgttttgtcctgaaacagtaccaccagcctgttttagaaagttttttcttggaaaactaggtttctggctttggccccattggtgattttaaaccatttgaactgtgcttttctttttgttttgttgttttattgtttttgagagaggcttactctgtcccccaggctggagagcagtggtgcaatcacagctcactgcagcctcaaccttcccagctcaagcaatcctcctgcctcagcctaccaagtagctgggactacaggcatgaaccatcatgcctggctaattttttaaatcttttgtagagacggggtctcactatgttgccctggctggtcttgaactcctgggctcaaccactccccccacctcaaccttccaaagtgctgggattacaggcataagccaccatgcccggctacactgtgcttttctaaatttttatctcaattattaaaggacaggctcttatgcaggggaatattgtctgaaactaatcaaattattaagtcaggaagacaactaaatttttggatgatgtaaccatatagtactttaaatagaaaaaaattgtactaatagaagttagtagaaaaaatttagataataatagcttttattttattctttttgctgaaagactttgaaaccatggtgtaaaataaaaaatcattaaagctacctttttagatactttttgttaagtcagtttataaagtgaggatgtctatctggaatgtgtgacagatgtaacaagtgaaagttgcaatagtctccatgtaaaataaaatttggactgacagttttagatctttttcaagttttactctaatgctcattattttgtcttctcttcccttctccatctgcataattttaatctttcctttcatggttaagatttggcaacctcgtgtgccttgccaggatcattgttaaaaagctgtagtttttttttttctttctcccgtccaagctgtcccagagcctggtgagccacccttgcccttggtgtggtgtagctactgcgcctcatagcaaaaggccaggttttaaagcatagtgcttcacacgttatcaggaatttattttctgctcagctgcaggatctcttgtttgctttaaaactgtaaagtggagtgggggaaagctatcaacaatcttcaagtgcccaggtcttttagtttctgacagaaacaagagcatttctgcaaaggttggggagtgcgcgcgcgcgcgcgcgcgtgtgtgtgtgtgtgtgtgtgtgtgtgtgcgcgcgcgcgcgtgcatgtttgtagtatttagtaaacattccaaagatttcaaagtctccagggctccacaggatgtctttgttgacttcataactgtggttaggcaaaatgaaatgagagtccaggataggtcaagataaggtaattagcaaattccctaaatactcaactagagaatttcaatggccagtctttttacagatgattgttcttatttttcctcttttgttttcaattacaattcattaattgaaacgtagtaacgggcctgaagttgtgttctgtactcacctgtgttttgatctttatctgtctagtcctcatattactttctggcaagcttgtgattctggcatataacagttggggcagggtgggggctattgatttgatccctcatctgtgttcctacatttctgttatggttatttgttggccagtctcttcttgctagactgagtgcccttggattgggaagatcgcattgcccggcactaggtctgccccagaaggatgctcaatatcattgtacagaattaaactgaaagtttgtttcctttaaactccatgtcatccaaggtaaacacagtcacatgttgcctcttagggtgatcttgagtattttttctcatctccatcaccaccattatccaacctaaggcttgtaaaagatctttataccatttctttccagattcaagaggctctgctgaagttcttttaatcaatattcgatgacaaatttttatatcaggcaaaggttgttgtagagctctttaagattcaattatgtgaacattagttcttgagcttcatttgaaacaggtttattttgaggtgggatcgattcttgtcattttctatgaagtgatgaacgtcagagctggagctcttgtggcaggtccagcttggaggtgagcaggacacagggttcctaactgacccagatgatccaaggagaactgggagtctgagaacagaaataaagctggagcccagccaggagtggtacgcagggctgcgaatctgacagcaaggccgaaatccaggcccgcaagtggcagagcaatgacagttaattgcttctctgtactgattgcttgtttcttttgctattggatactaataggatgactccgaatatgacaatagagtataactattccgtgaacaacgtataatatggaaagtctgctttatgtgaaatgtttatctgcaaattattgagcaaagggttattatttgttactgcttaaatgattggttttaaactactaaatctggtaagttttttttctaaatagcatttgtgtaatattttggaaaaggcaaaatgatgtaaaaattctatgtgtattttacttagtaccacagaaatctcactggaattaatacctgtcatttggatggagaactcatatggtgaaaagagcctaggctcacagctcaccctcggctggccacattctagccgtgcaaccttaggcaaggtggaccagaaactcaggttctcctacttcatctgtggcatgagggtggcacctctgtgggagggcgctgtgtggcgtggggacactgggcatggggacactgcaccacaaagcttaggccctgacatacagcggctggtgaatcaagggtggctattattgttttggtgctatcattatcttaaataattaaagaaaataagaacatctcacgataaagggaacagattctaagttaaccttttaaaattactaggccactttaacctccgggaatagcactcagataacaatgtcttagtattactggaagatttacagagtcaagagcctgctcttatccctggatagtgagataatcacatgaatggagaaaaaagcatgcttctctcaccttttaatagagtgaaacacatcatgttaccggaaacccttttgttctgttttttacagtaagagaaaaagtaattaaacttcaaagtcagatctgtaaatagctacatgaggacctatggtaaaagcagagctacaaggtcttctttttgcttctgaaactgggggtgatgtaggggctgcccagacccatggcatcccttgaaactcagaaagaagccagtgcttggctgggttctcatgagagtcaagttggagctggaggctatgagaggtaacacttggcctgtccttttgccactggtcgtgtgctgccaagtgagagggctcgtgtggcatcaaaccatgccttatcttaaggctaacatcacatttcctcaacttggccagaggtgctgcagagagagacctgcacagtatttgcagaatttgttcaataattattgttaatcgttgatttcactgaagatcaatgtttgctttttgctcttataaacaaaacaggaatattcataacaatggattctagtaaggctcaagtaccatttgtgttgagtgtctgtatgccgtcatagtattagaagtttcatacacgctaacattcatcttcacaggaacgtcagaaggcaggtggtattaggtcacatagctaataggggacagattaggaattggctactgctcaatttgaatcccaaatcagtgctctctctcttgtgcctctaaagccccaggacccagacagggcagtataggtaacccttagcagactactctcaacagtgtttggcccttgacaaaatgccacaaagttggaacgtgtagccctgagaagggttgttggcagaggctgcagagtggctttcagagtggttggccagctaagacatctgcatcaatgcctcgcaccactgggtgttcagttttccctctgattaaatcttgtctaccctgtgcccatagagtcagcatgtgctgcgagatcacaacgtgggagatcgttccccaatactgagatagagacaccgccccatagacgcagttacacactgccatgtgtaaacagatcaggaaaggagcaggtgcccagcccaaccagagctccagttcacacaaaagttttagaaaacccaagaggtaaaagtttagagaatattgtcttcttcaaacctccctctaacactgtaaagtgataatagacaagaatgtaaaaaaacttgggggaaaaaaagctaaagctcaattattgacactgttttaatgacctccacagatagatttgagaggtataggagcaaaaatgactttaaaataaataagttgttaaagttttattggtgctgcattcccaacctgaggttttctttgatgaaattcagatgaagtttcacatcttgtgctgtggaatcctatgaaatgcttagagattcaaatggtttgtgttggttaaagcaagctttaggctttgttcttcattatgctaatcagtttttcccccagcttaattgaagtgtaaagtcatttgaacaacactggtcttttctgtacacaagaaggttaagaacctcagacagctcatgctgctgccaagaagtctcccagtcgtattcttcagattaattacctgcagaaacagaagtaagaaaatccacaggttaaagcaatgattttggcaggatctgaaaagcactaggattatgtcatggggaaaacttcagcaaatctcacaaatgggggctctcctaagcagatctgacatttcggtttttaaccatttgtatttgaaggcaaatattgaggtggtgggggtttttattaaaatattaaaatcaaactttttcctatataaattcagcaatataatttaaatattctgatttgtgcagttttattaaagccactgagaccacagtgatgctaaagtttttgaatgcagggagcaggccagtcttgccttactctgtatgttgttttataatattgatttgaaaatgcaaggttatactacagagaccaactttttcctcctcaatcctgtgctggcagccacaataaatgtgcttgagtcccagcagtgagcgtgtgtgccttctctagaagctgctgtctgcacgaacaacccaaaaatgtcatagaaatgcacagttctaggctgggtgtggtggctcatgcctgtgtaatcccagcactttgagacgctgaggcaggataatcgcttgaggctaggagttcaagaccagcctgtgcaacataatgagaccccatctctataaaaagtttaaaaattacctagatgtggtggtgtgcatctgtacttccaactactcgggaggctgagataggaggattgtttgagcccaggtcaaggctccagtgagctgtaatcgcaccactgcactccagcctgggcaacagagtgagacactattgctaaagaaaaaaaataaatgcatgagtctatgctacagattctttcatgatttaaaaagcaaatattattaattatgcactaatttctaattattcagtgctaatttgcataaccgttgagacagcacataggaattttgttaaacttggatttgttttggtaatttttattggaaacaacaatagtaacaataacttaattacagcttatatttatttatacatgcactatatgcaaaaagtattctaagtactctaaatgtgtcaactcatttaatattataacaaccctatgaaatactcttgttgcacctgttttatacatagaggcagatagagattaagtagtttgtcctaggtcatgtagctagtaagtggcagagctgggatttgaacccaggtagcttgactccatagtccgtgctcttaaagactgaagtctatgcctcttctgccagtgctgtcaacactgacttagctctagaatgtcttctcctaccttagtagaactctccctgccttccgcctgaggccagagaccttcccaggtaggtgtgtgttgacccagcgtcctacacaatggttgttacaccaacctgactctgccttcttttattcacacattagaagatttcactgaactgtttaattactcctcagagggaagacagatataaaataccttcttatcttccccacttctctctcccagtggcatgacattttgaagtgagattttctttccctcctatccaaagtcaaaggagaaatggagaaattccccagaactactgtccattcacaagaagttacatagcacttaaggacagtctctttcccttgagcaataagtacttagttttcattgaaatatttctctgctgagctctcatagtataatagcaaccaatcccaacaagcaaaaataacttgtaaatttgcaaaaccaggccaggcgcagtggctcacacctgtaatcccagcactttgggaggccgaggcgggcggatcacaaggtcaggggttcaagaccaacctggcccacatagcgaaaccccgtctctactgaaaatacaaaaattagccgagcatggtggtgtgtgcctgtagtcccagctactggggaggctgaggcaagagaatcacctgaatctgggaggtggaggttgcagtgagctgagatcataccaccgcactccagcttgggcaacagagtgagactttgtcaaaaaaaaaaaaaattggcaaaaccaatgagtggaccttatcttacttaaacgctcataaaattactttattttatatgttaacattcaataaaaactgtcatttttgagataattctatgtgttttaacaaagtatggtttaatgtaacaaccaccactaaggatatagaacattccaattaccttcaaaattcccttgtgcagtgtccccaacccagcatttggcaaccactgatccattctccttcattacagttttgtctttggagaatgtcatataaatggaatagtacaggatgtaaccttttgagatgggctttcttcattcagtataatgcctttgagacccatgcaagttgttttgtgtatcagtcattcatcccattttattactgagtatattccattgtatgagtgcaccacagtttatccattcaccagttgaagggcctttgagttgtttccagtttctatcaagtctgaacagagccaccagaaacattggcgtatcggtttttgtatgaatattgttcatttttctagagcaaatacttaagaattgctaggtcatattggaaatatgtgtttataagaaaatggtaaactgttttccagggtggtcgtgtcattttgtgtgcccaccagcagtgggggagagtgtgtttcatttgctccatattctcactgcacttgcttttgtcagcatttttacttttaaccatcctaatagatgtgtaataatatctcattgtagttttaatttgcatttccataatgactaatgatgttgaacatcttttcctgtgcctgcttgttacctgaataacctctttggtggtctatttaagtcttttgcccatttttccccttgcctatttttaaaattggattgttttctcactgttgagtttgtaaagttctttatatttctcattcaatagagagaaacagaaaaaagaggacgtgcacacatccccatcagtactcctaataaacagtatggattctacattgggagcataaagaatggtatatttagttctaggagaggaggagcatgagaaaaggatatttgcaagttgttcttgctttatagttttacttctttaaagagatatgcttaagacatagttttaaaaagacttacacaatattttttttgtaagagcttagcggctctcttggttaatagatatgttattctctctcagaagtgccatagacacacttgaaaattatttctatgtgtgaaacaattatctgttacttagaaaattgacagagcctggctgggcgctgaggctcacgcctgtaatcccagcactttgggaagccgaggtggttggatcacctgaggtcaggagttcaagaccagcctggccaatgtggtgaaaccccatcctactaaaaatacaaaaattagccggcgttggtggcgggtgcctgtaatcccagctactcaggaggctgaggcaggagaattgcttgaacccaggaggcggcggttgcagtgagctgagatcacgccactgcactccagcctgggcaatagagcaagactctgtctcaaaaaaaaaaaaaaaagaaaagaaaaagaaaaaagaaaattgacagagcctgaatttaagggcaagacagaattatttatccaggaagcagaagttacaaggtggcagatttcaatgtcagaggccacttattattatctaaatattccatatgttttcatgtttctgcgtttttgtttaaattgcttgtttcctttgcttggaatgccattcttatttttccagctggtgatttttttttttttttttttgagacagagtcttgctctgtcacccaggctggagtgcagtggcgcaatctcggcttactgcaaccttcacctcccaggttcaagcgattctcctgcctcagcctcccgagtagctgggactacaggtgtgtaccaccatgcccagctaatttttgtatttttagtagagatggggttttgccatgttggccagactggtctcaaactcctgacctcaggtgatccacccaccttggcatcccaaagtgctgagattacaggcatgagccaccacccccagccctggtgaatatttttattcttcaaggccaacccctgcttgatcccatttttccaaatacagctaatattttctttgttcacttatcactttatatgtttatataacttatcaaattattttagaaatttgtaggcaggtgtcttctccactaggcagagagcttcttaaggatagctgtgtgagtgaatcatcttttatccctaacaactaatttaatgcatgcttcaaaagagatactcatttacccatttattcattaatttaccaaatatttattgagttctcactgtatgttaggttgaggggcagagtagtgaaccaacagaaaagattcctgctttatggagcttacattttgttgaccttttcagataaccagattctccttttctaaaacagtggttttaaagctattagttttcctcaaagccctgctttagctgcatcccatgtattttgctatgttgtattttcattatcatttgattattctaatttctcctgatatcttctttgatccaatgattatttagaaatgtattgcttcatttccaaatatttgtagttgatttctaacaatatcattgtggtcagagaacatactcttcccatctttaaatttatttcaatctgtttaatgacccagaatatgatgtgtcctgaaaatgtaccgtatgcactgctattgttagctaccgttttctctacgtatcagttaagtcaacacggtttatagtgttgttcaaatattctatgtctgtactggttttttgtttgtttgttttaagatagaatttcattctgttttcgaggctggagtgcagtggcgtgatcatagttcactgtagacctgatctcctgggctccatgattctcccacctaagcctcccaagtagctaggactacaggcatatgccaccatgcctggctaatttttaaattttttatagagatgagatcttgctataccacccaagcttttatttatttttttattagttgttctatcagttgctgagagagggacattaaaatcttcaggaaaaattatagaattgtctgtttctaactttaattctgtcagttttgcttcatgtattttaaagctctattaggcacatatgattgcagtgtttttctgataattgacccttttttcattatgaaatggccctttttatttctggtaatacattttgacatctattttatctgatattaatattgccatccagcctttttatacttattatttccatggtatatattttttccattcatatactttcaatctatctgtgtctttgtatttaaagtgtatctcttgtagacagcatatagttgggttttgcttttttaaaaaaaaaattattctgccatcctctgccttttaattggtgtgtttaatgaaattattgctttaatgtaacatgtaatagaattattgctatattgggtttgagtttagcattttattttttgttttttacttgtcttttttgtacctctgttactcttttctttccttcttttgaattatttgaatatagaatttcattttaaattttctgttggctttttagctacactcctttgcattattctttagtcatttatgagggatcacaatatacatctgtgacttttccactacagttaatactaaccccttacagttaataataactgcttacatgagatctattgtacaacattgtgactaacatatgtataattaataacatgtatgtatccttgagaaccactaagagagtagattttaagtgttcttaccacaaaaataagtatgtgaggtaatgcatgtgtgtgttagctcaatttagccattccacaatgtatatatatatattttaaaacatgttgtatacaatatatacaatttttgccaattaaaataaatgaaagccacttataattaatgacatatacttcatataaaatactgaaatcttgcaacttgtagatccatatttaccccatcttttatgttatggtacttgtatttattacataaaaatacattataaatcctgtaagacaatattttaatttctgtctttaaaagtttgaaggttcaaggctgggcacagtggctaacacctgtaatcccagcactttgggagggtgaagcaggatcacttgaggccatggattcaagaccagcctgggcaacacagtgagaccctgcctctataaaaaatttaaaaattagccaagcgtggtggggtgcgcctgtagtcccagatcctcagaaggctgaggtgggaggatcacttgagcctagggagtgaaggctgcagtgagctgtgatcacacccactgtactgcagcctgggcaacagagtaagaccctgtcaaaaaaaaaaaaataataaaacttaaggtttcataataacataaaaggaaaaaggaaaaaaatgagtctttgaactgatgcaggtatttatcatttccagtgctcttcatttttttctgagggtctgagtttgatcttatataatttttctttagcctgaagaactttcattagcatttcttgcagtgcaggtcttttgatgattaattctttctggttttgttactctgaaaatgtctttattttgcttgctttcttggaagatattttgctggatgtaaaattctgaatttagttttttctcacgtggtactttaaagatgtagttccgctctcttctggtctccttagttcatgataagtcagctgttaatcagactgcaggtcttttgtatttaatatgtcatttttctcttgctgcttttggtatttgttctttatctttggttttcaacagtttgactataatgtaccttgaggtgggctgttttgcatttattttgcttagtctttgattagtatctcataattgtgtgtgtgtatttgtgtgtgtgtgtgtgtgtgtgtgtgtgtatatttatttatttatttatttgtttattttgagacagagtattgctctgttgcccaggctggagtgcagtggtgcaatcttggctcactgcaacttctgcctcctgggttcaagtgatgctcccacctgagcctcccaagtagctgggactatagacgcgcaccaccacacccagctaatttttgaatttttagtagagatggggtttcaccctattggccaggctggtctcgaacacctgaccttaggtgatccgtttgccttggcctcccaaagtgatgggattacagacatgagccacggcacctggcctgtaattgtgtatttgtgttcattaaatttgtgctatttcagccatttatttgtttgttttgtttttgcgccactgcgctccagcctgggcgaccctgtcacccggggtcttgctctgtcacccaggctggagtgcagtggtgcaatctcagctcactgcagccttgacctctcgggccccaagaaactgccccacctcagcctcctgagtagctggtactacaggcacataccaccacacctggctaatttttttttttttttggtattttgtagaggcagagttttgtcatgttgcctaggctgatatcaaactcctgcgctcaagcagtctgcctacctcagcctcccaaagtgttctctgtgttctctggttggagcacagtaagtgaagggaagaatgatgtacaatgagattggagaggcgaagaagatcacggagaggtttatagaccctgataaggagttggaaattatgattctgagtaagaaaatatgattaccataattgtaagggtagcttgccaaactcatattgctttatccttcagagtcttgaccgatggatagggtggccttgtgattgtatgacctacctgtcagttaacataattggaacagaagctagaagaccatgcagactgggtttctgcagtgtgtgggaagttgaagtggacgtattctaacatcccttccactgctaaggttctccggtatcgctgaaaacaagttggcctccatgtagaaaagtataatgtcaattaaaaccacagtttataatgaagagtgcaaatgtagagaatgaaaagaccattgtagaatgaagagttgtagttacacacagctaaagatttcatgtgatttctgcttaagagcagtatctgtagtccgtaagtgttactatgttaaaacaatgggcttaaaacagcatgctagatagagtatgtttatagatctgatttccggggaacacttaaagctcacttgatcctttctttggtttagatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaaggtgggcgtttgagtgacacaggaacttcagtagaattggtctcgtggcagaatcttgctctagcaaacacattgtgctctttaatattgacagagaatcgaaacttagaataacaataaaacagtcttagcactgtcaacataatcacacgacgtatgatagtattttggggcttgatgttggtgaattgtacagcccagtgatgtacatttgtaggtgatcattaaatgcttgttgagtcaaggaaggaacaatccaaatggaccactgagaacagttcttttttttttgagacagagtctcgctctgtcgcccaggctagagtgcagtggcgcgatctgggctcactgccagctctgcctcctgggttcacgccattctcctgcctcagccccacgagtagctgggactacaggcgcccgccaccacgcccggcttattttttgtatttttagtggagacagagtttcaccgtgttagccaggatggtctcgatctcctgacctcgtgatccgcccgcctcggcctcccaaagtgctgggattacaggcgtgagccactgcgcccggccgagaacagttctttatcaggattctctgggatggagagagcttgcagaaagaaccatgatcctttgggccacttttggaggttgttctacctagcttttttttgaaaactgttatctctttatatgcacttagcttatactgtcattcagttcagcatagcaacactcgatcatatgccacattcaaagctctgagccaagcactgggggtgcagaggtggcgggcctccctctgaggagctcagagtcctatgttatcattagctcttcccctcttctagctgcaaagcaagccactctcatgcaaagcccagtgttccttttgaatctcctctgctgtccacaaggacatcacctgctacagagctctgtccctggtagatttctagcaaatttaagtcatcatttcatgtccctgtggctcttgggaatgagatattaaaaagcaatatttgtattaaataatgttgtcattatcttcttagaagataatggaattagacaattagacaatgttggaaataaaacgcctcctaacaatttctgtccagctagctggcgccctcatgtctacatgaacttgcaaatggctcgtctttagccagaatcactcttcctcgtgactaactgtagaaaagagaattcgtcttggctgtaagatgcctttggctaaaacgttttttgagattacaacatttagatgttcctttaaaaatacctttcattggctgggcacagtggcacacgcctgtaatcccagcactttggaaggctgaggcggtcagatcacctgagcccaggagttcaagacccatctaggcaacatagtgagacctcatccctacaaaaaatttaaaaattagctggatgtggtagcaagtgcccgtggtcccagctactcaggaggctgaggtaggaggattgcttgagcctaggaggccaaggctgcagagagcaccactgcactccagccgggtgacagagcaagaccccatctcaaaacaaaaacaaacaaaaggaatacctttcattgttatttcaatttaacaaattatttcacagttaatgtgtattttccttagagttgggagggaggactgtctaaggttgcgtctttgagtttttttttctcaagtacttggctgcatttccacacatctgtgggaagaaatcaatttctttgtcatcccagatgttatcaccagcttcgtgtgagatggctggctacacctgttgggctgatgtctgcattttgaataatcattttaagtaatcttttttcctcctgagttacaaagtgattcaggtattttaaatagaaaccgcattattttaagtattcttgacctaccagctttccaaaaataaatctgatgactgctgtgtctgaaagggtacatttgaaggagctgttttatataaatcttcagacctctaaaacttccttatttttagaaaactacaggaagaaaataacagggtgtgcccaagagttttgttttcttgattaagaatgatttgaatttcataactgcacagaaaaataaatgttttcatagtcatctgatatttctttataaacattctttttctaactgtaagcaaatcaaagcttagttgccagaaggtcacaccaagaagtaaaaaaaagattcacaagaaagcaggtgaatgggctgcatcccctgagtggagggaccttgggctctctactttctgtgcagctaattagagcacagtggaaacaggggcaggaggggcgtgcccgtgggaggggcatgcccacgggaggggtgtgcccgtgggaggggtgtgcctgcagcagctgccctggctgtgctcatctttgaggcagctgccacgtgggcacttgggaactggtgcccacacctctgtctgtctttagagctggctctctgtggtcatggttggggtggggagtcttttaggcaagatggattttaggcaaatctcctttggttttaagtggccacacaattatcacttcataatattttggcctgccatgctcatatagacttgaagtagcctggacacatgacattcttatttttatttctgagacagattcttgctgtgtcacccaagctggagtgcagtggcgtgatcttggttctctgcaacctccgcctcccgggttcaagcgattctccagcctcagcttcccgagttgctgggactacaggcacacgccaccacacctgctaatttttttgtatttttagtagagacggggtttcaccatgttggccaggccggttttgaactcctgaccttaggtgatccgcctgcctcggcctcccaaagtgctgggattacaggcatgagccaccgcatctgacctgcattcttatttttaaatatcaaatgattttttcccccacagttagttttttaatgcttaggtctcactcagtatgttgaggtttgggtgtacagcttttgctgtctgcccaatgctgggcgtggctgtgccaccaagaagcaggcaggtactcactgggggtcctgctcaaagccagtgcgggaagagcgcgtgtctttctgctgccgtagccgctagctagtttttagactgcagtcaacactcactggcctcagcagtacctgtggagccatagataatcattctgattcctttccacaataatactccacttatttgaagaatgttatcatgacctctaagctttggctgactatcattcttcatatgccttgactagtataacgatgagaactgcaggttcatggaaataattcactgacagctaaggtcaaggcttcctgaaatgggatgagattgtggcccactgtaatgtgctgggcctgtggataggtattctgtagagagggagctgtcacttgttcccctgtccctgcggttggcctgcttgcaccagttacccaggtcttctttcccttgaggatactgctctgggtcttaggatttcctcagtctctgtgagctccccagactctgctttctccttttcctttgatattttttaaaataggaagaaccggctaccatatcacacaccttcactgtggtgaacctcagcccataaagctggcttggttcatgttggatttactcttggatagaatgacttggaatgtttccactttgctgagcttggattaccatgtagtggagaaaagagaatcaaatcgttcacgaagggctgtattaaaattcttgctaatacggaagtgtttcagagttgtggttggagtggggcaatactctggtagcagaatacagtgaacagaccccttagatattgctgttgtgaccgtaaatacagacaaatgatggatgagtaagggaattcattgcagcactgtgcgcaacggagaaaaactggataggaaacaataagggagcagcaagcagtaggggcatggccaggagatgatggtgcctccatatgattaaatgctgtgtggtctttaaaaatgtttgtgttactggtacaagagggaaaatgcttacgcattacattgagtcaaatgcaggctataaaactgtatatactgtatcatttcaactaaatagacaaaatttatgcaaagaagactggaatgaagtactgtatagcaaaagtaattcacgggttttttcctgagtaataggattatgaatttttaaatacttttagttagtttctaaatgttctgtggtgtgtatttcttaataagcagaagaaatttgtgttctaaaaaatcacttctttctttgcattgaatctgaggtcaacagcagggctcatggcaaatgtcaggaggccaggggtttactcacatgtgttttcaagaagacagggagtagtttggagttcagtcaatccattgtatacacacacagctgattttcattttagtgcagggatttttaaaatgtaaaatgtagatgaaaatatagtcattgtgccatgtatctgggattgtctattttgttatgcattaaccagtgagtagctcatatttcccatttgaaattttgcttgtttgttcagactagttaggcagcttcccttttaaagtactttaatatgaaatactttaatatgcctttgcaacttttacaatcagttataccaactagtggatctatgaattagaatatcaaagaattataataattattggcttcattaattaatggatcagagaattactaaatataaccagaaggcttctgttggggaggttaataagcaagtcagtcctgtcattccaagacatcaaaaccctctagcctcagtacatagcctctgcaaccactgtcaaaagccaactacagatttttagctgtgagaagcctgtgctacactggcacttaacactgatattcagaatactactcataggtaccatgtattgattgactaagggctggactttgcagcagacattttggatgtattcactcatttcacccctccacgtttctgtgaggcaactatcattgtgcccattttatagatgagaatgaaacctctgggaggtttagtgatttgcccaggctacacaagggctaaatctgggactggaccccagggcccggctggcatgttctttctgccatctgcattgcctcactgtgcatgcctctagcagtattccataagttagcattattcacattaaaccaaatatttaaaacatgaatataatttgaaaatcttttttcaaggtttaatttgatttgcaaagtgtgccaaatacactagatcatattcagcacatcattgtgtgaaatactatgttacggtctcttcacaagttttattaggtaggtgcaactgacaaattaaaatttttaagctcttggcagtcaatgacattaatgaataattaacttagttctttatcctggttaaccaaaattaaggagcaagtggcttttgctttttctcttgtctactgcaccttctccttacaaattggcaaattacagaaaaaaatcttttctcttttgctcttttagatagaacatactatagtttcttttgtttctctcattagctgccctctccagtttagatagatattctgtagtgatttatagaaaagggtttagtagatgtttgtagtttttcagagattaaaaaagacgtttcaaattttgtattatgaaaatgttctcaaatgtgtacaaaagtagaaagaagagtaccttttacctgccattctcatttatcaatatgtggtcagttttcattatgaccctctcccactacccctcaccccatattggattattttaaagcaaatctaagacgctatatcattttatctgtaaatatgtcagtatgtatttctaagatatagactcttttttaaagtccataatggctgggcatggtggctcatgcctgtaatcccagcactttgggaggctgaggcaggtggatcacttgagcccacgagttagagactggcctgggcaacatggtgaaaccccacctctacaaaaaataccgaaattagccttgtgtgatggcgtgaacctgtagccccagctatgctggtggccaaggcaggaggatcacttgagcccaggaggtcgaggctgcagtgagccgaggtcacacactgcacttcagcctgggcaacagggcaagactctgtctcaaaaaaaaaataaataaataaagcaaaaataaaaataaagtctataataccattattacacttaaaaattaataatttcttaatatcatttaatagcaagtcagcattcagatttccctaattgtccaatgaatgactttttaatagcagttttattgaaatataattcacataccataaaactgacccttttaaaatgtacgattcattgattattagtataagttgtaaaaccatcaccactatctaattttagaaaatttgtatcacccggaaagaaactcctcacccatgagcggtcatttccagttgctccctcctcccagtccctggcaactgctagtctacatcatgtctccatagatttgccaccttggatgttttctggaaatgaattcatacaatatgtggtcttttgccactgtcttctcccacttagcatacttgttttcagggttcacccatgttggatcacacatcattccttttcattgtcaagtaatattccactggatgcaacattttgtttatccatttatcaggcaatgggcatttcagttgttaataaattactttatgaaatcagttcattaatgtctttttccccatttatatttctattatattgaatttttaatgttacaggattcttgcactcctagacccatgcctaagaattcaaatgaaaacgcatggtacaatggacagccccatctacatgtaccttttgataatttcgaaacctttttaaagtgatgcagtaagagacagtgttttaactctgctgcagggtttcaggtttctggacagtagatacaaagtagcatgctctcttgttctgaaccttgctctttttacttagcagtgtggcctacaaggcattcctttgcagtgtctagagctcctcctcattccttttttttttttttttaggcagagtttttgctcttgttgcccaggctggagtacaatggtgcgatctcagctcaccacaacctctgcctcccagattcaagcgattctcctgcctcagcctcccgagtagctgggattacaggcatgcacctccacgcccagctaatttttgtatttttagtagagacgggttttctccatgttggtcaggctggtcgtgaactcccagcctcaggtgattcacccacctcggcctcccaaagtgctaggattacaggcgtgagccaccgcacccagcctcctcattccttttacagctgcacagtgctcccttgctaggagatgccacagtgtattcaaccagtccctgcaacaggctttggttttgcaaattgtgctgcagtgattggccgtatgcgtagggcattttgtatttttgccagtctctttaggacaggtgcctagaagtaggggtgctgggtcagaggatacgtgcacctgtgattttgctggatgttggtgatggtgatgataggaatctcctccagcactcagctaatcatctactttgtcttataacttagcaaaagcaggttgccttttccagttctaaatacagacatcttttaaattttgaaatggataattaggaattctagcttcatagtggttagatatgttaaaagtaaactttggatttcctcatataatcatatatgtaatcatgtttttaagcctaatgggagttttatatatcaaatagtgcacattgcattattgatgtgatgtaagttaaaagcatttcttgatcattagattataacttaatatcaaaaaaatgcattagtagatttggctagctttactagaacttctagatttattcatatcaactgtagttttgaaaatatattatcatggatagtgctttttgaagtctgggtattctaattcaaccatttagaatgatgaaaaaaatttatttcaggcttaattatgaatgtgtttggacctgagatttttaataccttagttagattttcagttaccaaactatggagtcatattgcagggaatctaactcaaggtggtttaaatagtatgaaatataacaggaaactgctgagcataaataccgcacctgttactggaaaccagtcttcagcttggttgcccttctcccttcacttccagcgggttggtagggtctgttctcagagaggccaactcattgggaaactcaaatgttgctttacagaacacgcttctcacatgaatgaaagacaacagatttcagagtgggaagataccttaaggaacatttttgagcaaaggctttcctttatgggtaaggaaaattggacccagaggaccttgcctgtggacacctggctaggtggggacacagcagggactggcgccccggcccctgaatcccaggcctgagttccttcccctcctctccactacctcccccactctgccttggtgtaagcacaggaagtaagtggctggttttgggggagaatgtgcctagggttctactccaaatctgtgtacaggatatgcagcccatgggttctcactggctctgattctgcctctggtaccacttgaccatagcattttattctcttcacattatattcacgatacaaaattgcacccattgtccacaacagagcattttattgtcgggatgtagccaggggataatggctaccacttctagggtgtctactatgtgccgggcactgtactagaaacttcgcattgctcattcctagtcctcacagcagccctgcaaggtgggtgggcactctgaccttattttagaaagaatccaaggcgtgtgctgtgtcttccagctcagctgaggatgagtccagtcctgtctgccttgaggacccttgccctccttcacctgggcacctcttacccccagagacaggattccagccatcctgcaatccttccaccggatgcgttccaaacacagcgtttctcaggctcctttcatctgagaaattctccttttggtgctgtgtttgttgtcgtgttttgcctctaggaaaaagttaattttttttttaaaacaaccctttcatgaaccaaaagaatctctcatatcttagtgtcatctggaagctagggatccatttaccttagcacatgacgagcagaaaattgtgtttgaaacttccctgctgctatgtcacttctgcatttttaaagagcacttatctgaaaatgattcattacagctgctcctctttcctgtcatcttcaagatccaggctggcacctgttcagactcaacactaggaggtatttttccttccaccaggttttcttaccgcagcgagctttcttccttgagtggctaataatttttatacatggtaatgtgaaagaaacctggcgtgatggcatgtgcaaaataggtacttagtaagcgtgctggtggtgggggttacgatgctatttaatcagtcagtggttacaaaaacccaaggatgttatcaagacagggatgagcagcaattggatcttgccgaagttgggatctatccaacttctcagtcattccaagagtagtcagtgtgtgtccccctcccccttcccatccctctcctcttcctcctcttcccaccctctatttttctttcatgatctctcatcacaactttaatattctacttgcttctgatgctactctatgatattttaagatataaaatatacactctgggaatgcctcctgcattgcatctgattttcttttcatgggcttttaaaatcctattttctatttcttcttttgagaaaaggacaacaatagattattatgagattgaattttgaaattatcactcaagaaagaatgaacaacttagtagtaactccaaaatggcaacataatgtctgctcttagaagcaaggctttcgttactgaaattaaaccaagttacatttccagtgtatgttcactcccttctgtgtgtaggcctgggagcaggtactagcttcaaggatcctgcagtcagtggagtagacagactattggatttagcgttccaagtgtgatgacggtggccagggcaaggcgctgtgggagcatggaggaggccccactttcttttacattaaagagagaaggaagattggccctcagctttagggactggaaagttccagcaagttaaaaatttggcataatacacagttttgttgttggtaatattttaagagcctaaatggaggcagatttaattctatgatgaacaaaatctgctagcttttttgtttgattggagatggagtatcactctgttgcccaggctggagtgcagtgacaggatctcagctcactgcaacctctgcctcccgggttcaagcaattctcctgcctcagcatccttagtagctgggatgacaggcgcatgtcaccacgcctggctaatttttctgtttttagtagagacgaggtttcaccatgttggccaggctggtctcaaactcctgtcctcaggttatccacctgcctcagcctcccaaagtgctgagattacaggagtgagccaccatgcctggcctctgctagcatttttaaatgaactttttattttaggatagttttagatttctagaaaagttgtaagcacagaaggttcccatagacccagtacccagtttcccctgttattaccgtcttacattagtatggtacatttgtcacaactaatggatcaatattaatacattattattaattaatgaccatgctctattgggatttccttagtttgtcccttaagcccttttggttccaggttcccatgcaggataacacattatctttagttaccctggctcctcagcctcctccaggctgacagtcttccttgtttttgatgatcttgacagttttgaggaatacctgttagagggttcattgactatccttcaccttggcttcgcctgatgtttttctcatggatagactcagcttatgggctttagggaggaaggcacagaggtaaagtgccattctcatcttatcagcacatcccgtccaagggtgcatgctatcaacatggctcatcactgtggttgttgaccttggccatctggctgagggggtgttggtcaggtctctccactggaaagtaacttctcccccaacttcgtcatgtggctgttagaaggaagtcagtatgtgccagctacatttaaggagtggcagattatattttaccttcttgagggtggggtagccacataaattattcagaatacagctgtatggggatttgtccgttctcttcatttatgtatttacccaatcatttatttatatatactgtagcataaacttacagatactcgttgtgtactttgggttataatcgaatactatgttatttgttttgtggctcaaattgttccagctttggcctttgggagctctttcagttaggttttgtgtccgtttgacttgcccccaccaaaatagtgtcttttggttttgttgttgttgtctgagcacttctttactttctggcaccacagaagactccagattcatgtgctccctgccccagccgtacgtgctgctgcttcccctgaaggcatgctttcttctgctgtagaatggccttggaaaccaaggtttgggcattaggtgtcattgctttaggccctgtcagcagacagagctcagaaacatgtgtttatactaacctgtgtgtgtgggtgtctatgtatgtatttatacttacatgtctgcatctgtgttaagggaaacctgagtccacactgatgtctctactctagtggcacatggttcattcccgccatctgcccttgcttatccatcacctccctctccaacagtgagagacctgccgctgccatcctccatccttttatgtaattgttccatcctgatgttcctgtgtagtggtttcagaattgttagcctccacctttgtgggaagcacccttactaactagaatacagtgctgatgcgcagttcctgttatctttagttttacagtctctactcatttccaaaatgacttaggtcagcatcttcctgccccccactaccttcagtgaggttgtcatatgtttgtcatacaatcttcattccatcatggggtttccctgtctcctagatggttttacttgcatacttcaaggttcactcttggtgctgtaagggtctctgggctttgacaaggcatcatgtcacatatgccccatgatggtatcttacagaatagttttatcaccctagaagacttcctgtatgtcacctattcagcccctgccctgcaacctctgacagccacaaatcgattttctgtctttagtttacctttactcaaatgtcatataaatgcaatcatacaacatggagcctctcagacttgctgctttcccttagcaatgtggatttcagatgtggtttgcttcattccttttatcaccaactcatattccattgtatggatgggtcagtttgtttatctgttcacctatcagaggacatcttggtcgcttcccgtttttgacgattgtaaataaagcagctctaaatatttacatgcgggtttgtgtagacataagttttcagatcaattgggtaaatacctagtgtcagtacaattactggatcatatggtgaaactatatttagctttataagaaactgccagactgtcttccacagtggctgtactatttttcattcccaccagcaaggaatgagagttcctgttgatcggcatcccggccatcaattggtattttgtctgtctttttggatttcagccattctaataggtgtatagaagtatcgcattattgttttaatttgcatttccctaatgacaaatgacgttgagcatcttttcatatgcttatttgccatctgtatatgtcttctttggtgaagtgtcttttcagatcttttgcccatttttttaattgggctgtttgttttcttaccattgaatttgaagagttccttttatgttccttatacaagtcttttatcagatacgtgatgtgcaaatattttctcccaatctatgccttgtattttaatcctcttaagttcttttgcaaatttttaaaaatgttaatgaagtccaaactatcaatttttttctttcatggattgtgcttttggtattatatctaaaaactcatcaccaaaccactttcttctagaagttttatagttttgcattttaaatttaggtttatgggctgttttaatttttgtgtagggtgtgaggttagtgtctaggttgcctttgttgaaaagatgatcttggctgggcatggtggctctcacctgtaatcccaacactgggaggccgaggcaggcggatcacctgaggtcaggagttcgagaccagcctggccaacatggcgaaaccccatctctactaaatatacaaaaattagctgggcatggtagccagcacctgtaatcccagctactcaggaggctgaggtaggagaatcgcttgaacccaggagaccgagttggctgagattgtgccactgcactccagcctgagcaacaagagtgaaactctgtctcaaaaaaaaaaaaaaaaaagaaaagatgatcctttctccaaggaattgccttcatacctttgtcagtgctgctggtgtttcaaaattcatgtccttttcctttctacttagcttatgttctgtaaaacagtggtctccagcctttttggcaccaaggaaattgtggaagatgatttttccacagaagtggggcgggtggtggggatggttttggggctattcaagcatggtacatttattgtgtaccttctttcttattatttattgtgtaccttctttcttactattacattttaatatataatgaaataattatacagctcaccataacgtagaatcagtggcagtcctgagcttgttttcctgcaaccagatagtcccatctagggttgatgggagacagcgacagatcatcaggcattagattctcataaggaatgctcaacctagatccctcgcatgcacagttcacaagagtttgcactcctatgagaatctaatctgatctgacaggaggcagagctcaggtggtaacatgagtgatgggtagcaaccgtaaatagagatgaagagttgctcactcgctcactgctcacctcctcctgctgtgtggcctcatcttcctaacaggcagttgaggacccctgctgtaaaatgttacctttgcaaaggggaactttctgatattattttctgcttgtcttacagcaagaccactgatgcagaccctgcctttaagaaccacggtcaacaatggcactgtgttaccaaagaaacctactggctctctaccatccccctccggggtcaggaaagaaactgctgtgccagcaaccaaaaggtgagccagaagcagggccttaaatgaactctcaaagcagttctctcttagattccaacatgagtattactttttaaaatgacattgtacaatttcttctgtgagttaaagcttataaaagtccaacattttatatggtgccataacaagaactagttaagtttattattattcttgttttagatttacttgtgttgcctttgaaacctcactggctaaaaccacagtgtggtgttttgtatttttacttaaagttctcttttgaaaaaacaaatgttagtataacctgggtaaaaataaatagctgttcccaagtccatactgggaacatggcaaaattcagattgccatagcaaccttagatttttctctatgcaatttggataagctcatactttcaaaatgtacccaacaatggagtctaaatattgatgttatctgtcacaaagagcacagtttgctcttaactttgctattattttgtaattatcatttaaagatttttatattttagggccaggtgcagtggcttacacctataatcccagcactttgggaggccaaggtgggcggatcacttgagctcaggagtgtgagaccagcccaccttaaccatttttaagtgtagagttcagtagtgctggccgggcttggtggctcatgcctgtaattccagcactttgggaggccaaggcgggcagatcatctgtggtcaggagttcgagaccagcctgaccaacaggcgaagccctatctctactaaaaatacaaaaattatctgagcgtggtggcacatgcctgtgatcccagctacttgggaggctgaggcaggagaatcgcttgaacctggaaggccaaggttgcagtgagtcaagattgcaccattgcaccccagcctgggtgacaagagcaaaactccatctcaaaaaaaaaaaaaaaaaaaaaaaaaagagttcagtagtgttaagtatattcacgcatctattgttgtgcaacagatctctagaactttttcatcaggcaaaatagaaactctagacccattaaatagtaactcccctctactctccccactgcccttggcaaccacctctctactttttgttgctatgattctgactacattaggtatttcctaggagtgggatcatctaagtagtgcttgtccttttgtgactggcttactttgtttagcatgatgtcctcgacatgcatccatattgtagcatgtgactgattttaaggctggataatattgcattgtgtgtatatatcatattttgctttttatcttaattttaggttcagggggtatgtgtgcaggtttgttacaagggtatatttgtgatactgaggtttgggcttctgttgatcctgttacccagatagtgaagatagtaccaaataggaagtttttcaacccttacccacctctctcccaccctccttttggagtccccagtgtctcttatccccatctttatcatattttgtctatacattcatccatcagtggctattctgtaccatttatctgcacatctgtccttatggccaataccctaccatcttgattactattgctttttagtatgttttaaaatcaggaaatgggaggcccccaactgtattcttctttttcatgattgttttggctatttagggtcccttgatattccatatgaattttaggatagtttttttctatttctgcaaaaaaatgcctttgggattttgatagagattgcattaaatctgcatatcactttgagtagcatggagattttagcaatattaagtcttccaatccataaacataggatgtctttctcttttttgtattttcttttagcaaagttttgtagttctcagtgtatgagtcttctaactccttggttaaagttattcctaagtattttatcctttttgatgcttcagtaaatagaattaatttcttaacttccttttcagcttggtcattgttattatatagaaatgcatctgatttttgtgtgttggttttgtacctgaaactttgttgaaattatgtattagtcctcacagttttcttctggaatctttagggttttctaaatataagattctgtcatctgtagaccgatagttttactttggatcctttcctatttggatgcctttcatttctttctcttgtctgattgctctgggtaggactttgagtactatgttgaataatagtggcaagagtgggtatcttgccttcttcctaattttagaggaaaagctttcagtcttttaccattgagtattatttgagctgtggccactcaaatatggcgtttattacattgaggtagtttccttctattcctagtttgttgtgtttttttatcatgaaaaggagttgaattttgtcaaatgctttttctgcatcagttgaaatgatcatgtggtttttgtcctttattctgtgaatattgtatcacattgattgatttttatgtgttgaatcattcttgcattccaaatataaatcctaatttgtcatggtatataatccatttaatgtgctgttgttttcagtttactagtattttgttgaggattttttcatcagcattcatcagggatattggtctatagttttcttttcttgtgtctttgtctggttttggtattagaataatgctggcctcatgcaatgatttggaagtgttccctcctcctcaattctttggaagagtttaaggagcattggaatttatccttttttaaatgtttgatagaattctccgctgcagccattgggtcctggacttttctttgttgggaggtttttgattactgcttcagtctccttactagttctaggtctgttcatattttttgcttctttatgattcagtcctggtgggctttgtgtttctaggacttatccatttgctctaggtcacccaatttgctggcatatgcttgttcacagtggtctcttatagtccttctcgtttttgttatatccgttgtaatgtcctttcatttctaattttagttatttaaattttctgtctttctttgttagtctagctaagggtttttcaattttgttgatcttttttaaaaaaaacaattcttggttttgttgatttttttcctattgtttttctattctccacttcatttatctctgctctaatctttattatttccttcgctctgccaacttttggttttatcttcttcttctagttccttgaagtataaagttaggaggctgatgtgagatctgtcttctttttatgaaaactttgatcactatagacttccctcttagtacccctttcactgcctcctgtaaagttttggtatgttgtgttttcatatgtctccggatatttttaaaatttctttgtgatttcttctttgaccattgattgtttaagagtgagttgtttaatttaaagattgactttttattgtagcaaatacatgcatgcctcattttattgtgtctggctttattgtgctttagagataccacattttttttacaaattggtggtggtggcaaccctgtgttgagtaaatctatcagcatcgtttttccaacatgtacccacttcatgtcacattttggtaattcttgcaacattacaacttttttgttatcattatgtctggtatggtgatcagtgatctttggtgttaatactgtaattgttttggggcaccaaaaacagcacccatagaaggtggcaaacttaatccataaatgtggtttgtgtcctgactcctctgcccattgtttccccatctctttccctctccattggcctcccttttccctgagacacaacaatattgaaataaggccatttagtaaccctataatggcctctaagtgttcaagtgaaggaagagtcatacatttttcactttaaatcaaaagctagacatgattcggcttaatgaggaagacatgtcaaaagccaggatagaccatcatgtggtttagatgtttgtctcctccaaatttcatgttgaagtgtgatccccactgttggagatgggcctgggaggaggtgtttggttcatcagggtagatccctcatgaacgtattggtgctgtcttcacaataagtgagttcttgctctgagttcactcaaggtctggttgtttaaaagagcgtggcacctcctccccacttgctccctctcttgccaaaggacgtgcctgctcctgtcttgtcttctgccatgattgaaaactccctgaggccgcaccagaagctgagcaaatgccggtgccatgcttcctggacagcctgcagaactgtgaggcaattaaacctcttttctttataaattacccagccttgggcattcctttatagctgcacaaaacggactcatgcaggcctgttgttccaaacagttagccaagttatagatgcaaagaaaaagttcttgaaggaaattcgaagtgctactccagtgaacacgtgaatgataaaagaaaaaaataaaaagcaacatccttattcctgatagggagaaagtttgagtggtcagaatcaaagatcatacgaggcacaacattcccttaagccaaagcctaatacagagcaaggccttaactctcttcaattttatgaaatctgagagaggtgaggaagctgtagaagaaaagattgaagccagcagaggttggctcatgaggtttaagggaagatgccctctccataacataaaagtgcaaggtaaagcagcaagtgctattgtagaagctgctacaggttatgcagaagacctagctagctaagataactggtgaaagcagctacactaaacaacacattttcaatgtagatgaaacagcgttacattggaggaaggtgccatctagggcttttatatgagaagtcaatacctgacttcaaagcttcaaaggacagactgactcttgttagggcctgatgtggctggtgactttaaattggagctagtgttcatttatcattccaaaaatcctagggcccttaagaatgatgctaaatctctgcctgtgctctataaatggaagaaaacctagatgacagcacatctgttgtagcaatatgatgtactgaatattcttagcccattgttgaggcctactgctcggaagaaaaagcttcctttccaaatattaccattcatttacagtgtacctagtcatccaggagctctgatggagcggaaattaatgtttttatgctggctcacacaacacgcattctgcagcccttggatcaaggagtaatttcaactgtcaagttttattatttaggaaataacattttttttttttgagacagtcttgctctgtcacccaggctggagtgcagtggcgcgattttggctcactgcaacctccgcctcccgggttcaagtgattctcctgcctcagcctcccaagtagctgggattacaggcgcacaccaccatatccagctaatttttttgtatttttagtagagacagggttttgccatgttggctaagatgatctcgatctcttgacctcatgatctgccctcctcggcctctcaaagtgctgggattacaggcgtgagccaccgcacctggcaaggcatttgctgccattgatagtgattcctctaatagatctgggcaatgtcaactgaaaaccttctagaaaggattcaacattttaaaagtctttaagaacatttgtggggccaagcacagtggctcacacctgtaatcccagcactttgggaagtcgaggcaggaggatcacttgaggccaggagtttgagactgcagtgagccatgattgtgctactgcactccagcctggtcaacagagcgagaccctgtctcaaaggaaaaaaaaaaaaaagaacatttatgattcatgggaggaggccaaaatctcaacatgaacagggaagtttggaagaagatgatttcagccctcatggatgactctgaggcaattcaagacttcactggagaaagtcactgcaaatgtggtagaaatagcaagagaactagaattcgaaatgcagcctgaggataggactgagttgctacgatctcctgataaaactttaatgggcgaggaattactgccaaaatagtagtttcttgcgataggatctactccgagagaagatgctgtgaacactgttcacatttcatgacaataaagggtttagagtagcacacaaaccctgatgaagcagtggcagggtcgtgtggctggagcgtggggaacgtggcccgggctgtctggctccaaagcctgtgcgccttccattgtgctcggctgcttcccgcacagatttccaggtcagccctgacatctgctcaggaaaaacgcttgatataatgactgcttgcaaatcatccttcttttatgccccatcctgtctgtgtactatttgtgggagcaggagcagcagtcaggagtgagggtgactctcagcaaagatttctcagattgcaggtctgatgttgttaaggggatgtcggggccaaacaccaagtaaggaaacaagtcctggctatgaacagaggcctgggtcttacacccccacatttcagccacatatgaaagggctcctaggtggcaattactctcagcaattttatcttagggaagaagggagggaggaagggagcaagacaggaaggagtgaacgaacacgtgaaaaattatgctttgtagccatcgtgttatatctaagtgtgtacgtgtgtgtgctagcacttaaatggtaaccctcctcccagaaacattctaaggcctctgtagacttttccttataatttacagaatatccgtttgattactctaataagctattgtcagcatatagctgccaactagaaatacatatttttctagactgagtgtccaagactctgggttttgagtgaaagtgtagtgattcatgtattttggttcgtttctggcatttatgggcttcggtggatgggacttcccttccatttggaagctagaaataagaacagtagcatctaattgctactctgtggtaaagttcctatagatctctcattaggagagaattttgaaaacagaaagaagcaggctgggcattctgaatattaggattaaaataacttccaagtcatttcaaatatgtttacaatcaggtaggaatttttctgtaatcagagttccaaattaaatgagttggggcatctgtggtgtgtggatgggtatatgtttgttttcttttctccgggggtttttcagcctggtgcttaagaacaaaatcccctttggaaatagtccagttcccagcggttgtgctttgtgttgccaattaagacttcgattgagggcttgatttggaatccttgggaaaagctttgtttccattaggcaaaggaaaaaaggcagaaaatccagggaagacattgtaggtcataccttgctcagtggggatgcggaggctgacaatggagtaacatttctactggttcaagaaagagacaatcactgttctctgggctcataagtagagcatgacaataggccaagctatgtgaacagagatcaaaagaacaaaactggtacaaaaagcgttatttaaaaaatgctctgtgacaaatgtgagatagactggtaaatatctcttgcttccaaacaaacagccaatagtcctttggaaaaatagttccacttgttagaagtacagcatttgtaattgcactgaagccagtgctgggtacatagcgtgatttgaagaatagaaagccaaaatctggcttcagttgatttttaagaattatttctaatatatttctctattattccgatccattgaaacgtaggtgataaatccatgtttgagtctgttctcagtagcaaaatagaggtggaagtattgtcctgttgaacaaaggaagacctgcgggacctgtccccttatcagaagtgatatggttctccccactagctcgagtagttgactttgtattgtagaaagaaagacttatgtatatagaattctctaagattctcccagaccactagccttcctgaaaaatgacttggattttgccgaagatcagtttttagacagtgaaagatatgagcatttgttaatttaattactgaagtgcgttatctcagtctgtcagaattatctcctaatttgagggacaaaagccaggtgggtcctggtcccttgtggaccctccagcactcagcatagcgcacagtggatggttgatgcctagtaagtgtctgttgagcagatcactgcttttatccagtgttagtcgccccagctgtcaggacaaatgaaatcatcagaaaatctctggtcacacataagagctgtctgtcagatttctgttttggttgtaaaagtttgggatacttttgcaaaattttggaaaatcaatttttgattcccaatcacatgatgaaagaaaacctaattgtagcttcttatgcttagaattcttattaaccataagaagaaagacatctgtttttcttatggtcaccagtctccctgcagaaattttattatgtctaaagtgttaagtggcacaaattgttgaatgcatatgcaatgtaatataaagaaccatttattttcataacttacaaggttgcaggtttgggtgtgcggacagagagcagaagggaaaacaaaataagtggtgatgtctatgcatttctatacaaaaaatacttgccttaagcactaaaaaatatactgcattattgcacagtctctcacaagccagtacttctaccactttcaaaataaagagcattatttttcactcgccgtccagagagaacatagcttctttgatattccctgctggttatttgaggaggcttcctgcagtgagtgtacggtattgctctctctggctgcccttgttactgcaaatgtcttgtctttaagctttattttctgtccttcactttgagtcctagtaaatcctctttaattcataagagcccttggttctcaaaaggaaatgtcttgttttttattctacgtctgggacaacagtaagatttttttaaaaagtttaacattttaatgcaaatatgggaatgacaaatatcttggaagagttgtgaaggattatatccacgtctatatttgcgaaccaaaatgtctttcgattttgatgtgtgcgtcctgcaatttactgaagcttatcaaaatacttttccacgcttttattaattgcactcacatttattctgctttatttctgtgcctcttatatgtagattaaacagatctgtgagtcttctcaatgcttgcaaactgaatagatcgacaccaaggtgaggggaacttagatttactttgtcaccatagctgttccttccattgtttccatctctgttttaacgtagtagcttcaaggtcttgtccagtgcctaccattcgtcaagtcatcaatcatgtaactatattaatcattgacatttattgtttttttagatgctcaactggtcctccaaaacagtatactttggcggttcataaattgcagatggtgttaattaggggcctaatagagagaacacagggttgaagtcaccagccccaccacttgctgtaaccccaaacaagttgcttcacactcctgaattcggttcttcatctgtaaaatgaggataatgatattgctgcaggggatttgtgaggtttgaattaagtaatacagtatatgtaaaagtccagagtatgccttaaacgttaactgtggctgctgctgctgcagttttcatcactggcacccccgtgaactcttccagccaccaggttgagtgttaattattagaaaatcagttagtgtttgctgtaattgatgaacagttgtggtttttcagctctttaagggtgttttatacagttctttaagttgctatgaacttgccatgaactcccacaaggacgccccagaagctgtgctctgggctcttcttgcggctgcagaatctcccagggccccggcagctggttgggcaaagtgtgcatcagagccttgtactaaagactgggcggagaataatcctgctaagtcaaattagcttggtgtttgtcgtcatgggaacatcttgaacttgaagcacaaaggctcctataatttttagactttaatcccaaatttcagaaatgtaatgctctcttaaaatctgtaatttccttgtccccaaattgagcattctaaaaacacacattttgaccttaaggcacaccctgcagattgcagttgtaagattctggcactgtccactcaagggttccccagttaacaaaaagactatgtggaaagtgtattcagataatcaccctgagagtgatttcaaagccagcataccatgagggtttttaaaaacctgcttggagattactaactgagccactggaagttgcaaaggaaggaagagtgaaagttgagctaaggagggtgtatagacagaggagacagagaggggaaggaaggaagagaggagagagtcactggctaccaaggagagtggccagccccaggcaggagctgcctggatgggaggcttgtcatttacttatgaggagggaggacgttgagcttcagtgcaggcgcaggggtcttgctgtgttaagttcctcagctcctgcgtgctccttgttgagatctggtccccgtgcacccttcactgaagctgtgcccactggcgccgcctgagactccccacttcccagggctcaccccctcctctgtgcagcaccagcacatttacctaatcctgcgctagcctttgcgcaccactccttctctcctggtgtcgctgctacctctgactcctgtggtagcttctcagcccacgtctttaaacattagtttccccagggctcttctgtccttggtcacctcctccctcggtgatttcctctgcatccgtggctcagcacccgccagatggatagagtctgtcctgagctgtctcgcgtgttgcaggcttgtattctcacccacccacacctccagctccaagtgtcaagactagagccacccaagtctgtgtgtgttcccagagccctggccctagaacagccccctgcctgcccctcccctcctccttttttgcttacagagcaggtgctgcattaaagcagtttgtgtctcttctggtgacagggtcagtgtgtgatacttccatttatttcatcctttcatttaataaatgtgtaccaaacttttgtataaggctctgcaaagctacgaaaatgataaatgagataagatctcaagaaatgcgtggactaatgatgtagatttttaagtatgtacagagatacctatactagagttatgtgctctgtcttagtgagtttgggttgctgtaacaaagtccatagactgggaagcttataaacagcagaaatatatgtctcaccatcctggaggctgggagtccgagaccaggggggccagcatggtcaggttctgatgagggctgtcttccaggttgcaggcggccatcttctcacatggtggaaaagggtaagagagctctctgggcctcttccataagggcactaattccactcatgagggcttcaccctgctgacctcatcacctcccaaaggccccaccccctaacaccatcacattgagggttagggtttccacacatgaatttggggaatacaaacagtccatagtgtgctctaagaggggaacaatcagcctccactccatacctgggctctggtttacccctcatgcctacgaatcccctgtgtataggggatcccttctcctagagcaggctctttccatctgtgtcataacaacacattcaagccattcatttgatctttcccggaatttcgcagtctttgggaagacttccccaggctgccttcccaggcctctgagcactctagtccctcttgtcctatgaatgaagttggccgcttaacatggacaccacctccaaacaaaggcattgtacacagggtggaacgtttctgtcgttactcgtgacgtcctgttagcatttgtcccacgcctgcctttaggccagatttcttcaacctcagcactatcgacgtctggggccaggtgctactttgtggagtgagccatcccgggccatgcaggatttctagccgcaccccgggcctccacccactacatggcagtagcagtccctccccagctgtggcaacagaaggatgtcgccagacattgccagatgtcttgggggcaccatccccccgggttgcacaccaccatctggaccaaggttgtccaacccatgggcccatgggccttgtgtggctcaggacagctttgaatgtggcccaacacagatttgtcaactttcttaatactctattttctttgcaattttttttttgtttaattcgtcggctatcgttagcattagtatattttatatgtggcccaagacaattcttcttccaatgtggcccagggaaaccaaaagattggacatccctggaaagtgaagcctactcaagggcaggattgcttccctggaagcccctggagtgctctcacacggtactgttgaagtcttaatgcctcagtttctccatgactgtgaactgtgctagtggcctcagttaaaaaggcagagagagagcagagatgttattctatgtgacactctgaaaagctttttgatctccgtcgctaggcctgtcttttgaatatccatgtggaagtatgacgttctatgtatatatttgtatgcttagcaataaaataaagtcacgatattaaggagttcactgtcacttccattccacccttagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaaggtaaggacgtcttatctctcagttcctgctgttcagatatgttagtacggcttgtccccagagaggagtcagaagatcccctcatattccaacaagctgggagtactcttggagaagaagaccttctcctcaggtatttataggactaatcaaacagccatttgagggcagctgccaggcacagttcacacaaactaccgtccaggtggaaaaactgtcactcagattcccagcactctcatgtagacataagtagttcctgagaatttcttagtaccaagtacctagaactggggaagccattctgaatttctacctgagcgccttcgatttctagtacactctcctgacctttttaagttcattttaatggactgctttaagtttgtcagcagtattttctgagacacagtggctgaaaagttgtaattttatgatttatcagaggctatgtttaatattgatgctaacaccagaaatgtgaaccatttttctttatggtttcatgaaatacgtggactccaaatttttgagtttttctatgaggttagtttgtaatggattatgataagtatcggtgaaactaatagtaacattttgttcctgaatgctgctttttggcattttagcagcttgttttgtgtctatataatatatttatatctatataatgtactttgtaaagaaaatccagtttctctgtgtatttttacctaacattgtactttgttctcactttttaaacattgtactttaattttattctctctgtttagtaaagctgaggaaggaatttcagcttcagaggctaagcatgtgttttttttcccaaatgttcatgtaaggagaaggcttagtcataaagcaatcgactccaacccacaggctataaaacttccaagtttgtaaatccatggtgattcagtcctataaaggaagcttaaactctttttcagttttattcctaaaagatgtctgttgtagaaaacatagagacacttctcacatctataacaggtcaggtccacggtctattaacaatttaaaaaaccattaacatgggttctgtcttcttctcatttagactattagtacttcttatcagaagattatgctaatggggtgataataccttggaaatgaggccaagtggttacagtggcaacagagtgtgaattagtgggaggtgcaacgtagcccaaagcttctttgaattcagggtaagcttggaagttgacctgaaatgtctagatcttggcagttcttagagacttggctcctcctctgcacatctgatttttattaagaatttccaaaaagaatctgcattgtgtaaactccagatccattttatctttaaaatcctatggctttggtaaatgtgctgggtaaatatttccatagaagatatttacaaagagatttttgagaaatgccacagtaggaaattttgatttggaaatgagggactgggaaaatttactaatcatgttcccaaactaattcaggcaactaaacatgtccatttaaaaataaattctttgtcttgttagaacccaggcgtggttgaggcgagcatagcacagagctggctgagtttcatgcatcatgcactgaaggggtttcagagacagttactgtctcctcttaggcaattgctggtcttgacagggacccataggagtaagagctgcagtaactcaaaagaagcagctaagactcggtagaagtgaaggttaagctggtaattcagtggctgcctgaccccttcccgcctttcttcctctgtattcccacgtgcgcagccccatgctcaggctgccttgaccccagcaccaaagcagatctggagtcttgctgagaaatgccaccctcgaggatgggacacagggaaggaaaggagtagggaggtggcccccatgtaatttctgtttttaaacattactgcgttcagtggactcaagatggcatgcctcgtccccatcgctcactcgacatgtccattgttcctacaggctgtcctgtgatttaaaaaattgcccttgttgggttcctgtaggcagcaagacatggtggaaagggcagaggctctgcagtaaaagaaagatctgggtgtgtatccagttctgccttaatgtctccaagcctcagttttttcctctacaaattagagattttatacctaatgcccttgaatcttataaatgagctaacttgtaggaaattatccagcgtagggcttggcactcagtaaatgatcgtcatccctgtgatagttcttataaagacaggcttgtgtggagcagaggaaagtaatcagtgagattttctacaattcctcactttttattttcctcatttgtaagatgaaagtgttagattttgtcacaatccgcgttgcacttgtgtctaacgtagttgggggaaataaagtattataaatccttgtgaagctcacagttcttaaataaggcatcgggcgggagctggtctgtgggctgcttgcgatcccagcctgcccgctgttccagagccccattctcttccactcaggaaggctagttagggtgcatgtgagtgagagtgctgacgtcatagggatggcttccaccctgtgctgctttgtagaagaagcaaatcattcacacaggcagtgctttaacttgcagccacaacagattattagccataaagctcacagcttctcacacgccatgtgcaaagctgtcgttagcacatatggcacttaggcgcaaattagaaaaaggctccctttacttcagaaaaacagttccatctcagcactatttctcaataataatacttacagcagatagaaaaccattctgtataaattatacaaatcttactattgaacacaaaataatagtgtttgtggagtcctaaatattaaccttttctgagatactttattttaaagtaattacctgttttgctttcataaaactatattctttttctttttcctttttttttttttgagatggagtctcgctctgtcaccaggctggagtgcagtggcacaatctcgggtcactgcagcctctgcctcttgggttcaagagattctcctgcctcagcctcccgagaagctgggactacaggtgcgtgccaccatgcccagctaagttttatatttttagtagagacggggtttcaccacattggccaggatggtctcgatctcttgaccttgtgatccgcccacctcggcctcccaaagtgctgggattacaggcgtgagccaccgcacctggccaaaactgtattctttatgatagtttcagtcttcttgctcccatgtctcattttctttacaaatggtcactggattcgagtctttcttgtgatatggaagacctttatcttagaatgtttaattttttcaaatactttgtaacaagccacaaaattttaacagcatttaatctttgcaccaacaaaacctctattaaaaacaaaagcaatatatggtagtattttactttatgtattattgatgataaatgaacgttaataattacatagtgattcatgtcatcatgaaatactacatttaaatagagaattggcaataacatcgtgatggaaggcttgtaaaatgtagccagtgaactaatctgatggagatatttttcaattaaaaaagtattttatacctgatagaaaattggctgcttatttagaagcacagttcatgttagatgttgctagattgataaagcatttcaattatcaaactggttccccttttgtaagtcttaagggaatgagctatgtcagctctataagcaagacactgtttcagctttactgaaagttgttgaaatgagttgattttgttagaataaggatgtttcagtcatgtgctagaaactttgttgtcacatatgtataaatcaggggtgtccctggacttcggcctccctggacttttggcttccccagattaaaagaattgtcttgggccacacacaaaatacacgaacaataatgatagctgatgagctaaaaaaaaaaaaaaaaagaaaaaagaaaattgccaaaaaaatctcatgtttaagaaagtttacaaatttgtgttgggccacattcaaagtcgtcctgggccgcatgtggcctgtgggctgtgggttggacaagtttgatataaactgcccatctttggagtcaacaaacatgaaaaaaaaaaaacccacctcaaaatagtgaagacgttggcatgttaggtgtggtgcccttttgtgttgtgccccctcaaccccgggatcagacagccccgtagtacagctgtcaggtcgagaaccactgggctggacaccttgagcgcctgtcctttctaaagctctagcatttggtgactatttcatctcagggctcttcagggcgcaaagttgtttttcctttacgatagcatcactgctgccgtcggctcaacagtactccttggctggggctccgggcccttcatccaccagctcctcattcccttttgtgccctgacacgcatgcctctccaacacattgcgcacttttccccagcacaacttttttccttttttgaggccatttatttattatacaagtaacttgttttagaaaatctaggccgggcgtggtggcccactcctgtaatcctagcacttcagcaggccgaagcgggtggatcacttgagcccaggaattcaagaccagcctggacaacatggcaagaccccatctctacaaaaaatacaaaaattagctgagcgtgttggcacatacctgtagtcccacctacttgagaggctgatgtgggaggattgctcgagcctgggaggctgagactacagtgagctgcgatcataccactgtactccggactgagcaatgggaatgagacccttcctcaaaaaaaaaaaaaaaaaaatctagatgcactaaaaagaagaaacaacaatcacctgcagtctcaccactcagcgaactcacagccaacagtcattacatttccacgtggacttttatttgcagggtgctgtatgagtgtagtgtataattttgacataaatgccattcttgtgcatattttgtgatcccttcttcatttgctaaatgagcatgtctttgtgtgaataaatgcactcttgcaatgttattttagatgtggttcatcatgtttccagcccgaagtacttcagttggacgtttaagtaccaaacaagtttcactaatccactcagaccaggccaccatctagaacaatgcccagcacacagtaggtgctcaacaagcattagtcgaatgaatctttttgccctgatcactataacaaaagaaggttaaaatgatgggcctttattgccacagccaagtgttaatcccagctctgctgctttgctttgtcattgtgaacaagtgacttaatctctttggggttttcctcagtagcagtaaaagtggtacctgcctcacagggtgcctaagatcccatgcataggagcctcagtgcagagctggtctgcggtcggctcgccacagtggcagctgtgagtgtcatgtctgcatcccagactgttggagttgaggcctgcacacttgtgtccctcccactcccctgcttgcagggctttttttcttggggatgtcttggaattccccagcgcctgtttctgcctttatcccagcctgaaaagcgaggaatcagaaattctgaaaattgttctcaccttgctctttcagtttcactgctgtgctggacttatggagcacctgctgtgtacagaacgtagtccaaggcatggcagggagtgggaaggagcagcacagaaagactcattctcctaacaaatgtcagtggcacaatgcctgcagggctgctttgcttaattcccaaaggactcacaaatgggagaacaagataatccacggaatagaaaaatggtaaagggtctgcacaggcgctcactgagaaggaaataccagtggcccttaactcatgaataggcaatcaagcccagacctaattaaagacatgccgatctaagtaagaagataacatatttagaaaattctttttactttactataaaataaagcacagatgcagaaaaccacacaagcaaattcgtagcttaatgaattgttctaaggcaaacaccttctagcacctaggaggaggaggggttttcccctctcccaagtgacaggtggatgtatctggaactgggggtgggggcagggaaggtgactgtttttgatgaactccagctcatccttcgagacccaactcaggatcccctttttctgggagcctcccctggctctctagtctgagagcagtgcttttcagatggtgtcgtaactgcctgttaactttatctgtgactctgtagctctcctcccttcaccatgctgcacacaccgcttgccctcccttaggctctggaggcccaggccgtgccattcttattctttgtatctctagtactttacacagcacttggtgaacatgagtgctcaataactatttgttgaatggatggaaggatattgtatacgatcaggcatcacttaatgacaggcacattctgagaaatgcattgttaggtgttttctcattgtgtgaacatcatggagtgtgtgtttacagaaaccttcatggtccagcctgatggtctagcctgctgctcctgggctacagacctgtacagcacatgactatagggaatactgcaggcagtggtaacacagtgttaaatattggtgtatctaaacatagaaaagataccataaaaatacagtattataattttgtgggaccacagacatctatgtggtccatcattgacagaaacacccgtgtctggcccatgactgcatttcatttgaaagccacagccattcaagaactatgtaaacagcaccacctatgggtagacaattttaacaccacattttacactggaagatgagacttaagcattttttactgaaaaaaatgtttcactcttcaagccatggggtcatttatgttttaataaatttcaaaatgataagtgctaatattcttcatattgttttagttttgagactgttagctgaggagtctggaaatacaaaggtttttgcagtgaaaggaggaggaagagggaagccatattaattaataacatgttggacgcattgtaacatatcttatttaatcgtgccaataacctgttcctcacagtggttgtattcccatttttagattaaggaggttaagctggtggaggtgaagcccctcacccaagccctagaacacggatccagctggcctcaaaatctgtgctccttccaccatgttaagctgggaagtattggttggaaatgtctatgaagcagtcgcttttgtcccaaataaagtctccagcaacttctaaacattttgaatagatggttcttaaatgaccctatttctaataaaaagctgcttaaggacaatttttgtagagtcattatttccatggtggagtattctgacttccagcaggaactttatttcatcacgtgaagtcatttttaaaagcagtcatgtggctgagcccagtggctcacacctggaatcccagcactttgggaggccaagacaggcagatcatttgaggccaggagtttgacaccagcctggacaacatggcggaaccctgtctctacaaaaaatctaaacattagccgagtttggtggcatatgcctgtagtcccagatacttgggaggctgaggtgagaggatggcttgagccaggaggtggaggttgccgtgagccgagatcacaccactgcacttcagcctgcgcgacagagccagaccctgtctcaaacaaaaagaagtcatgttattccaagagccaaagttgttctggattaataaattgtagggaaatcacatgtttaactttggaatggactcctcctctatcaagccttattaatcactttcaaaagcaagtatctctgctcaaacagcacgtggctcctattagttccactctgatcctagttgcccaggacttcttacacatgtcaccacgtgtcgaagacctgcaagatctggccccagagccccctttcaggaacatggggttaggttagttaatgtagatgaaagagataagagcagatccccgctctgaggtacagtgaatatctgttgagttgcagcctggacacgtcgtccactggactctcctccttataaatgccagtctatggtgcagcaaataggagctttatcagatgagtaaaaaccaaccactcttagaccatccctgtgcccaaagtccacagtgaacacattcagggatttggacttagacatacgtgttcacagctgcctctgcggtgttgaccgcactggtgtctgttggtgtgagcctcccagctcagactgcactgctgtctgttggttgactgcactgctgtctgttggtgtgagtttttccttggggcagatgtctagtgttctcctgccatctccccatacagctgctggtctggtgaagattcaaatgtacctcatcctccgttgagtctccacgactgcttatatcttatatcagctctcgaaccattcagctcaagggagcatacagccgagctctttcagcaaatctccttcttataagcaataagaactgcgctggagttcgtcttggagatattggccacaacttaacaccagaatagccaagcgctgagagtttgttcaccgggggggcaaatcctttctctcctccaggcttagttctgtcatgggcttcaggggcaggtgcaggacatcttgattgactccacactgggcaagggatgaatggagcctcattctgcagctggtgctccttcacccttcctaggacaggactgggcattctcccccgcaccccgccaccgccatggagccacaccccagctgctgaggggatgttaagtcacccacttaattttttccaccgagctcacatcaagaaatggggaatcagagatgaattacgtaacaccttgagaagcgatcatctcccactccaagtgaattcaccgcccaagcatgtttcaaaatagtgctgggtctgaaggacccactctcaatttgagtggctgtgcgttctggagagatgcactttctgcattcagctcccgtcaacagactttgttgagaggccacggtggcttcaatgttctcttctggttatcactgcacatctgtgtgtttgcctttctgtcagttgttcagaagatttgtcatcattttgtgggcttatatgccaagatttgcatgcaagagtgaaattacctcctcccaggcttgccttttagaaaaggtggtggtgcattggcaggagtaatgggttctaaacaaataagctgggtttttttcaataaaaactcaactttctaaaataataaaatgtagcagtagtatattttctaaatacagcataccacaaagtgatacattgtttagagcatgatttaaagaaatgtaagcattttagtaccacctgatacctcctctctcaatgaccttagttgttaacattcctgctacctaatctgttaatagaaatctttcattcttcctcttacagttcttcagtgtcgaaggtccacgagcttccctgtatgaagcgttcagattcccttgcggattttctctttgcaggaagaacatagttcataattgcttttttctgtctctagggcaagttctgaatttctcatttctgtgttcatagcttttgcatcattctacttttgtgatcaaagtcatgataaaaaaatagttttcttatcttttgattccatacctggcttccctttgattatgtttctgtaattagatttgcctcgtagtcttttgtcagctttccttctgtcctcacctccttctgcctgtaaatttaatcatatatgtgaaatttggagttaagatttcttctgcttctgcttagcacacagaaaatgacaagaatgtcacttccaccctaaaaatgagaacaattcaggtatctacagtatcatagctattttaaggccaccatggagctgaggacagaaagtagtataatgaactgaagtgttactgaaaagtggcaagcccatctgaggagggacaggccccacggctgcttttgtctctggcagagtggcggggagaaaaggggagccctcttagatgggagtaggaaatcacctggagctgtagaattgggaaaggctgagtgtggactggcaggagagttcagagtcctcaggggctctgggcacacgagaaccctccccccgctcagacgcactccgcttttccccagacttccgtgagtgtgcatggtggattgggagccggacaggcggctgagagagacccacggaggcagaggcatgccaggaggaaagccgagagacgttctccacgctcagggcctggaactaagtgccaggcagcagctggccacccccgaaggaaggatgaggaaagctgagagagagccctttgaggggtgggtgtgtagtgaggtctggggacctggaggatggagagaaactccatctgcacaccaagccccacaccaggttcttggcagcagctgtgtgtgccccggggagaggcaggattgctgagagccgaccccaccaccacccaccaggcacagatccttggggcctgctgaaggctgaagacggagaaccaagaggaattccacaggagctccaggcctcacaccagggcagccgctgtctattgtccaaggccctgggaatatagccatgaacagaaagatccctgcccctgtggaattgcctcctggtgggagaaacaaaatgaaggcagggggcaaataagtgctatagagaaaaataaagcaggaggggcgggggctgtggcgagcagggcgtgaggagggtttcagtatggagcagcgaacatgaatccgtacgcacggctacagcagtggcctgagagtggctgacttcggggaggatggtccaggagggcccatgagccaacgcctgacacggagcctgctgggccaggttcccagaacagcagggaatatagtgaagggagatgagctctgaagaatacaggggtcaggtgcagattggatagggccttgtaggccaatgtaagacccaggctttcaggttcaaaggctgtgccatggctttttagtagtattttcaatgaccatagtttagagtttaggaaactaagcctatagcttacaaaactacttaaaacacatttgaacagagtaaaacacttttaaagcatcaggaaagtagtaggctctaccaccccaccccatgtgctgcaggaaattatctggaaatcaagaatattaatatagaatattacttactacatcttgggattaaggatagtttttattcctggtgtttttcattgtgtttcaagtcaaaaattgaggaataatattaggaatatatctgctcaagtttttgttttaaatacacacacacacaaaatgcatatgtaatcctagcagcatttaaggcactatggtgccttatgggttcactatggtgaacccagtgcaccccttgactcccgtttatttcctgtgtcgtcttttgtatcttaaagcaggcagaagtcagggaagctaagcaatgcaaagcatgaactttggagtcaaagttgaggtcaaggggtcacccccctccctgagctcccttggtctccctgtccctgtctggaatggagacggtgccatctccccaaaggtggtgtcatgggaggggtgcccctggcagaaagtagtgggtctgcagtggcggccgcctctccttctgcccccagggtcccctcgtggaagtttctcctgtgaggtgcttgctcctagggatgtccagtctgcctgcggctgtctgtccttaaatgcttcctgggtttggtttcccaagtgctgtcatggggtggtctcacctgctcatggtgggtgcccagggtgactgaagtcagcaggggtgtccctacctctcccaagagatggctgagctggagggtaccacaccctggtgttccccccttctctttctattttatgttcacccacttgtcttccgagaacagccatctgcttaggaggtgagctctaaaaggcctcaccaaaagatcttttgtcaggaatttgctagttttaaataagttctttaaataatctgtcagaagagtgtagggaataaaaacaaccgtttttacacatttagacagggtcattcccttcttgattaatcacattttttcctccccgaaacacttacttgcagtcataaaaagcacaactttggtgataaagtgaggattgcaatctcttgcacctatgagattgtttatgattgtttatgtgtgttcctttttgcagtgaaattggtggtgtttttcttattaacgtgtataacttatgcagcatttgtgtggcagactactgcagccgtggctttggggtctgaagtgaatgagatgaaacacccacagcaccctttaaaaactgtttttcgtttattttcacagcaaacccaaggagcctgtattcagtgcaggtaagtctgatttaatttatgtatgggaacccctcactcactctctcagaactcaagggacagaaaagaagtagccagtttcaggggccagccttggacacacaggagctttggtttgtgcaggcccagatggagctttgtacctggaggttgaatggctcagatagtgacagcgagactgcctttaaacagtcataaagagcaaacccttcacctaccctctccaaaaccaacgtaagacatgccagtaaggaggagagtggaatgccaccacctatgccatgatggaatttctagattaaaaggtgtctgttgccttggttattccttccttactaactggattctgttatcaacatttgcatttctcttaggggaaagtttcttatgcatcaagttatataactgtctaaaagtagcttttctttttctgcctatgatctcctaaactgcaaactaatagttcatgtatatctttccatatatcttttttaacaccttttgtaataaggtagatgctgttgtctagcatcttaaccttatttagaaatgcatttaaaatgcaaaaaatggacaagtatgtaattgatgaaatacattcatttaattttaattgttctagttttttcttaagttcagaattaaaacataaaagtcaaagttgtgtatttatcagcatgtgctttagtgttcatttcattttcaggaagcatgaaattactcactgaaaatgtacttgctgtaagctcgcagggccacattgtgagcgcacttgtcaggatccctgaaccgtgtccagattttaagactggggggcaggtcaggtgttggcctgcgggctagtgagggctccgggctccggggcaggcaggccagccacacttgcagtactccaccgtctctttatctagcccttctgtctctgtctccgaaatcacaagggaaacgccgggtgacacactgcaaaggtaggcagcatttctgaaacctcatagctctctgagcaaagctgttacccaggctacagaaacctttttcatacaggcaaacagatgctctccttgtatgaaaatgtttttgtgttgcaaaccacttcgattcattttaagttaaacgcatccctgagcatttactcggatgggctttaataagtggctgtaatttggatcccaattggtattggctgactgcaggaatttttttttcatctatgtaaaccttaagagagctatagggccacccctggatgtcccactgtttgacttggtatcatgcactgctgctggcctcttcccactagcgcctttgggtttggtggcgtgtgtgctgttatcctaacctgcctggaacaaacactgctttccctggctgcattttgattttagatgtagcctgtctgaatcaccagtacaaaacagtgccaaggctgacttcagtgctttttttgcctagttcagtaagttaaaattctgcagtaagtaagctcagtcctaaggtttcttaatcatcacatacctgtgatagactcatgtggatatttcatagacattggttatatacatccacactctgcattttttatgtgttgtggaaatagcattatattgtctttattcctaacctacattctgcgagctttctggcaggactgattctcttacaaagagagttgctagaatcccttttcatttagctgtcaactccagtctcctgcccctcttttcaagaatgtcaatcgtttgggtgcttttagattctttggttgtggtagccacacagcccctgatgagcttatatttgggtgaggtttaaggaagggaagaagcttcagaagagaacagcatgagcggtggcacagacaggacagggtgtagaggggggcaaagagacacgcctggccccagaggagaatccctgtgggtggctgtggcagatgaggtcctgtgcggtgagagcctggcagggcatttagacctgctggatccagcaaggaagagagcaggtgaagaagtttacatggaggaagggctccgtaaaacctggtttgggccttggtgggtttggcagcagtgtgtaaactgacccaggagagccataagacagcctgtggtgatggggccccagtgcacctggggaagttggcaccagtgtgggagacattgtaaggggaggatccatgggacgcagtggctggcacacataggcagggatgatcgcgttcatgactctcactcaacgtcagccttaatacgcagtgtgaagagtgtgtcacgtgcatgcatttaagacctgaagcgcatacacacaataacatgaaactggggtgccctcttgatttttaagtaatactgcatgtggcattgtttgaaaatccttaagaataagacttataaaactaacttgtactataattatttcctaactgttcctcgccaatttcctccctgcggatgctttttctgttgagttgtgtacaggtatccctggttccaactgcccagtttaaataccattaaaaccaggtcctttgatctgcagtgaaatttcagaattcagcgagttctgaatctgaacagaattcaccaggagcggagctcacaagacattttctttgcccttatcatatcctgagaactccagtcagaacaccccaagatgttctttttgaggtctaggagttaccccgtgttgatacgttgttgatatttacttttgtccctatgatttattgaaatattaaaagttattttattatagaaatgttcgttctgaagagttttgcatcctgatttctctctctaatgggtcttttgttcttttgttttccatttctagattttctttgagcattttcctttctgcattgcatcctagcatgcacttctgctgattttgtgttctttacacttgaaagaattgttcaattaaaagatacataaagatatatttttacattgcaatataacaaatccatttaaatattgaaaaatatttgtgaatttggatattgagattgtgtatacattgaactcaaaaactttaagtggatttcttgtgttagttgaattttgggggtggtattttttcccctcctgatgataaaagaaagtaaacagtaaaatctcatggaaaatcattgttggaatcaagttccttcctgccttttacaatttcgtaggtatctcatgtacttaagtaaacagaatatcaaaagcaaacaagatgcaaacttttgtttcaaactgtttatttttatgttacttttttccctaggatatcaattagaatgacggaagggtaaaagtttctcttttatactgaaaggctagagaggataaagcatttgttttcaggtacgctgggcactgaggtatcttactgaaatctttgttctttttgtagaagaaggctatgtaaaaatgtttcttcgtggacgccctgttaccatgtacatgcccaaagatcaagtggattcttacagcttggaagcaaaagtagaacttccaaccaagagactcaagctggaatgggtgtatcctttattcattgattaggtctcacatgaagttatcagtcaatcaatgcttgatgttaactgtagaaattcataaaacttaagtcctcttaagcttttaaaaaacaaaatgttttactgttacttttgaaaacttaatgtaacaaaattgactatatgttagagacctacagagttctaacaaagtaggagcttcataagagcggtttattatcaggagaaccaacttatcattcctgaacgaaatagctgtggttctggctcaaatacatgttcattattttgctgaaaagaaaatatgaagatgttatatgattgtatgagtgatttttttctttgtcaggagaaaatgaatcactagtttctggtccgaattttattctttccaaaagaatgacaatagtagttagaaatatataaagaagtgaacagtgaaaataatcaagaatgggtagaattttagattctaatgagaactgatttttttttaagagatagtctctccctatgttgccccagctgttcttgagctcctggactcaagcaatctgctcgtctcagcttcccaaagtgctgggattataggcatgagccaccatgcccagccaaaagccaattatttttaacaggagctatcatatacttagtcaactcttcagggacagatggaaaactaggcactctctatatttataaggaaacaacagtgacaatgcaagaaaatattgtccttatgattgaggaaatgggagtatccaaaattgaaactaaaccacattggcaaaaaagtttttaaacccaaagaaagaggggtactctgaaaggaggactagcattctccccttaaaccaagtatggacttggccagccttaggagccaaacttcaagtgtgaccttgactgaagggatgatagaaaaatatgaataccaaagtactgaatgaagggagtcaagtgaatgacgtaaatgaaattgacatatcacgtagatatcatcctactttaaaaaaaaaaaaaaactagctacagggatgcatccctgtagtcccagctgttcaagaggcttagatggaaggatccaggagttcaagtccagcctgggtaacttggcaagtccctgtctcaaaaatacatatattcatatcaatcaaaaaggctccccaaaaatctaggccacaaaaatctgaatcaaccatataactaatgttcttgaaacagaggtgctggtagcttcatggcatgaggtttggaaaagtgagtttccaggggaaaaaacaactgaaagataagaaaatagaaactgtgaaaaaggtgaattaaatgttgattatttttccattttcttattactttagaggaatcctgcagagaccacctttcagtctatgcagattttaagggaaaaaaaaaattttttttcaccttcaaatatttgagtacctgtttaataccaagcctggaacacaaattataagatgttggtttaaatttaagctattgtgacttcatttagaataattactatttgagattatggaatcatattccttagaaattttttaaaattaccacctgtacctaaatttctcccccaaaatacttttttttttccagattcaaatgtcataggcatttacctgcacctgttttggaatctatcttgatacatgaaattgaagtgcttcagctcgtctttaagtcagtagtggtttattaaacggttatatcacatctggaaaacattattcaaaacatttattcagcctacttcctgttcatattttagaagatgtaaagcaatgaaatttgctctaaataaatggcatttttttggccattatttggcatcttgccaggttactttttacatccaagttgaagtgatattttgttctcaaaataaaataattttcaaggtttggaaatataatgcaaaaattttaacagggattcttatcccaaaggatctgaggggcctgatttttttttttttaccttttatgtatgcttgtgtgcatgtgtgtgtgtcatttgtaccctttgtaagtacttttaccatgtttaaaaaaggaattttttagtaaaaatttagctcgtagattacagtaaaaaaattaataattgactcaatagctttctaaaaataaaaccaaatcattgtgaaaatacgtattcacattacatcaatgactgtttcaactttactgcatgccttttgggggtcacatgtatttgtcatggaatatttgcaatttaatgttgtttaaattagtgatgctgatggtaatagttatatggtattttattgcctgtgcctgttgaataaagctgatgttttgtcagctcttaaagggaaaaaaaattttatcttgacatccacaaagctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtggtaagtcctgaaacaggtcattcctgcgactcagaaggcgaaggtaggaggatcgcttgaggccaggagttccagaccatcctgggcaacagtgaaaccctgtctctaaaataaataaataaataaatgtgattcctgttgcacaggtggaaatagcattagcagaacacggtcagtattgggacataactaaagagaaggaagagggtctgaggaaatgaggtctttgggagagctcttctgtgtggtctccttgtggtccgctcactactgcgctccgtgagacccctctcatgtttaattttccagcctcaccaacgcatgagcttcacggaccacattgtctcaacaaacagcgccacctctttggaggccttcttaacacatcatgtattaaaggcttctaatttgggtctttattttttgataaacataaaaatgtgttgcctcatgtttgtggctgagtcggctcttcccataattcatttatagcttttggtaggcatattacatatcttggaaggatggatgcgtgaagagatggatttatatatttgtatttgtcctggttccttggtcaatgataaaaatcctgttcacgaaagatggtatctttcctatttatgtactcaacatgactttttaataaagattgtagactaatgtagtggttctgagattgaaatggtattttcccagcagaggatgctttttccttcagtttgaaaattcttaagaagaaataagggaattaagatgaaatgaattaggtactagttgtctaacgtcgtggtgctcagagaatttgtcatgagtctgtaagaagttaggcattatatatttcttatatttaaatttttgactagattatatttgagcaagggaaaagtaaaacttacctgcaacatgtagatgttttgtaaatatccttttcttagcctagcagttcatcctgatcggatcacgatagcaacaggacaagttgcgggcacatcgaaggatggaaaagtgagttacgttaccttttcattgtttcataatgaactggtaacacaaagtaatttttagaaaacattgtgctgctgagtaaggctgcttagatataattatggtatctgaaaacttctgaacccctcactagaattttttattgtaaattagaagacttattgtgtggcagggtgcggtggctcacgcctgtaatcccagcactttgggatgccaaggcaggctggatctcttgaggtcagaagtttgagaccagcctagccaacatagtgaaacccgtctctaccaaaaatacaaaaattagccaggcgtggtgtcacatgaccgtagtcccagctactctggaggctgaagcaggagaatcacttgaacccgggaggcggaggttgcagtgagccaagatcatgccactgcactccatcctgggtgacagagagagactaagtctcaaaaaaaaaaaaaaaaatactgactgtgaccttaaaaatccctggagctcatcttaatttcatcagatttttaaatagcattgttctgaacaaagaattcgctaattcttaaaatgtttatttatatgataagtattaaaaatatgaaggtaaacatttaataaagttaaaattataataataatttgaatgtacaacattttgccaaatttcagccaccctctgccctgtcctgtgaatgtcgtttaacagtcgtgactttaacccatgaagtttgtgtctgtgtgcagtcacaaaagctactaggaggtttttagcacagattttgcaagcacttcagcaagactttaatttgcattttaaggcgttagagagggagcttgtagcttttttgatatctacttttatatagcttgttattgcataatattttatctgaaactaatttctttaagtacatacattttatcaacatgttttcatccagaaaaaatgaatactaccatatttcagaaaatattttagtaacattggattttaaatattaatcttatgctattttccattaatttttttttttttcttgagacagggtctcactctgtcacccaggctggaatgcagtggcacaatcacgggtcattgccacctctgcccccacaggctcaagtgatcctcccacctcagcctcctgagtagctgggagtacaggcacacgccacctcgcccggttaatttttgtatttttggtagagacagcgtttcaccacatcgcccaggctggtctcaaacttctgggctcaagcgatctgcccacctcagcctcccaaagtactgggattactggcgtgaaccactgcgcctgacctgcattaatattttatacttgaaaagagttaacagaaataatggaaatcagaccactattatgtaaataaatttacttaaattgaatgggtctttcaatttttttttttttaatgttaaatggctttgaaaaattctttgaaattagtggtaagctatttgttcctccctctagtggcttaaaagtatatttcagtttctggcattgaaattgaatcggtactttagaactagagaaaaatattatagttatctttcagtttacccatagagaaatccagagaggcctagtgaatgcccgcggacacccagctgcttagagattagactgaactagaacttggttcacctaacgcctgcctagtgtttctactaggtccaaggccagcaccttttcttactgataaatctactgattgctctatgatgttttcttctattaaggaagagaaaaattagcgtaaataacctaggaacacagttgagaggattttaaaccaattataacaattctaaatcttatttgtacataattgatgcctgttttgcccaagaatattaagctcttttttttttttttttttttttttgagacagagttttgctcttgttgcccaggctggagtgcagtagtgcaatcttggctcactgcaacctccacctcccgggttcaagcgatttcctgcctcagcctcccaagtagctgggattacaggcatgcactaccacgcccggctaattttttgtattttgtagagacagggtttcaccatgttggtcaggctggtctcgaactcctgacctcaggcgatccacctgcctcagcctcccaaagtgctgggattacaggcgtgagccaccacacctggtctgttaagctcttaatattatttggtggtgaccatcttatgaatttaggcatggtgacaccttagcaacaaaacagactttaaaagaataacccatatgtgagattccattttacttgtcatttttcatttctaaaattcagacacatttagatgcacaaattaaagtgtcagttcccatggtactattgtcaaaaattggccattcaaattctaaaacttggtagacctctccttactgttaaattatcaacaaggccctccacctcctgaagtcatcgggaatgttttatttacataaaaaggcagactcctgaaatgcagaaaaagatcttttgttttgacaaagtccgagttactgcccaagtaatcttgtagcttcaaggtaaagacacatgtgtatcaccatcacaattgatggctctgtgtttcttttctgaacagcaattgcccccacatgtgcgcatctgggattctgtgacattgaatactctccacgtcattggaataggtttttttgaccgagcagtcacctgtattgcattctcaaaatctgtaagtatgtgccctgtggatattgctgtcttcttccacaggaagtagagaatcaactcagggttgaagagggggagttgacacactcgatacctgcctgggtgtatgtacagatttggactctgaaacattcctgcttcccagaacccctcagtcagaggtcatatgcatgtctcatcagggacacacacttccttccaatcagacatctccagccacatgggtttggtgatgaaaacaggcccccagagatatcgtcctcactttccttaaggcagtttatgtgctctggccttgaatttcacctgcttctttcaagggtggctccagcgtgtctgtctctgccatcctgctactggaaaggggtcccgatccagaccccaagggagagttcttggatctcttgtaagaattcaaggcaagtccatagagtaaagtgaaagcaagtttattaggaaagtaaaacactaaaagaatgtctactctatagagcagccctgaggtctgctggttgcccatttttatgactatttcttgatgatatgctaaacaaggggtggattattcatgcctcccctttttagaccatatagggtaacttcctgatgctgccatggcatttgtaaactgtcatggtgctggtgggagtgtagcagtgaggacaaccagaggtcactcttgtcgccatcttggttttggcgggatttagccggcttctttactgcaagcggttatatcagcaaggtttttatgacctgtaccttgtgccaacctccatctcattctgtgacctagaatgcctaaccacctgggaatgcagcccagtaggtctcagcctcattttccccagcccctattcaagttgctctggttcaaatgcctctgacatttctcccctcccttttataagagaatccttaatcctaagggttgtaaagggacaaagatccatcttctgtaacttcttcgggctgaatagggatgatgatattcctgcctaactattagggtctcttgtatttggggtagagaagagctcagtcagaagacgtcagtatggcaaggtgatatctggaagattattaagtgttcaacttaagaaaacattgagtaagcttatcctgcattcctacacaaagagtgcaacagcaatatattccacaacagtaaaacaaaataaacaaaattatcccaagtaaactaagtaagaaggctttttattaactgggcaactattggaaccaagctgatatggggtcgctagctgattccagtgtgtccagaattggaatactgatccagatatttacattacccattgcttttatttcttctgagccgcagtcagagatcactggttggttcacaggaataagcagggttagtttaaatagcagaaaaaacttaaaaacgactgatgaaactagaatctaatgacaaatgtaccatagttcttgaaacataatttctgtctccagtctcccatttttactaaagacaaaccataacaggactgattagtttggaaaaataagccttagtcttgtatacttggcttgattatttgtataaagtgcagcaagaataattatttttcacataggctttttaaattggctttgatggaactctgttccataaggaatctcagataagaccttttttaaagccaagcccagccataggtttatattctcaaatacctatgggttgggtaaattcctctcctcttggggggtcccaagataacttggggctcctgggcctgtgagaaagtgacattctttacttaccacagatcaggaaccctgtacagggactgtggagacaaggtacaaggccagtttcccccaaggggcttctattgactctacaattcaatttgattccttaaaggaaagcatgccattcctgtgaaaaaaataaccagtttctccagttgtgtcctgttacaaacaaaaacaaattctttacaattatgcaattaactatattgccataaattaagaatactcacaaatagtttctaaattctggagagatcaggttgagagaaacaaatatgcttcaaattttgttcatagcagtatactttacttaattgttaaaagctctaaatagctcaaaagaaaagttttcttgtctttgaaaaaagcaaaggatcagcaacattttaagcaaagtcaaaaaagatgatttcaatcttctattagtttggttcatgcagttaactcctgttctgcttgatattcaggaacatttcagctccccatgagagtcctgaaagttttttcctctattctcatgttacaactttgaaagtaatcagaaacttgcattcaagagcacctgttaaaggcctatatctgattataagccgccttttaaataggaccaaaacaagacaagaattgtctgtggatgacagaaagtcttaggacagccacaattaaagccacaattgacaaggaaatttggttactcctggagcatacaataatttaacataacaagtacaactattaataacatacactaagtcatatcagaattataggagtttcacctaattttggaacacatgccagtaacatatttatacaaatacagcccaaagaaagccaatttcctatttgacaatgcttcctgtatgacttttataccaaataagccaaatttcacctttacattagtgtactattgatgttaaatattcttaacaaaatctcatagataaatctattcattttttttttttttttgagacagagtctcactctgtcacccaggctagagggcagtggcatgatttcagctcactgcaacctccacctcccgggttcaagcaattctcccacctcacctccctagaagctaggattacaggtgcacaccaccatgcccagccatttttttgtatttttagtagagacgggtttcactgtgttggccatgctgatctcgaactcctgacctcaagtgatccacccgcctcggcctcccaaagtgctggggttacaggtgtgagccatcgtgcctggccaatgtattcaattttaatcactgtgaccataaggtaagatttttataaaccttttattaatcctttacaatttgtgttgaaaagcagatcattgctcagagaaaaacctgttgtgcttttattccaatgtttaatttacagaaaaactgattaatacccctttaactttagccaatatgttcacacagaatttctttacaagattaatttctctcaaactttcgacaacttgcttaaactttgagctttattctatctaatttaaaacaataatttaaccttttaatctaggcaaaaaaaaatccacatttccatgccttcttataatctattaccaaaagacatttcactttctttatacaccttacatataaaacagtttttatttcccaaaaattacttaattcatgtgaactgaaaggcattacactttttacttttcttacaaaatatttgatttaagcttattattattattacaccaattaatcaaagctctttcatatataaacatcacacacataatacatgtaaatacacagacagaaaataaaggactcattccctaagccaggaattgaaccctgatcccaggctgccactgtgatggcagagaccaagataaagtactgccacgtgttacaaggtcaagctcccaagcacacgaaacaagataagagagaaactttatccagttttttttcaggaacctgccacaaaatttataactgaccagtttgctgtgctactttgaacagtgggcttatagggtcctaggcccacattctatcctatggtacccctctttatgacagaatgatatagaagacaaatttataacacaaagcacaacagattttctacagcttaagattaccctcacaaatccttttttcccattaatcaaaactttacaggagataaatagtgatttttaccattcattcagccagtttgcagagagagagagagagaaaggccagaagtctgactggtaagaaattcttaccattttgctggcatgccaggcttctgggttccctttccctgaggcggccctagtgatccagctggctgcaccacagccctaggggccaagccacatcataaaggaaaattatctttttctgtcctggccagagcaaaatatgtgtgacaaaacatagatattagccattcagctcagcacccagcacccaaaatcaaactggcagggctcagacatgcccctggtcggccccatcgttgttaatccagcctccaaccaggagcttcaacttacggtctctgggcaagatggtggccctgagtaatagaaaacataagaaagggaaaaaggagagagagaaaagcattccctgtggcagggcggggaaggtgaagagctcagggaggccagagaaagacctgcccactgcagtgacactgaaaagttcaggtggctgcctgttgataacgaagggatctttcccagcagtcccgtcagctcttaaatttccccttttggggaggaaaaagttccccatgtcccatgatcttgtacatgcctaattctgtcacccttagccatcagcaaagagtgcaaggcagataaacccaaagatgataatagcagttaacgtcccatagtgccaagcctgttcttagctgaaaaggactttactgagagggacctctaaccccctaaatcttaggaaggactctaaccttcctaagttgggcctggaacccaaggtctgtctagcgtccttgccttttattaagaggggcctttaacccactctgtcttaggagagactcctaagttaggcctctaacccaatcccatcctttgcccaggtgtgtgccccccccttacccaaaatcagccattcggtgtgtacagatgatttttctttgcatcaggggtctccagtatcatccctttggggttcaccagaaagatgttaccagaccccaccacttactaaagttagcctttggattggaggtttcctcagtattgtcccttctgtggtctccagaaagatgtcactggaccccaccacttacccaaagtcagcgtttgggttgggggtttcctcagtgtcatcgcttcatggtcaccagaaagatgtgatcataaaggggtcccaatccagaccccaaaagagggttcttggatctcacgcaagaaagaattctaggcgattccataaagtgaaagcaagttttttaggaaagtaaaggaatagaagaatggctactccatagacagagcagccccgagggctgctggttgcctatttccatggttatttcttgatgatatactaagtgagggatggattattgatgcctcccctttttagagcatatagggtaacttcctgacgttgccatgacatgtataaactgtcatggtgctggtgggagtgtagcagtgaggacaaccagaggtcactcttgttgccatcttggttttggtgggatttagccagcttctttactgcaagctgttttatcagcaagatctttataacctgtgtcttgtgccaacctcctatctcattctgtgacctagaatgcctaaccatctgggaatgcagcccagtaggtctcagccttattttacccatcccccattcaagatggagttgctctgattcaaatgcctctgacaatcccaacgtggctggcgggcagcctggctgcaagcaggggtcggacagggccttgtcatcttccaggcttcctcaggacgtgctggttcagcagacccaccctacactctttcaaaccatttcaaccacttcagaaacccatattcacacacatgtgcacgtgttcacatgaaaagacccccttgcactcaggcccccagagccgaggcattgtgcagccccacagcagccaccttcacagctgctaacagcccctgtgccatgcctgctgcaggcactgtctgctctaggaggggctcttgttttcatggaacccagtggtgaagagacaccccactggcccttctcttccccaattcctgtttcttcattccccatcatttacctgctctttctgtctggtcaagaaagcatgtctcagccaggcccagtggctcagccaggcacagtggctcacaccttctaaccagcactttaggagtctgaagtaggaggattgcttgagcccaggagtttgtgaccagcctgggcaacatagggagatcccatctctacaaataataataataaagagtagctgggagtggtggtacacacccgcggtcccagctacatgggaggctggggtaggaggattgcttgagcctgggaggtcaagggtgcagagagcaatgattgcaccactgcactgtgacctggatgacagagcaaaaccctgtctccagaaaaagaaagaaagaaagaaagcaggtctcaaaagcaatggatgagtattctttaactacaatgtagcagactctttattaaaaatgaaatttgatgtttatttttaatcatgttcaacccactttattctcagatatagtcttcctgtgaataactttcttttcagaatggaggaaccaatctctgtgctgtggatgactccaacgaccatgtgctctctgtatgggactggcagaaagaagaaaaactagcagatgtgaaggtcatgctccaagccttttttgggctgcattaacattttcccattcagagccgccctggcatagtggtagccccctttcagcgggctcattcccaccccagcccttgtgtatgacgccttcaccttagaatcgtttggccccgatccctgtcccatcatgggactttgaccccaggtcctgttagggttttttctcttttcgccatgtctgtaagattgttttcttcctcatttcatagccactacccttttaattcatccagtcatgtatttgctggctgttcctttcatttgcttggcacaccccgagtgcctgccacgtgctcgcacggcacgtggaggcccggaaatgtgctcaggcgtgaggtgggcttgctgcctgagcccctgcagccgcaggaagggcaggtatgggcaggggccgccagcacgggggctcctccaaagtggcacagactcaggaaagaccagcgggagccccgagctaaaccccaaatccttcccaacaggattcctcctgcgaggggccccttgggacttctttgaccgcctctaatccgttttgcacaatatgtcaaattcccttgccttgactgacctttttctatttctattttctattggaagcctatttttatagactcgaattcagatttctcatctttgcatctattaaccttagataaccttagtcacctaactttctctgctgcatgtctgcgaggcagaccttgtattctaaccaggtctgttccctgacacctgtgttcattccctagccccaccttctgatattctgggcaggtgtttaagttcttcttgctacgttgctaggttagaaggcatcagaggcaggttattatccaggctcaagaatgtgtaactgcattattaaatagaagcagtgatcagagcccaatccagtaggccagggtgcgggtcttggaggttagggtgtgggctgaaggtggcggaggtggcacctgaagtgctagatctactccatgggaccccaggccggttcactgagccacaggcagagtcccaggagtcaatcgcaggaggaactccctggggaaacgggcagccagagtcagccacgaacaatggacctttgtaaaatccattccagggccctccctggagatgacatttaccagatagggggtgaggcctagagatctgcattttaccatttctggtgattccatttgttcggccagactgggaacccatgactagcagatgagagcaaatgcttgcagttctgaagtccctctggtcccaactccctcctcagcaaagcatgctgcatgcccaccccatgcctggccctgggagaggccctggcatagacagaggactcctgggtgctccctgtcctcaagggctcattgtccagtgggggagacagacaaggaggaggtattaaggcccacaccagcatatgcttgatgtttttagcaagatggattcaatgggggaaataataggcattgtgcttgccttgaatttcttatttatttgtggctcacattttacttgttttcctacatgtctcttacgcgtcttaagagatgtgaggcatccgagtccctgtttttcctatagtgctctaatgaagctgtgtttgctgcggatttccaccccacggacaccaacatcatagttacttgtggaaaatcacatctctacttttggacactagaaggaagctcccttaataagaagcaaggattattcgaggtaaagttaaattatgatttttgctttatttttctctcgtatatgtgattggctagatgcatctctctgggggctctggtgatcaacacaatcccttgggatccctcacatagttgggaagcgtgtcacacctggtagataacgctggtaatgaagtgaagaaaaggacagagcaagcctgggtggagggcagggaaaggacctggacccagggagcaccaagcctcccacagtggcactggctgcagagagtatcagaagatgaagtcatcgggaggcaggcaacctgcctttgcaaaagacattagagactccctgtgccttttgtctggacgttgtggggctgcgagagcaccaggggacagcaccttttcccgggggtccatctgccaccacctccctgaggcttgtttcgaggacccctttattctggtgctcggaccctgccctttaggctgacagcatagccccacccttctccccggtcagtaccctcctccgcttgctgtctgcagctttatgattccccagccacttggggttgctagaaatcgctttgtcttagagcagttaatctcacagcagaagttatgtaatagtagacagaaatgcaaggtgtgcagggtggtcacagaagctgacactatccagcttgggaccactgcgaatctagatgttattagtacaaatgaaaggttgtctggaatatatatatgttgtatggattaaatatatatataatttttttactacattctacagaaacaagaaaagccaaagtttgtcctctgtgtgactttctctgaaaacggtgacaccattactggagattcaagtggcaacatcttagtatggggaaaaggtaataagtgattgttcccaaaaccaatggtttttggtaatgttgtaagagatcaaacatgagtgctttaagaattgtctattaatacaacgtacaggagtaggatgaaatttcaagttacagagacacacacatacatgtgtgcatgtgtaacttgaaaccacaaaactagaacagaggaaaagcggagaatagtaagagttactgaccttacagcattctgaaaggctctttaagcccaagctattatgatggaattaaatagctttattaggaaatcccctgacagattatgatgaaattaatgactacttataggtctgtaaaatatttaagttactatcctgatttatctagcatgtggcagacatttattgaaagctaattatgtgctagacactgtgaacatacaactgagtcagacccaaatcccctgctgtctgtgagcaaacagtttgctaagggagatgatgcatcactcagaaagcatgcgtccagttaagtccagtgagcatttatgagcacttaccccgtgacaagaaaaaagggaaaatccaccatcccttttctcaaggatcttagagtttgaattggggctgaaggtggagacggacttgtaaatgcaatttcagaagcattggtgacatttccagtatccctgctgctcttggctctaggtgtcttattcactgctcacttaatccttagaacaatcctgcagggtaagcagcagccccattccaccaagggggaactgagggtagagtaactaagcaatttgtccagagaaacagctcactagagagctgggatctaaactcagagcccacgttctcagccgcgtggtgcttcaaccatgcggcttcaacaatgcatattttccttcattctaaggtaacccatttcatgcttgtctggtgctctgcgaacgtctagaaattggatccttcatagattcatattgcaatgatgtgctcacggacaatattgcgttttaaaacctaagtcagatgagattagaaaatgggcagaggcaaccttttgacaatgtgctaatgatggttttcttggtgtgtttaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggaggtaagtcatcaaggctactgctaaaatttgtttttaaccttaaactgttatcctttttttattagtttgaaatctgtatcttacagttttgaaaattgtttaggtgaaatcacattatatgggagcaatgtattttattaaaatcctgaggcaggttaaatataactaataaaatagaattaggtttataaaacttgaggttgtaacacacttcatatttagaatatttttattctcaattttccaagggactgttacccacattttgatttattataaaaatctgtcttctcttttaactttttctttttctttttttctttctttctttttttttttagagcagggtctggctctcacccaggctggagtgcagtggtgtgatcacagtttactgcaacctccccctcctgggctcaagtgatcctcccacctcagcctcccaagtagctgcgactttagacacacaccaccacacctggctaatttttgtaattttgtagagatgttgcccaggctggtttggaactcctgagctcaagcgatcctcccacctcagcctcccaaagtgctggattacaagcatgagccaccacgcccagcctcttttaatttttaatttctagcatgttattttggagacattattgcattgagtgaactagtatttgttgagtatctacttcgtacatggccctcagctaagtgccaatgtgctccctagggctgtgactccttttgatacccggtgtacctccccattatctacttggcagccctgcattccggtaggcaccagaggcaagatatttaatattccttctgcccactcagtgaattttctcccccaggttccaggaaatcgtgagcagacactgcaaaattggcctcattctgaagggtgatgcttttcatccctagcttagaatggacagactttaggactttgaacccagatacacacaaaacacttatattttacatcagagagcaacatggcaccaccctctggcagtgtgaaaatttggttctgttgattatttcccttaataaaggaagatcttcatctgagctttggaaatcacttccccttgcctggagattctgttgtgagaacatttttaataataagatttgaccagcatttggttgaacatattgtgaattgctagagtcatagacatgcccaagtcatattataactgtaaagaaagctccaaagccccatctaatttcataaaagctattcactgtttgttagtatctgattcttcctcattagcatgggtcatcatcaacttgactcaaatctgtgctaacatgccacactggagaatgtgtgaggggaggctgcttctttcctggaacgggagagcctaacagcaaccgccagggtcaagctgcagcatttgttctttttatagtacaagaactttgtttcttcatcatagcaaattgttcttaatgggtgtattttgcaattctttctcttaacatttagattattccatatgtttatgtcgatttttaaactgaacagaatgacattgccaaagaacttaccattttaagttgtattatggcagtgttattattattattattattaattattattattttcagacagggtctggctctgtcacccaggctggagtgcagtggcgtgatcttcagcctctgcctcccaggctcaagtaattctcccacctcagcctcttgagtagctttccagctactacacgcaccaccatacccagctaattttttttgtatttttggtagaaatggagtcttgctatattgcccaggctggtctagaactcctgggctcaagcaatccacctacctcggccccccaaagtgctgggattacagatgtgagctaccacacctggcctatattctttactttctgaattgtatctactgttgctatcagaaattgtaaaaagtaaagagaaaactaaccagtagcattccttatttttaaattttgttgaggaaaatgctttttcttaacctcattcttgctgatgcttctaagatatataaaatgtttgtagtttaaaaataaggcttagggttttgatcactcactcaacagttggctgtggtatctgtttttttgagatggagtttcactcttgtcacccaggctggagtgtagtggcgtgatctcggctcactgcagcctccacctcctgggttcaagtgattctcctgcctcagcctcccaagtagctgggattacagccacccaccaccatgcccagctaatttttgtatttttagtagagacggggtttcatcatgttgcccaggctggtctccaactcctgacctcaggtgatccacctgcttcagcctcccaacgtgctgggattacaggcatgagccaccaagcctggccagctgtggtatctatgtgaaactctccatatatatgtatatacaacatatatatttgaacgtacattatatacatatgtgtatataaaactgttatagggactatcattatgataagtgttttgaatgactgagctaacaactgaatgaaattgtacatcttttcttttcatatgacttttcaatgcagattccagaacagtttggtccaatacggacagtggccgaggggaaaggcgatgtgatcttgattggcacaactcgaaactttgtcctgcagggcactctgtcaggggacttcacacccattactcaggtacgatcccactcagcaggcccggcaaacactctcattttgcattatatcagaccctaatcaagcattacaatcaggtgctttatactacgataaccttcctccaccccagagtgtctgtggctgctgaaagatgggaggagagaaactgttgagagcagttatgaagtcagcatgaagcctcggttcgtcatcccttacggctcctgagtgcgaactgtagtatctcagagcgcttctgtttgtcttggttatttgtagggtcacactgatgagctctggggactggccatccatgcctcaaaatctcagttcttgacctgtgggcatgacaagcatgccactctctgggacgctgtgggtcaccgtcccgtctgggacaaaataatagaggtaaacatgcacattacatttccatttttcttacagaaattcatctggaacatgtttatttattttttgcatgaaatcaacagtgatacaaagttgtcccaaagcaaatgttatttatctatttagagttgccttaacattgcaattgcatttaacagtgttacttttaacattgcctcgtggcctcagccatgtaattttgaagtttactgttgaaattttctgacaagaagttgttctttctgagttcattgtcagattttctgagtacagtctctcaaccatcctaagagctgaaaaatacttgttatgagcctgcattctatttacagtgtaccctttgaatgggaatttacaagctgtactaaacacacgattgaatatatctctacattttgagtttgatggtaaagtgaactttcgtttgaaagtcagctgggcacggtggctcatgcctgtaatcccagcactttgggaggccaaggcaggcagatcacctgaggttgggagctcgagaccagcctgaccaacatggagaaaccccgtctctactaaaaacacaaaattagccgggcatggtggtgcatgcctatactcccagctccttggaaggctgaggcaggagaattgcttgaacccggaaggtggaggttgcagtgagccaagatcacgccattgcactccagcctgggcaacaagagcaaaattctgtctcaaaaaaaaaaaaaaaaaaaaaagtcaacatctctgtgaattttgcaaaagaaactctgatgacctgtcagagtgttgaaatgccctttccccacgtgtattacttgagcactgactgtttgcatgccaagcactgtgcgtgtattatccttaatccctgtagcagctctgcaggttgaagaggttttttttttaactctgattttattgaataggaaattgaggtgtagagaagttaaataacttgccaaggtcactaagttagtgagtgacctagctagtgttagaacccagctcagtctgactcctaaactctggttctttccactgcattgcactgcagcgaatcggaagctcattctctgttgccggtgccctaatgatctgtgcaatcccattgcacagaggaaatagcccttctgtaaaccaacacatcatcctttcatcccccatagagttactggcatgtcccaggtgctaggttcaagttttggctcccttcccttcattttcacggaaggggtgctggtcactggtggccagctgagccgtgaggtggaagggcccaaggggcaggcactgccactcagagagcaggtgtggcccgtgatggcaggaaagggctaaagggaacagtgttatatgttctacctatgccctggtggtccaggagggctgaaggcaatgacagctcctttaccaggctgttaatcatttagcctaacataagggttggagctctaagctggaagccagggaactgcaatgaagttctagctcctctgcctactggccttgtgaccttggacatctgtaactcagtgtccacttctcaaaattgttacgaggcttagatgaatgacacagacagaagtgctttgtaaatggtaaagcttcaagtgaacacgatttctgtttgtgtattagtggcagctctgagcttaattacagctcccactgtagaaagaaagcattgaaataatgtaatcatatatcaagtttctttctcttggttttttagattatccagtggatctcagggcctcctattttcattcccattgctacttttcttcctgatcttccttaatctcttctctcttcatcctaaacactcctgccaagtgccctttatctaaaacacatgttcaatcatgtcactctttttattgaaaggacaagaccattcaaagtgttcttatttcctagtgatcaaagtccttaccatggcagtgacatcactaatgtgatatactctgtgctgtaagcccattgacctatctgccactcctcaaatatgcccacagctgtgttgcttccatcacttttactatattactgcccccttcaccatggtccaaaaaacgactggagtggccacatctcaccttcaccagtgataattcttcctctcctgggaggcccaagtccagtcgtctgtaccgcgaagccttggcccagcttcccagtgtcacctcatccctccctcccctgtgtatctctttcatggatctctttcatggatcattccatcttgtatccgagttagtgatgactgtgtgtgtgttccactggatcaaaacctagaacatgccttgctcatctcatgatccttccaggcctccatagtgttttgcacccagtgggcactcacccagtctccgtgtcatggagttgggtgccgtggttgtctttctggagcaatcaagcacactattcagtgagcttaccactcagcacggggagtcaactgaaggggctgggttctataagctgtgactttgtagaagggcatttacctgtctttcatcagattactgtagaaatgagaggatgtaagacaaaaagggaaaaatcctaaaaggacagaaatttaagtcaggctcaatggcttacacctataatcccagcactttgggaggcagagacaggaggatcacttgagcccaggaattcgagaccagcctgggcagcatagggagactccatctctacaaaattaaaaattaaaaaattagccaggtgtggtgacacacacctgtagtcccagctgcttcagaggctgagccaggagtgtcacttgtgctgcaataagtcatgatcatgccattgtactccagcctgtgcaatagagtgagatcctgcctcaaaaaagggtgggggtaggtagaaatttagcattattgaaacgcagcattcattcaagcaggaaaacatttttctctagaaaagagacttttcaaatagagccatatagccctaaggaattagaagtgtgagcgtttgtgtgtgcacgcactcacgtgtgtgtgttttatgctatagtgttctatctgttcatcaatttacacttcctttaaaatattttaggatccagctcagtcttctggttttcatccttcagggtctgtggttgcagtcggaacactcactgggaggtaagtccatgccaacagcgcttgtgcttgcaaagcttatggaaaagaggcctgttgtttctatttccccaggaacaggcccccgttcagctcttggctacatgttcgaagcttctaatgacttaccaagaattaagttaaaagcgaaacttgaaacagtggcccattacattttgagccttggggaatctgaggaaagccatagaccctctctcctggaaaaggaccctctacctccactagacacacacacactttttttgtttgttttttgagacaggtctctccttgtcacccagactgaagtgcagtggcacaatcacagcttactgcagcctccagggcttaagtgatcctcccacctcagcctcccaagtagctgggactacaggcatgcactgccatgctcaactaatattttatcttttgtagagacgcaggtctcactgtgttgcccaggctggtcttgagctctagctcaagcagtcctcccacctcggtctcccaaagtgctgagatcacaggcatgaggcaccacacccagccacacacacattttgcctacaatctcgaggatttgtggagcttctcaagccctgatcttgaggctgtgggagaagccttgattttggaatgaagcaagaaaacatttcaaagtgctgagcatttaaaaatgctttttctactcctggtcacagtggctcacacttgtaatcccaaccctttgagaggcctaggcaggaagatcgtttgaggctaggagttcgagaccagcctgggcaacacagcaagaccctatctctataaaaaatttaaaattgagctggatatggtggtccacatctgtattagctactcaggaggctaaggcagggggatctcttaagatcaggagttcgaggctgcatcgcactatgattgcaccactgtaccctcgcctaagccacacagcgagaccccatctctaaaaaaaattaaaaatagaaaataaatgctttttctagctgccctttcaaaatttcaggaactgcccagaccctgagcctcatattccaattgagttaatacctattcacctggcacctcctacacaccggatggtgggtctgcgtttgcagctcagctttgccacttagcagcagtgtctttgagccggttacataagctctctgaatttgtttctttttctgtaaattgtgatattccctgcctggctgtgttgcactgaggatcgaaggagacagtgcacacagcacctgccagggctgcccatcaggcactgcaggggttattattatcattgctttccaggttttgattgaacatttatgctgctcattgtactgtatacatttactgtggtttcagtcaaatatttttcctcccacccttcctctctaaaaaagcgtagcacttaaattctgttgctatgactgcagagcctatatggataaagaaagtgtagccctttgcaggtcataggtagcaatatcttaagtattgggctccatgtagccaacagaattcttcatgaaaacgtttgtatagccacacacacacatacgcatgcacacagacacacacacacacacacacacacacacacacacacactccacctcccatttgactctctttgagacaggtaaaccttctaactcatcaggctcccaccttctgatgactggcctcccaataggctgacggatgccagcatgcctactgtgtgtgtaggacacggtgacagtgctcagaatcacagtgtcccatggtggaggagatggatcgggtcacctaatccagcccctcatctgtacctcttgccattcaggtcctaggttaggcttagctcccgatgctgttgatttaacaggtcacttcaaagccatgttctaatcagccccagcctttattaaggttaaatagcacattaaaggtaaatggttgttgaagatgcaagaaattggcactgaaaagcaaaatccacatttctggggggcaggacatctgacagtgcctggctaggggggctcctgtggaagacaagggacactcactctgcgtcagtggacatgctgatgggatgtcctcaggcaggttagaaactgcagcaacagtttatccatttatccttatccatttatccatttatcctgaaaacaccaggggctcaccaccaccccttgagaatataacaggcaggagagttcagtcattctgatgttaacactcatttagtgggtactgtgtgcttatcagaggatacaaagcacttccatgtccattatcattcgactttaatattgagcctgcagagtagacctgggctcttctccccatctcaccactgaggaaatggcccagcgaggtgaaattagaagaccagtcctccactccgatttctcccatttgctctgtgctttccctcgccctgttggttgcaggctagcatccccataaggcctgtactcttggcctgctctgtctgcagcaccattgggaacaccaccaccccggagttgtcccagccccatcctcctgcatggtcctgcttcgccctggaaacctgggtgagctcttgcaggtggtccttcactgcttcctctcaccatatgccctggcactaggtattggcatcttccctgcccagagctttctctccatgtgtaaatgacaaagcacaaacacagagaaaccatgtcatagtgttgataatggcatagttttgaatgctagccaatatgctgttcctttcattagaaaatgcttatatataggaaattttctttgaatgaaagctgggaacaagctttcttattaagcaaattctgagtatttattaagcttttatgattaacaatttttattcatcccactattatataatcttcattttcttattaaacaacttactgtgctttttctcatgttgataacaggtggtttgtgtttgacacagaaacaaaagacttggtcaccgttcacacagatggaaacgaacagctctctgtaatgcgatactcaccaggttagactccaaaccattcactactttattttttttaatcaacttttattttaagttctggagtccatgtgcaggatgtgtcggtttgttacataggtaaacgtgtgccatggtggtttaacgcacagatcaacccatcacccacgtattaagcccagcacccattagctgttgttcctgatgctctccctccccctcgcccccctccaacaggccccagtgtgtcttgttccccgcccagtgtgtccatgtgttctcatcattcagctcccacttataagtgagcccatgcggtatttggttttctgttcctacattggtatgctgaggataacagcttccagctccatccatatccccacaaaggacatggtcttgttcctttttatggctgcatattattccatggtgtatatataccacattttcttcatccagtctactattgatgggcatttgggttgattctgtgtctttgctattgtattcactactttaaaatcccaacagaattgagattctgtgtcagtgtctttaaagaaaaaatttcacaagcctcctcagagtaaaatttaaattagacatgcacataattatggcatttagggttcttttccctcctttgggtcactgtgcttgtgttatggaaaatttcaaacatagacaaaattaaacagaatggaataatgaaccccatgtactcatccgccagcttcaatgatgatcagctctcagccagtttcctgcgtctggagccccacccaccacccgcctcccatattctgaagcagttcccagacatctcatcatttcatctgttaataattgtatatatcccaaaaagatgaggactctttttaacagctttattgaggagtaatttacatacaataatgaaccattataaatgtacagctcatcgattctttataagcttgtggagctatgcaacaaccatcactacagtccagttttttaaccttttcatcatccaaaaagtttcctccatgcccattagcagttcacttccaccctcacccccagtccgaggaaactactgatctgttttctgtttccaaaaattgctttttctggacatatcgtgtaaatggattcctacaatatgtagttggttgcatctgacttcattcacgtagaatgatgtttttgagattaatccatgttactgtgcacagagcagtactatattccttctaattgctgggtagttttccattttatggatatataccacatcttgtttatccatgcatcagttaatgatggattttttttttttgagacagagcctcactgcaacctctgcctcccaggttcaagcgattcttctgcctcagcctcccgagtagctgggattacaggtgcatgccaccacacctggctaatttttgtatttttagtagtgatgggatttcgccatattggccaggctggtctcaaactcctgacctcaggtgatccacccacctcggcctcccaaagtgctgggtttacaggcgtgagccaccgcaccctggccttatggatttagattgtttctggttttttattattattaataatgctatgaacattcatgtatatgcctttttgtgtttgttttcatttctcgggtaaattcttaggagtgaaattgacggattgtatggtaaacttatgtttaacattttatgaaactgccagactgcctgtcctattttacattctcgtcagccatgtgctagggttctagtatcatcacatcctcccaatacttgttattgtccttttgattatagtcattctaaagagggtgtaatggcatctcattgtggttttaattggtgtttccctaatgactattgatattgagcattttttaatgtgcatattagtcattccaatatcttctttggtgaaatatctattcagatattttgccaatttttaattgggctgtttgtcttactgttgagtagtaagtcctctttatatattccgtatatacagtctttatcagatagatgatttgcaaatattttttctgaatgtatggcttatctttttttctgtttgtttgtttttgagacagcatctcactctgtcacccaggctggagtgcactggcatgatcatggctcattgcagccttgacctcaggtccaagcaatcctctcacctcagcctcccaagtagctgggaacacaggcacacaccaccacgtctggctaatttttgtatttttgttagagacagggtttcgccatgttgcccaggctggtcttgaactcctgggcccaagtgatctgcctgcctcggcctcccaaaactgctgggattataggtgtgagccaccatgcccagccttcattttcttaatggggttttttaaagcacaaaagctttcaattctgatgaagttcagtttatcagtttttccttttgtggatcatgcctttggggtcgtatccaagatcatgaatatttccttgtatgctttcttttagaagagttgttttagcccttgcattcgagtctatgatccatttgagttaattacacaagagttacaagagtacactagacttgtttcttgtggatggtgagaaggaagagcctgtttgctctgcatagaggtatctagttgtcccaagcactttttgttgaaaacacagtctttccctgttgaattatcaatgacacttttgtcaaaaatcaatcgatcaaaaatgtaaaggtttatttccagatactcagttctgccccttcacctgtgtttatccccgattactgtgaccctagaggaaattttcaaattgagtagtgtcactgctgcaaatttgttgtttttttcaaaatagtgttggctattttaggttcctactatatgtaaaattgtatataaattttaggatcagcttgtctttttttattattttgttttttgaaatttttttgtagacacagggtcttactttgtggcccaggccggtctcaaacgcctggtctccagagatcgtctcacttcggcctcccaaagtgttgggattacaggtgtgaggcaccacactaggccagctcgtcaatttctaactttgaaaagcctgttaggattgtaagagggattatgtttaatttacagatcaatatgggggaaattgccacctggacaatagtggctcttatcatgagcaaagactgtctctccatttatttaggtctttactttttctcagcaatgctttatagttgtaggtgtacaagtcttgcacttcctttgttaaatttattccaaaataagtgttttttttatgccattgtgaatggaattgttttctgaattttgttttcagttggttggctgctagtatgtaaaaataggattgaattttgcacgtagatcttatatcctatgacctttctaaacttctttgattagttttagtataatagtccctcccaatccacaggggctaccttccaagaccccacacaggtgcctgaaactatggataacaacaaatgctaagtgtactatgtttcttcctatatatacttgcctatggcaaagttaaatgtataaatcaggtacagtaagagattaatgacaataataataaagtagaacaatataacaatatattgtaataagagttatgtgaatatggtttctctttcagaatactgtattatacgtaatatttgcagaccacaattgaccacaggttactgaaaccacagaaagttgtttcagtcttattatattatattaatatcactacattttattaagtttcttctgtttttctgaggagaaaaagcattcagtctttcatcatgagggataaagatgccctttatcatagtgagaaagttcccttctatttctaatttgtttggaggttttagcatgaatggggttggagtttatcagatgctttttctgcatctgttgggattattatgtgggtttcatccttcatcttattttattaatatcactacattttattaattttcagatgttgaaccaacttcacattcctgtggtaaattccccttaatcatggtgtataatcccttttacatgtgtttgctaggattctattaaggatttttgcctccatgtttctaacagatattggtgtatagttttcttttcttgtggcatctttgtctgtctcagttatgagagtactaccggccttacagagcaaattaggaagtgttctctcctctgttttctgaaagagtttgtgaaaagttggtgttatattaaatatttgacagaatgtatgtgaatttggtgaaactacctgggcctttctttgtgggaaggtttttaattactaattcaatttctttacttcttacaagtctattcagatttcttttttcttttttttttttttttgctctgtcacctgggctggtgtacactagcacaaacacggcacactgcagccctgacctcctgggttcaagtgattctgccacctcagcctccaagtagctgggactgcaggcaggcaccaccacacccagctaattttttttagagacagggtattcctatgtctctaaactgaaactcctgggctcaagcagtcttcctgcctcagcctcccaaagtgggattacaggcaggagccaccaaatttctcttttcaactctatttttgcttcatgtagtttgaatgaatgattgggcagaggttatgcacaaataacttaagccagtaaggctccgtcctctgccagtggctctgtgggcaggttgaagggcatgttcaaagttcaggccgtttccatgtcggcctggcttttactttccactcacccttttacatctcctctatgcacatgtacagattcagattggccggaagggtgtctgaataggcaggatcctttcctgcctccactgtgcatgcaccagcctcccgtcagccaggaatgcgctcacccatccaataaccgtaacctcaagccagtagaaaccttggccctccccacccaactgccctagagatggtcacttccatcccagtgctactattgcccagggctccatatggagtgagcccttttaccacagccgcgtggtcctcagagcctgttcttccctgccaggaccgctgtgctggcccagctgctgcgaaggagtgagggcagcccagggaagaacatgatggattcaccctgtttttacctgaagttgagaagattttcaaataaacaacacttctcagattttcatgtcttgttcaatttacagagtctggaaatggttgtttttgtcagttttatagaatttcataattgctttatggggagaggattggccaaccttctcatttggccacagctagaagaactgccctcttattttttgtgttttttggggttttttttttctttttttgagatggagtcttgcactgttgttcaggctggagtgcagtggcatgatttcagctcactgtaacctctgcctcccagattcaagcaattctcctgcctcggcctcctgagtagctggaactacaggcttacgccaccacacctggctaatttttgtatttttagtagagacagggttttgccagattggccaggctggtctcaagctcctagcctcaagtgatctgcccgcctcggcctcccaaagtgctgcgattataggcataagccaccgcccctggcagctcttattttttttaatgactgctttttattgttagagatgaggtcttgctatgttgcaggctggagtgcagtgggtactcacaggtgtgatcacagtacactacagcctcagccccttgaataggtgggactacaggcgtgtgccactgcacccagctctgcctttttttttttttagacagagcctcactctgtcacccaggttggagtgcagtggcgtgatctcagctcactgcaacctctatccctcaagctcaagcaatcctcccacctcagcctcccgagtagctgggactacaggcatgcaccaccatacctggctaattttttgtatttttagtagagatgaggttttgccatgttgcccaggctggtcttgaactcctgagctcaagcaattcacccctgcccttggccttccaaagtgctgggattacaggcgtgagccacagcacagacctgccctcttatttttaatataaccacagtatcgttgtctcctccccaacccaaatcagcattgatgtcttaatatcatcagatggccagttacatgttccagttttcaatttacttttttttaacaatttgtttaaaccaggaagcaaaaaaaagcccacacaatggtaattggttgatatgacttactagtttctgttaatccataggtgttctctctctccctctattacagtaaatttgttgatgaaactggctcgtttgtcctgtagcattttccacactggattttgctgaatgcatctttgtggtgttgtcttcacgtgttcctctgtcccctgtatttcccataaagtgattgctggatatcgaggcttggtcatattcaagctgtatatgtgttgctgtatttttcctttaggaggcacataatgggtttttctcactttttgtgacattagtagctgttgttacccagtgcctagatccataaaggttgccaactattgatttccaatgttagcttttcttcttcatttattagatatagtacttctatgaagaaaaactttccttcatctacaattttggtacccagtggtagagttcatataggaaagtcagaattaatgcttgatttcattcactttattttccagtttctgagataatacatttgctttctgctcctctaacagtcaccgatcagtggtggtgatagtagtggtggtggtagtggtggtggtattggtggtggggggggtgggggggtggtggtggtggtggtattggtggtggtgatggtggtggtggtagtggtagtagtggtggcggtggtggtggtggtggtggtggtggtggtggtggtattggtggtggtggtgatggtggtgatggtggtggtggtggaggtggtggtggtggtgatggtggtggtggtggtgatggtggtggtggtggaggtggtggtggtggtggtggtggtggtggtggtggtgatggtgatggtggtggtggtggtggtggtggtggtggtgatggtgatggtggtggtggtggaggtggtggtggtggtggaggtggtggtggtggtggtggtggtggtggtggtgatggtggtggtggtggaggtggtggtggtggtggtggtggtggtggtggtgatggtgatggtggtggtggtggtggtggtggtggtggtgggtagtggtgtagttttggtgccattatggattgaagtttatttgctgtgttcctgtctgttatattaggtggaagttactctagttggctcctgggtccttttgacgtgacctcaggagcctttagtacttgttctctggcataacaagttgttccaggatccttgtatacatttcttacctatagccctttctctcaggaggccctccttcctttttcatctgaagggaggagatcacaatatgggtgttaggagtgcttgttgccacagggtaggggattgtcttgccttttcattatatgattatgttgtgggaaatactgtttctttcatgcacaggccatttggctatgctgacactcttggaaactggagttttggttctgggaaatacgtggctgactctgagctgctggtctctgtagggatcttctattttataaccttattgacagcgtcaactctgcctcacagtgggacgtgtcctcgagctttagaagatctgatagagcatctcttttggatgttttttcgttgtctctgaaccacgttcataacttctcaccctaaacagacaactgctcagcccccttggcagccttttgtccatgttgagaaggagcttgacttggaatgcctttcattcataacctcctcagtatcacatttctttctgttaatttagccagtgttctgcatcttatcttgtgtttctcaccattttctcagttattttgaacgtctgctgaaggcacgagggcctcatctgcagcctctttcctagaaagccatctgatacctgtcagcgcctgctaacttgagcaggtccattgggaaacatgtttctatttcttgtcagttacactaatgaccattccctggagagcagagagctcttcctactagaactctgcctctcagcttcagagtcattgcctgggagctgtgtggggcaaaagtgaaagccctaagccagggccgggccaaccgcatttgaatctagtgttctcccttagttagccaggtgaccttttcagagcagacagtgagttaccatgaggcccaactgaaagaagtgtgaatgagttctctgcagagcattgtgcagatgtcacaggggatgtgatatcatcatcagtaacagcagcagtgatggcccctggaacagcacccagatggtggactcagacccctggggagtgacccacagttccatgatgggagggaccctattttgttcagcactgtgtgcccagctagctcctagcatagggtttatgacgggttagttgcatgcgtgaatgtagctataactaactacagtgcaacagacacaaagcaaaatgtgatcagcagtatgagttttctggttacacaagatttttccagcatataggctatactgttgtggattactatctcatttttggatttaagtatttacagacctaagactaaagagagagagagagaaagcattcgatgcccaaacacagattgtcattgacatggaatttcagaaacctgctgccaagatcccggccgagatctgtagcccatctccaaggtagcagcaccctgcgctgccatgtgctaagaagggaaaccatgatgaaatgatgagggctttttctcattccgtcagtctcaggaaagctatgagggttctgctgatggccagaggaaaagctagtagcggttcttgagctttataggtggagctggccctcctgggccttcccaggatgtgggaaggaccaacgagcccccagccagaggccccctgcccaaagataaatgccaccttcacactcagtgaggcaggtggacactgaccctttgccacagactggggttgtggagaggagctttaggaggaactggggctattttgcgaatcaaggttcaaggttgatgttaactgtgcaggggtgcgggtctgaggggttacctcataaactggacagtcgaaactttagcagcagttgagaactaaatgtttctggcaatttctcgcttctcgcacaacaggcaggcccaggtttcagttgttggtctatacctcaccgtgggtggaagagggaggttcagaaagtcagcactggaactctgggcacacgcctggaacgcaaccacgaagccaagccctccaggagtgcatgtggatcacccagagcgggtgggggttctttggcatgctcagagccatgagcctagagaatttccatggaccattgaatacccatctcaggcatgttttagcaactgtcatttatggactattttatataacatggtcttttgctgataaactaatgttacgtgaaagtttatcacaaccagtcagctaagtgttggcaaaatgccagctccctcaggcttattaaatacagaagcttcatagtgataattctcatatttaacatgcatgtcgagaatcttatagagcactttatgattggacaggatggagttttgattgaattaagattgtacttttttaaagaacagaaataggaagaaaataacttcctatttattaagcccaactgcagatccttagcctgcctgttctagtttcagctcattgaacctagggtaaaaatctgaatgtgaagatgaaagagagaagcccagaaaggactaggtgcaactggtcatgcaattgtgtttctcttctttgatcttatccatgtcattgtttgaaaggtggggctttttctgcttttactagaatgaatcagaatctggcacttactccgtcacttgcagtattagatcccccatctgcctgggtctgagccctgtgctgatgcaacccctgccacccagccaaccctttcccctgtcatgtggcattccccctccctgggttgatccccatgcagatgcagcagtcttgtctccaagcccaaaattacaatcagtgtgccaggagagaggctacaccatagctgcacggctgttcctacacctgcagaccatcttcgctgccaccccctccctccccaccccagatctcacttgtcagcttacaggtactttgcaagcatgcaaggatttctgtctgtgccactcacctggctgtgttgctgtacacaaattactaagcctcagtttcctcatctgcagagcaagtctaattgaaccctctgctgaggcgctgttgggcttgactgaagcccccagcctccagcctggtgaagagtgagcaatcagtagaaaacagccgtaaggttgtccttctgccctgagcacctggactcttgctcccgtggctttatgagttctccagctgattttcattttgggccaaatcctagcttatttcagtggagtaagtttaggaatctcagtctccgagagagctggggaatgaggcttagagagtttttggaggagaggagaacaattagggaaagaaaaagggctctgtgggacccaagaaacaggctgtgctaggtttcttctggcctctggttagcatattgacaaacgctggttggttttgatttcttaggcaattgtttttatatatttatggatgaatgtaggtaaaagagctaggatttgaacccaggtttttctgcctcgaaggccacattctaatcctcacactctgccgtcttgccgggcagtcgtcgcggtcaacgggagagtcattttgaggtttttcgtggtggttatgtcgggggccaggggctgggaggcacctcctctgaggaagggaacgtttctcctggttctgcctttgtctctgagccactgcctgcatttccacatcacgcactggtgggtgcgtgctaaggacgtggaaacctgggtggggtggggtggtcagagttgtttacaaggaagattagggcctcctgggccatcttttcgtgcctgtgcagaggcctggggttgtggatggtacgatcagccggttcccctctgcagggaggacttccccaggcagaggtgagcttcaactcctgcatgaagaccgtggattagaataggaaaaaggaattacaatctgattaagcctgtcagagatagaagtggattgctgagagagattgtgaagtcctgtttcattcatctttaaaaacagatatgggggccgggcgcggtggctcacatctgtaatcccagcactttgggaggccgaggcaagtggattacctgaggtcaggagtttgagaccagcctagcctacatggtgaaacccatctctactaaaaatacgaaataattagccagacgcggtggcaggcgcctgtaatcccagctatctggaaggctgaggcaggagaatcgcttgaactcaggaggcagaggggcagatgttgcagtgagctgagattgcaccattgcactccagcctgggcaacagagcaagactccatcttaaaaaaaaaaaaaaaaagatatggcgatggtgattatgcaggtgtagttgtcaaaactcctcgaaccatgcacttgaaatgtgtgcattttactgcccgaaaattgtgggatgatgttgtaacatgacttttttccttaaatagccaattgcgttaaacctgtttgttaaataacaaatagttccattatggccgggcacagtggctcacacctgtaatcccagcactttgggaggccaaggatgttttgcttgagcacaggagttcgagaccagcttgggcaacatagtgagacccccgtctcaacaaaaaaataaaaaaattagctgggcatagtagcgcacatctgtagtcccagctactcgggagaccatggcaggagtcgaggaggtcaaggctgtagtaagctgggattgtactactgcacttcagcctgggtgacacagcgagaccccatcccaagaaacaaaacaaaactaatggttccattatgaaagacacctcattatgttttgagttcacaaatgatcaggtagttcttttttttgagatggcgtgtcgctctgtcgcccaggctagagtgcagtggcgcaatctcggctcactgcaacctctgcctcccgagttcaagtgattctccagccttaccctcccgagtagctggggctacaggtgtgtgccactgcctccagctaatttttgtatttttagtagagacagggtttcaccatgttggccaggctggtctcaaactcctgatctcaggtgatctgcccacctcagccttccaaagtgctgggattagaagcgtgagccactgcacctggcctgatggggtagttccttgagaccttttgcataagagtggacagccaatcccctgccgtgtcatgtgacagattttcagctgttctttaccctaaagctggtcggaggggcagtgcccctggagtcagattgcctgggtttcagccagtttcaggaaacctgtgtgaccttggatgagttagtttattgtacacgcctcactgtcctctcttgaaaaatggggataattatatctacttcacgaggttgttacgaagatacgaaaattaaataagttaacacaggaagagtttagaattggacctagcacatagtaggctctcaaacatattggccaggccgggcacggtggctcacgcctgtaatcccagcacttcggggaggccaaggcgggtggatcacctgaggtcaggagatcgagaccatcctggccaacatggtaaaaccccgtctctactaaaaatacaaaaattagccaggcgcagtggcatgtgcctgtaatcccagctacttgggaggctgaggcaggagaatcacttgaactcaggaggtggaggttgcagtgagccgagatcgtgccattacactccagcctgatcaacaagagtgaaactccgtctcaaaaaaaaacatattgtccatttaataattgtaattggtatcattaagtggccattgttagtagcattttgtgtttattgcggtcatcgtcactgttgctgtccaggcatggccagttgcaggcattgagtgcagagacggttggtttctggcgtggtcacctggccttctcaagcctcatcagcagccgatgacagcctgtctccggcttcagcagtccttttgtttttctcagcaaaaaatatgtatttgccccattccttcagaattcttgatttggacaggctgccttggtcttacatcgcccctattttgtcctggcctaggccaacacttcctaaaataccattccctgaggcgccaggccaccctgggtcctgcaggattcctgcctggcagaaggaaaatcacaggaaagaaggaggggagaaacaacccttacctgatgctttacgcgcctgtgagcgcaaggccctgtacaaatattgtccaagtggagcctcccgactgctatgaaaatgcgccgcttgctgtgttttgtggatggaggacctgcagccccctagctggagcagagagacccctgctaccctgcattctattctgggccctgcatggctccaggtttccagtccttctttttgcttgctggctcaggaaagtctgaccttttcccggactcacctcctggccgtgtttcctgtcctgggcatcgtgagtccccctccctgcatagcgtgcacagcatggttgcttccagccaccagggctgctgctgccttttgttgcaaagggctccttcccatgtgtttccacacaagcatcgcagcctgggtccttaggccctcccagaaccagaaacccaggggaagaacataccaagatacccctgggaagagaggcaggaagggctgtccaggcagagagcagtgagtgcagaggcctgagtgaacccgtgtgttcagtgaggagcaacgtggctagaaggctgtcctggtgggctttctgggcccttccaaggaattgagtcttcatccttcagtgattgggacagggaggggcttataagatttcataaaattgtatgaaaagaatttgtagggggcagtggctcactcctgtaatcccagcactttgggaggccaaggcaggcagatcacttgagctcaggagtttgagaccaacctggtcaacacagcgagaccccaactctacaaaaaaatgtttttaaattggccaagtgtcatggcacacgcctgtagtcccagatacttccctaggatcacttgagcccaggaggttgaggctgcagtaagctgtgatcataccactgcactccagcctgggtgacaaagcaaaaccctgtctcaaaagaaaaaaaaaaagagttcataaaaatttataaatcgctggacgcagtggctcacaccttaatcccagcactttgggaggccgaggcgggcggatcacgaggtcacgagatcgagaccatcctggctaacacgttgaaacctcgtctctaccgaaaatacaaaaaattagccaagcgtggtggcacgcacctgtggtcccagctactcgggaggctgaggcaggagaatggcgtgaacccgggaggcagagcttgccgtgagtcgagatcgcaccactgcactccggcctggcgacagagcgagactccgtctcaaaaaaaaaaaaaaaaaaaaaaaattataaacctttaccaggttttatcatctggccagatgtgtgtttttcaaaagatagctttggaagtggcaaaggattcattgaaaagcagatttttctcttggaaataattcattaatctggtgattttgtctaaatctgtggtggcagctaccgttatcctttgtaacgaacaaaatgtgtattgttaacatctgaaatgtaatttgtcatctttttatagatgggaatttcttagccataggctcacatgacaactgcatctatatatatggcgttagtgacaacgggaggaagtacacgcgagtgggcaagtgctcggtaagcgctgacagtggacctgtcgcttctcatgcactgcgtatagtttaactaccgtggaacagtgttggcagggacttctaaggccaatgaaatgaagacagtgttttaccctcccagggtcattccagcttcattactcacctggactggtctgtaaactcacagttcctcgtgtcaaattccggagactacgaaatcctctactgtgagtaccaccccggggttgtatgaagtctcgatctcagaaagcgttcactctgagatccagggggcctctgtgagaacccacctcctgtatgacttaggcacgtgccatcatctctaggtcatggtttccgcctctgtaacgtaggggagtggggctgcgtggcttcttgggtccttcccggtttcctgctgactgtgagcccctatggaggagaagatccagggcctgccccaaggggaagaaggccaagccctgcagaggggggcttggggcaggcggatgtggcagaagggggcgggtccgggtggatgtggccgaagtgggtgggtccggagctgtccaggcaggaggagggcctgtaaaggtgttatcctcacaggagggaccatgaagtccatccccgctgggtggacggcagccctgggacccctcctcctcccctcccaacctgaccctggccagtctctgggcccaggcagtgcttgggaacagcgaggatgatcgtggcgggcacttacaagcacatcctcatgccacgcactggttccttagacacccaccaggcacctgccacgtgccccactctgggccacgcagggcggcgcgtgggcacaaggaaggcctcgctgctcccctgctggaagttactggaaagcgcagtgctcctcctctgcgtcttctcagatgacctacagcactttctggcttggccgcatgatgcagggaagggctcagagcccaaaacacaggccccaagagcccacgggggtgggcgggtcacactcacttgagcgtccccacttgttgaggaccaggacaggcaggaccactggcggcagggaaagcagggcagtgtgtaccgagactgagctcgctccagtgcggagggcggccgcaccgtctcacctcctccctgtccagctcctgcctgacacaggcacaggaacggtatgattttcagggacaagccctgggtctagagccttctcagatgtggtctcgtactctgctggtgagagctcatttggggaacacacaagtcccctgggaggcccttggtttgactggtttcaataacctccattcctgacactgatctgaagggactgaggggtatagggaggcgagggggcctgaccgcagaggcagagctgtgttcaggggctcgggtgggggtgggcagcaggcggagacccaggaaccagaggctagagaagccagactgtgggaaacagacttggacggagatgggaaaaaaacaaagaagagggcacctccacccaggcccatgggctcgggctcagttccaggggaactcacatctgtgcacacgtggttcctgcccgactgggaagtggaaggtctccctctccaggaagggctctgtacccaacggggcacagctctgggggctcagccttgcttaggggaggggtggggccttggcttagatgttgccagactgtttgctttttgcaggggttccctctgcctgtaagcaagtcgtaagtgtggaaactacaagagacattgaatgggctacctatacctgcactttgggattccatgtttttggtaagtttgctgcagatttcactggttccaacaaaagagtgtctccttttaaaatatttcttcagttgctacggagtctcatggtcaccagtcttgtcagattgctcggctgctacgggaggcccatgagacacacctcctgccgcaccctggggtagggcctgggcttgcctggccgtggcccactgagaagaaccagagagatgggtttttaacccttctccactgtacagggcagcaggtcctaagataattccctggaaccctctcctatcaggttgtgccacatggacctaggtggaccagatggcactcagtcaacttaccatttgtgagggttattatttatatattttttgttcttaaactaaaaatttcactttcttcaacattcactttaggaatattttcataagtgaactaaattaaagggctgcaaattaatagaatttttaaagatagtgtttattgtctctttacgtaagactacaagtcttgtgagaatttgcagttttgtggtgttcagtgctgaggtccggaggttcactccagagctcccagtcgaaaacccaacgtgcatccagccctctcctagccacaggtattgttgaaagggtttccccgacaatggtcagaagagggcgtcccccacccacccattctccaggcccacctgggctcacccgacaatggtcagaagagggtgtcccccacccacccattctccaggcccacctgggctcagggatgcagagcctggagccagtaatgatgggcacagctgccaggctgccccaagcaagcaacagccacagtgagtgaccccaagaaacatgcgcacacccagggttaaaaggcctttggagagacccacccatgtagagttacagcaataacaaggaaactgcaggcttgaggacagggcagcttcccacaagatgcttcagagatcaaggagaggtgtcactttggaactggggttcctggtactgtctgccttggcctcaagatgaggcctcaaaagacctggcagcccggaaagcttgtctttgctccccttgcacagcagagcatcagagggtctccgagactggcctgagtgagaggagactgggcgcacagcgagaggccaggaactgaggctattgtgcttttttgacccttgtttctaaagctggacttcaggcagtttcatgttcaggaccgttcagtgggcgcttcctgcgccatgtggccctgtggcccctggtgtttccagcgccctgtttgtggtctttgttttaggagtgtggccagaaggctcggacggaaccgacatcaatgccgtctgtcgggcccatgagaagaaactcctgtcaacaggcgacgactttggcaaagtgcacctcttctcatacccctgctcgcagttcagggtaaaggacttgtttcttcactaatcttatcccccatggggcatgcacgtacacccgacctgtttggagactaagtggaaatgggctgtgagcgactgctgccagccacaaaggcagatgtgactctgttctttgcgccctgagcacttccagccgcccttagggaaaccccaagccccacaggacccacaaagccgttcagagctgctcatccacctctgcagccccacaggctcacgaccccgccctcccccacggctcccttgctccggccctgctcagccgcgccagccctgagccctgggacgcccttcttcatcctccgtgatcctgaccctggagacccctcaccctcagccccgggcatctggttaggcccacctttggggcgacctcatacctggcacctctgatactgagcatatctctcggctgagggcggtcatttgctcgtgtctgtcccctaccaggccacgaggactgtgggctttgtttctgtgtcccttctgtgtcacacacagagcaggtacccaagtgagagctgccgagcggagggcgagtaaaggaattaaggcatgcagtgagaattcaagcactttcccatcccagatggttcgccttgtagtaaaggaagctttcccccgtatcattccctccaggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacgcccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaatggcttcatttcattttaattgaaattctttaaccagtgcagtattaaccttgcaggtgttcactgttcactcactcacgcgttaacacagcgagcaatgaccctgtgccactgctcagcacctctcaggcaagcaaggccttgaacctccaagattctcccggaacgagaggctcaggaaccgcgcagctcttagcccagcttccctgcagcacgtaagatgaggaaagatgaaaggaaaggaaagattacgatttatttgtagttacaataattaagtttgttagcatgagagaattttccagtgaacaaaaagccctcaggggatttttttttatttaccatttgaaactttgtgaagatgaaattgttgcttttgcagagtaaagtctccgtggcagtcctgtttagataaggtcaagtatcaagggaacgctggatttcctcaagaacagggtaggtgctggcgttcacatgcttcaaagcttgcaaaagagcacagttgacccttgaacaacacaggggttaggggtgctgaccccacatgcagtcaaagatctatgtataactttttactttccaaaaacctaactactgatagcctactgttgactggatgcctcactgagaacaatttccacatattttgtcaatatgtattatatagtacacgcttgcaataaagtaagctagagaagataaaatgttaagaaaattataaaagaggccaggcacagtggcccagcctgtaatcccagcactttgggaggctgaggtgggaggatcacttgagcccaggagttcacgaccagcctgggcaacacagcaggaccccatctctaccaaaaattttaaaaagtagccgagtatagtggtatgtgcctgtaatcccagctactcctggaggctgaggtgggaggattgcttgagcctgggaggtcgaggttgcagtgagcctggagcagaccactgcactccagcctgggtgacaaaatgagaccctgtctcactctggggactctgaaggctgacagcctgctgccgcctgcctccagggcctgggaagttgatttgaagagtgacactaccagggcagggaggccatctgtcattctgcgggtgtttgtttgggggattttgtaggcttgtgacagcctgcagggaaagcagggctatttgatagatacactgaggcttggagaaggaaataacttccccaagacaggcacttgttccaaacttgtcttaatgacatgtgctgggcgctgggaatataaggacgggcaaaaccacaccagtgcctgccctggggcgcctacatggcatcagaagagccagaggttagcagaacgcatgcccagccgcgtgctagatgaccaccatatgagccaggaaggaattgagagcatctaactggaagacccgagtgagtatggggactccggaaagtttccctggcagaaagagaaggaaatga

SEQ ID NO: 12372 - DNA, 181429 bp, Human
ttaaactttaaaggccaccttggtgtcattttaagaagtggggatgagaccctggggaaagtgttgaaatcctggagaattcgttttaactattagaagtggtttaatatttgtaagtttgtagttctgtgagttctaaagactaagtgcagggatttatgtttttaactcttatgttttagtttacaagtttcatccttaaatcatctatttgtgtaaataaagcttcatctcctctataacaagtgtgttctccccatatttttttttgtctctttctaaggttaatctattacgcatttacattttctatgcatcctttaagggacactgaagatgctttttgatacactttctaaaatattaaataggcataatggctaggaatatgtaacattgaagaaatgtttcagaaactacagaatcaaagaggtttaaagaataaatttcatatctctcttccatgttattttattaggcaaataaaaactacaggagacaatttaacataaaatacaaataaatatctgggggttgtcatcttagagaactccctactataaaaagcagaaacaactcaatttactttatatttccagatagaaaggttggaaaaagtttggagccttatgtgagatcaaactttggatctatcggaaataaaaggaaatcataaatgactgagaaatatttttaaaggaagaaattataggacaaaaaaagaaattcatcttaaacatgtgatcaagttactctgtgtgacctttgaaattgaagatttggcaattaaaattttaaagttcttcctcttattacctacctcttgaatacaaagtgtccgaaactgcctaatggaaaacagatttctctacgcagccttccttgccgttcgggttgaatgaattcaactggagatattggttatgactttttttattcttagtttctctttgaaagataagcattgaataattcctgaaaatggtaaatacttgcgaagagaaaggtcttgctttatgaatttaatacgtagtggcattctttaaaattcagtgtaatttatgcagcgaaatggaaaactatcaaagtggaggcaatccaaggaaaaccttagaaaatgataaacgcgtaaaaaaacgatacgcaaccatcagaaggttctctcctaatgtctcacttcgctcaacaaactatggtgaaaagacagggcggaggagaaggggcgcttaaaacaaaagacttcctttcccactcccttttcctctgtttcttttgccagagcttgttgcaaactcttggaaacattgtttaaacataatacacttggttactttattctttcagggattgtggtgggtggtacctaaaactgacggctcttggagtaacagaaaaagagaagtagaaacttttcaaaaaggcaaaaaacaaagttacccagcccgcggaggttctaacaacaaaaaagtaaaacacactttacttaaaggcacagctcatttcactgtccgggctccgtgcttggtagctgagagaaggcttgcttcgcctctggtttctaaaagatcgcgcggagtacagctatagaaaagagtgtaagttgggagcgttattctcggatttattctgctacgcgaaagctgcggttgctaaaagcagagcgtccaaagcagcacacacctcggctaccatcctcgttctcctctgaacatccagcgcgagctcagaacctggagggaatcctggaccagcaacctgactccgctcggcaccgattggctcctgcctcggaccccgcccccgtggccggggcggccatttcgccgggacccgccccttggccctgggaatcgcctcctggcaggccggctgtgcctgccactcagcccgagtggcggaggctctcagctcggagccccgccccctccccccctaattgatattattggagtgtggagcaagcggccggtctgcagtcggagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaaggtaaggtgatgggaaagcaaagtttgttctgacttatttatttagatgtctacctgcacaagccagctcgtccgcggcgctgccggccgcgcctccggcgccgggcgaccctcccccgccggctccccgccccctcaccgctgaggccgctcctggcggaccagcgagcgcgaaccagggctgttccgagccgcctacagccctgtgcccggagccgtccatccgacgggtgcgggatttctggcgcgggcagtctggagggcgtgagcagcaacgggggtggggtggggttggaggaactgccggcgagcttatttcttagtacctcaggcgggtcacatctctctctagctcggtcttccttgtctccttattcgccttctgtgggagctgcggccagagttgggttggagactgggaaatgcagcccctaccgtctccgccagcccgccggcgagtggcgggagcccggagccttcccagagggaccgagacttcgatgagctcggaaagctcgggttactaatgaagtgctcactgcgtcggaggcggcggcgcggtcctgcggttggcgctcggccgccagcacggaacaataacgccgcggaggtgaagcgcggcgtgcggcgcgcgacccgagggccggggatgtctccattcagcgcgcgctgcgcgtcgggcccagcggtcatgggggcagcggcagcccagcgggcttggtcgggccgtggaggcagggggcgggctggagctgtgcaatttgtaaggatgccgcctgggcgactcaaagtccccaattatttgccccatagtgcagcaattgaggaatccgagtgcccaatccttgccaaagacctgaaccctgagggttggttctggtaggagaaggcaggttttatttggcaagctgttacagatacgcctgtatatggttatgttttccttctttgaacctttgacagaaggtaaaatacctttcggtgcctgtagttggagctggggaaaaataaaccctgtcaatggaagtctcttgcttttgagcagtgtcacaatcccatccccaacccccctcatcccgtcgcccccctggtctttcaggctgtgtatctaagtttcatttttcgatctgttaaaagcagaagagaaataattacttattcctgatgtgtagagggagaggaatctgttatgaaatttaggtcatggtggttatcgggcggggtgttgaggggacttacatataggtccttgattcatctatttctgaaaacttagtgcaccttttctttattctcatcgtgcactcctcttagttcgctcaagcccccctcaaacccggcgccaaattctagtccttctttcagcctgaccttctgaccccactttccacatctgcaacctgtatagatgctgaacccattcagagaaccccgtgcctccaagctggcggttacgcgtttgcagaaggacggacatctgctagaaacgcacgctcatcccctccaaaaccacatttctactcccctgacgttagcgatcagaaaccttcagccctggcatactgtgattcctctggaatagcggaccagaggaaaagtttgcaccgccgcggcgaaaccccgcgcgcgaacacacgcagactcgggctggagtttgggctataaataactgcatcactagggggagaggttcctgcagccagaatgtctagttctctttgctcttctgggtgcaagctacgtgaagaggattctgattctaagagcctgaattctttagatgcagaagtgtgatgtataaaaggcgcgggggtgatgggagggagggtggtgatctgtggctggcgggcggcgagtgcgcccggcttctaggcggcgacgcctctagggcgcagcggcgaccaagagctggcgttctaggagttcacaagccccgaggcggcccgcagtacccaagggctagcgctgggaaccgcttgaagcaggtgccgggcctcctggggcatttgggggtggctagaggaagataagaaacccccttccctcactttccttgtgcacgttctctcgggttggtcagttatcatcgctacagggagcgcgtgtcagagtctgacgcttgaaggcaaagtgcagctgcttactttttctctccgtaaatgccgccgccgccgccgcctcttcctcagaggagatgcttcccgaaagccactctcctcttcccgaaagccactctcctcttcccgactccttctcgagcgagggcgccaccggctccctggagtgcccaggtctggcagaggcgtaatggatgcttggcgcggctggcgcgcccgcctggcagcccccgccccgcccctccgacggccccgccccagccccgggacgccagcctttgcccgcgcggtcgttgcctgggtctgtcagggcgcgcccccagtctagcccctctcccatcacctgttggcccacaggactccggggcgcggagccctggagtcctaggcctggcccccagcgtccgggtgagccgagggactgcgcctccgcgggcgcaaagggaggtcggcactctgctccgagcgggaagggatacgcgctcttttgagggtttaaccagagagcggaccgagcagaagagagacgcacggatcacttgagagcggcttccgattaaacgttctcgggccgggttctgttttgttttaatttgttagtttgtttctctcttaacttggccatcactgctgtctgcttaggtcccttgcttccacccccaggctgagctgaggggtagcagaatggcaataaacagtaatctcgcaatgtttatttcactctcagaaatgacccaagaaggtcacctgcatttaaaatcctgttgtctatattcagcacacaagaaaaataaaataaaaattaagaaagcatctcaaaaagagtagagtacctgaccacccaccttgtttccctgtgcttcatgtctgttgttgaggataaaaataaactttaaaaattactttttatataaattcgctagtccaacgatttatcgatgttacaagttgaaattcaaattggcattttgaaagtgttgtgggtgtgtttctcatttgaaagggagtcaaatgtttctgatcaagtttttttttttcctgtcagtctccctgagagtcttaagtgtaaaacactaaacaaagaaacaacaacaacaacaaaacaaaaatcctgggtctctatatctattttcatttacagtgagtaactttgactagtgtgaaggaattaaacacataatcaactgttcctttaaacagataatcagttgttcctttgttttcttatcataacacatttttgtctttcaaatacatattttatccctagtgattgagttgtataattattaaaagttcatataagcatgtattttaagtaaaaattttaacatttttctgaggctgatgttaagcctattgacatacttaaaatttattcactattatttctggacaaattgatgcatttgtcaaaatggtgtagagtcagataaatatttttaaagtgcaaaaacttatgtaactctgaaaccagtttgaccaaaagagtgagtgctttagaagagtaattgtccaaaaaagaaataaaatatatcaaatagaaatattatgtgtattaatatataacattctaatgcattctcatactgatagtatcaggagcatttataacactttatatacattttaaattaatcgcattatgctttttgatagcataaaagtgaaatacaagtgattagaagtcagagttgataccattttgagaattatctatcactttgaaaattaagaaattaaaaaaaatgctgaaaaaactgatgcttgactaacctgaataaaatcttgcaaataataggcaatttggttttctgataacattgcttaacagtttttaacatttctgtattcattttagcttaacgacactgtatgtggaaagattttttaaaagataaactccaattctcaaaagacaatagaaaatactgctggcagaatgttacaaattaatgactggatcaagagtaatataggaattataccttattatgttcatgttattgtatttgacaaatttgaacagctcaatggtttacaaaaccgtaatatataattactgtggaattaatgtatcacatataaaatttctaccctcattctaatattgcattttaagatttaatattgtaattaaagcataccaaatataatattggtgtcttaatatcttttttcctttaaggaagtggaatatacatgtatcaggagggtgttcatttcaccattgatttacataaataactacagatcttaagtcatatagtgatagttatatgaaaagattcaccttaaaaatgtctacatgtgtgcgtaagtgtttcatgtaacatatggaaatacaactttctttttcagtactactgctggattctaaagcacaacaaacagagttggagtggatttcctctccacccaatggggtaagtttttttcatcataaaatatcacttttttaaaataagaaacaaaacgtttcccttccctccagggtaattattcacactcttcatgtataaactgtttaattccaaatatcttgtccaatattatgttgcatttataatgagacattgagttccctgattagagagggtatacttagaacttggggaaatggaaaaaaaacctcatagccatagtcttttgagttcttattgtgtggaatcatacctcagggtccaggctgtaaatgctaactaattacagggaacattcctttcacaaactcacttaaacctctttagttgctttatatttctagtataatcaccatgtcagtggtatataattctttaaatcagtatgtaatcaatctgttttcctatttttaaaagtttcagcatcattcaaaatgtactttaaaatataactaaaaatgtactatgttcaacattttggtatacaatttactataaaatattatatagattctccaaatttatattatgtgctatccgctgttattaatcagaaatgatggcaaagcctgcacatattacaataaaaatctgcaatagatatgagtgaaaattgtccagtaataacctaccaaaatattagtaaatctttaaaaatactaaccattatttttcatatgtaaatgtagctcagtatccgtgtcttcagatcttatttttaattgtgagagagggcacattctttattccttatcaagtaagagggctttgagaaaggagaagataccctattgctatttgtgtttatctttggcttattaaaaaccgtgtggagtgtaagttatgatacaaaaactgtagcatattttgcaaagagaagaatgaaagtttgaaagagattgttgagatcataaaatcagcatgtcaggaactgaaagtttaagaatgtaaaatatgaacaaaacaaatctgtttaagatatttagagttttcattaaatttaatttttaagattcctttcattcatattgtggttatctgtattggttatgataaattataaatcaatgacaaccattttacagattaaatataaaaattccatgagttggaggtatgaatataacacctttcttgagataagtggtttctgtaagtaaaataatatacattatagacagccattcatgataaaaaatgaaacacctttcttgccaatgacagatgtagcccattttctaccatccatcaattaaaacaaatagagatagaggatggttttatctctgaggagaagtaaactgatatatgattgtagtatttcatccatgtaatacacaaaatgacaaattatgactgtcaatgttatcttggactcaaatgggcattttatcagtccaaagtatcttaacagttaaccctacatgtctgtaaacatcaacacataatattagaaaacaatgatggacaatattttctatatctgtgcaataggttagtttgcatgtgactaaatacctaactaaaaaaaatgttcttgagatataagttttgagaaaatatttctataaacgtactataaaaatgcagtgtctgaatgaagacatttttcccaatggcgtcatttgtggaaatgttcataatgtcttagaaagtgagataataaaacaacagttgtgttaaatgaatttatgtagtctcaatgtttgtagtctacatcatagttttcctgaagcattcccctctggaataaaattttaaataaaaataaaaattaattgggtttcaagggtagtaaaattgatttttcttatacagaataaatgaataaatttgttctcgaagttagataaaggaattcttaggctatattcttttaaaataattagctttggtttcttcaaactgcagagttgttaaaaaggagcacatttatctttggagcttttgattttttggtagatatcattactagttttacttcttttagcaatttcaatctaattaagagactgaaatctagccatccaaatggatgaatttggttatgtttggctgattgccattcagattgtaggcagctaactgaaacaaagggaagctaggcacactgttaactagtcacaaatgcaagttgaactgagtaaaagctgaacattaaaatgggttctttactacatttgagtacctttgatggtattagactgtgtataacaaaatcacaccaaatatataacatcatcaaagaaatttctgaattgtattatattgctaatttgtcagtcttgttaattttctaaggactggttttaaaagtatacattaatattgtacagaacatttaaataaatcaatactcaaatcaagtatttaaaataaaagtatttacccatgatttttattttctcatcttttcttgaaacaatagttaaaatattgcatgctatgcaactttggacttgaacacaaatgttttgtatttgaattttttattggggaaattaatattaacatgacaatttcattattaagacatcataaatacaaagtgggaaaattattaataattgtacgaagaaaacaaaccattcatttaggcttttaagattcctaggtgaaatgattttattgattaatgagcgacagaatattatatatggtttaatagtttgaaattgttgcaaattctgacaaatgcactttttttccttttttgagaaaatatttaatatagatttgtttgtaatgtacattatatcaacatataaatggacatttttaaacatctgatatttttcctgtcagaaggtttatactaaatatgatccagcatgcagatttgccatgtacatttgattgtctattgaaagcaatttatttataaaaatgaatcatactcttataactacttatttatagttatgtggctttgtatgtgatattatatataacactggaataaataaatagctctgtaaaatgttacttccttatatctcattttgaaacgattgtaaaatattccaaattataaatatcaacaggttgttgaatggtttattcagaataccgtgggcattttcttcttcatgtttttaagtactctgtaatcgtaagtatgatatggccacttaaaatgtcaactgagttatcaaaaattctgccaggcatccatatgtatatactttcactgataatttaaataattgtgagctttagtctataaaaattataatctcaatggagaacataaacataagcaaacatgtaaaaaagaaacactaatatactcacagaaagatattaaacaaaatgaaatatttattgtatgtatacacaaagcaagcagcataagtatgttccaccaccaggatgaagcagaacctggaatcttacattctctggtttatagttttgccagcataggaatcaacctaactttttcgaagatctgtatttgtgaagtacttgcactttcaaaagcaaaatgttattttttgctgaatgactgatgaccttttttcaaattttacagtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaacgtaagtaatgtgtcctattaaaactccactttgcctttttaaatttcagtatcagacattttaaactttaatagttatttgaatacgtgaatctgctctgtaccagaagcgcaattcagtagatcttaaacaaagtcaccgttgaacttagtgattgccctacagtagcatctgcactaagtgtatgtaatcaatataggtgataatgaaatttgttactaaaatttaatgtgtcctatgcttaacatggaagtcaatagttgcacgttgggctatggagtttagagaggagtctgggtagttggacatatagcctggcaagactgaggtgacatttaacaggatttaatgagatgccattcctcctgtttttaaacccatattgtctgggcccttgagtagcagtaaataggaggttaagagggctgtgaataagagctctagtgacaggcagggcataaacgaatatatttacaaacttttagaattatcttatataaatactataactttaatacaaaattttcaaatttcacttacaaaatctctgtggttacttctgagaaaggtgtgtgttttttttttttttttttggactaagtaccaaaatgaccacatttttgtgaaagtgggccaaagtaaagttttaattattatagtacaccaattgcatgttttgaaacaatcatgtatgaattagtaaacttttttctttgttttataaaaccgttttttttctttcctagcattatgtggctaaatatttaaaactatgtcatatggaccttcaagattgatagatattctgtttctaggtttcatgaaaataaattataaagttatgttactagtgtctctttttaacttatataaaacataatacattaaaaataacacatatatctatatttatttttacaccagagccagaagcacaggttttatacttggaattcttagttgagctaaaggagactactgataataataactattataactaatttttcttgataacttagtatgtgcagacatcctccatttcctttacatacacaagcttatttaatgaggtaggtatcattatcatttatgttttacacaataaaaaaatagaggatatcaagagtaaatagcttgcttgcagttacgttagtaatatttgtctgagcttaaattcaaacttgagatattctgactttagagcctaggcaacgatattgccctagttttaatcacaaagcaaggagaatcctaggaaatactgtttcaaggctcatagtgtttaggtgcctcatatacatatataaattggattacttccccataaaattctcattctagtagaatatttttaaaattaaataatttttaaaaagtttagacctgtgctatatagtactgaacccagcagccacgtgtggctctttaggttttgaaaaatgactattaaacattgagatgtgctgtaagtaaaagttacacactggatttcaaagctgtactgcaagaaaaaaaaaagaaaaaaaagtaacatatgtccttaacaatttttaaatgttgattacatgtggaaataatcatattttaggtatactgggctagatagaggataatgttaaaatttcagctgtttcttttactcttttttagtgtggctagaaattttaaaattgcatttgtggctcacattgtgtttgtattggatatacttttcaaatggagtaactgagcaaatacctttttctgtcctattcaaagagttaaatacttcatgtggatggctgctaagcatgtaaagtacctatggctctgcactcaattatcatcttcaccagaggtgacattgtgaagtgaactctgagcaaaacaaatggagatgatataggttcaggtcccatagaccagtttagcagtctccttttatgtccctgaaggagtcaaacctgtctcctattgtcctgtttccctttccctcactggcagtatttctaattgagtagaaaatcctgcagtttccatatatgtggaaatcagaaactgatgaagatttatccctgcttgtaggcaaaatgctattccactgggtaagtagagaaatattctcagtgaactaatcaattcaatgaaaggcagcgttcctgttgacaggaggttaacagttacttgaaagtgatggtggattcagcagtaactgttacaaaaaattttaggaacattattgcactttagctatgaaaggagcagtttcaatattatgcagaacttgattgatatgaaaaaggaacttaaaacttttacacaattaaaatgggaaaaataacgaagtagaaatacatataaaagtacacaattaaatttatctgagaaaagataggaaataacattaaaggccctgtgttttaaaggttttaaagaagattacgggtttttgtggcagttgtttcactttgtataatttaactcatttatttgttaagaaaatgtgatttccacatttattcataagaaaatgtgaacaggagctgtttgagttttatgcttctaattatagaatttagtaagaaaagcagtcttaaaccacagtaaatagatatatttatcatgaaaaataaacctcaatttatttcaaatgagaaaaatcatctcatcaaacatggtactgtaaaattacttacattcatcaaatttaattgcaagaattgaaacattttactaccaaaattattgttacctgcaaactataccaaggtatttaaaaataaaataaaattactccactgtcatcttcattaattctgcttttgaatacttgaaattaggtattaatattatagtaacatttaattaaaaataaaaatacacggttaaaggaggcaagatgctgccttatggtttaatcgaaagaatatgtgtgcgttgttataagtcaagtaaattgcttatgacataactttcttaatttttagccttggtgatgttgacaaaagaattaaataccttctacttaaccatggaactatgttcatttgcaaaaacacttccctccttggcataattccaatgcattgctgcaagagtacttgcctctggaatcactccaggcttgcctttatagtattcttcctgtttcctttcaatgatcctgttaagagtttgaaaacaaattccagtcctatattgaggaaaactaatgtgtttgggagaggatgctagtgagtccctagccaaatgagagtggttagccacttaaaggcaagtttatctgggcacattttgaagtagcagcccattgtgatgtttgctagaagacaatatgaaatataaataactataaaaaactgattgtaggtttgatgagttgatgtaaaagcttttcttcatgactgaaaaaatagctcaattttgaaaaccaaatgcttctcaagtctaatatgtggagaacttctgtccaattcttaaacatagtatttttatgaggacatctctttatattgatttaagaatttataatttcatttagtatacttttattgtcattttttaaaatttacaagttatgtaacaactttgatgcaaactagccaatacattttcttagataaaaagtatagttattttaaaaattgagagatcctgttatattttacatatgtaaatatttcgggaagactaataaaataaatatactgaagtatatttcaatttttgtaacttttatgcaattttattcgatttagaaagtagaatagtgcttgtcaaagtgtggatctggatattataacttggatttgcatagacagtttgcagtttatactgaacagtcacattcattttctcatttaaacctcaccacatcactaagatgtggaaaatattattatttttctctttcaacatatgaagaaactgaagctcagagatattaataagtaacaaaattggataagaattcaaaaatcctgtttaccaattcaagtcttttttcctcactccactacttctctaaaatttgttctggactttacccagtagattttagttactaaaaaactaatgaaactttattctatgtagggtgaccatatgcccgatatgcctgggataattgttttttttaattaacactgcttctttttgctttgaaaaatgtttttttttatttggatgataatcctacttgtaaaaaattcttctcatttggaagtaaaaaattcaaagacataagatttacatgcacatatatcagaatatagaaatgtgatttacttgcattactatattgcttaatttaaattttctgaaagcaaatatgtaaaatttttctttcagatgatttcatgtaaaggggaattcaagtaatcatacacttataatttttatgagaacttttcctaatagcagctttttaatagtttctgttaatgttaagaggtctatcattattttaataatatataatttatgaacatatgtataatttaacaaatgaaacaatacattcaattttatagcatcagcaatatttaaattctgtttcttgatcaaagtttttgaaaactgcctttattttcgcagacaagtagcatgtaatttgtaccatgaaattttcataacaaatgagtctttatatagtatttataatcatttatatatatatatatatatatatatatatacacacacacacacacacacacacatatatacagaaatataagaaacaccagtgggttagtagctcagatgccggagtcacagtttcaaaatgctggtttcacaacttattaggtgcataaagtaggacaatctctccaaaccttaatttccttaagtataaaatggggctaatagaaaccctcatagggttcttgtcagaattgaatgaagtaatgtatgtacaaatcctaaaaatagcatgtgggacatagcaaataatcaatgaatgcttatcattaataataaaacaaggaatttgctaagtaaagaaacctcatggtgatgaacaaatgaacatgtatctcacaggccacaaatagttaaatatcctttaagcaagtaatttcacacctgttaatttatctaagaaggcatttcaattaaaaaatattttacataaccctttttttccaccagcagtgtatgcaattttaattattgataataacctaaatgtccaaagttaaggtgtatcaccttgattgaacttagtctatagaatatcaatgatattataaaggaattttgaatttctattaataattttgaatgaaaaacaaaaatttgtataaaatgacatttagaattatgcaaaatatacataggaaaaagagtagatggtagtctaacaatgaatgtatccatgtagtgggattgtgggtgatcttttgttctgtctataattcaaaacatcttgaacattaacttttatttttgtacactataattttaagttctaagtaaccaggtagcttatataaagacaacttgaattgtatctccaaaatatgggtttttaaattaagtttgtttatgtataaacacagggctcaggtactatagcagtagtaagtggcaaatatagtttaaattatataaaaggtagaagatattaatagaaggcattcaataaatacagctcatagattttgttcgtttttagttgttaatagataccaaatcctattttaagtacttgcatgtattaagtaatttaaccttaaagggaggtgttactaatttagtctaatagaatgagactattattacccagtttaaaagagaaaaaatactcttaccgtgagaagtatatgtctctctctctctctccctctctctaaacatgtgtgtatatatatatatatatgattatatgtatacatgtatacatatatatggttatatatcttatataagtttgtatatatataaattcatgaataaaaacaatgtaaggaaactgaagcatagttactttgggttaagtacttatgatcacagagtggtgaactgctttttaatcaagctagtctggcttccgaatccttattcctaaccaataccctggatcatgtctttatagaggaacattttatctattgcaaagtcttttatgaacataaacttttttcagaacatcttgaaaggtgatacaaatctgaacattttctttcatttatcataatttcgaaatatgtgtctctacctttcctaacatcctaaatatttcacttgctttgtcattctctttttgattccagttttttctttagatggccatcagattgtattttgtaaaacacaacatagtatcattattcagaaagcttcaggcttctaattacctagaaaaattgtctgtattttaaacttgcatgtaaatttcctcatcttcaccttattttcttttctaactttcagtcacatttttatcacagttgaagcccctgctccctctgcctgatactgttctctcactctgccttaagcatgcccatagatatttctacgatgtctcattatttaacatttggcctcaactaaaaagaaaaaaattaacaattatatatctcacaattttctattatactttaattatatgcattcttgaagaggcttccctagcttctttttcaaattctgatgttggttactggcggtaccattctccttgttcttaatctatcttgttttttcctacgtagttaccatatattttcttatggtctcccggttgtagaaattctgcctttccttaaaatatcaatttaaataccacgtataccctgttaggtgatctctcctttttcttttttttttttttttaagagatgagtgttgccatgttgcccaggtgggagtgcagtggctattcacaggtgcaaccatagtagatcatagcacactacagcccagcactcctgggctcaagtgatcctctctgcctccacctcccaagtagctgggactgcaggcatctgccactatgcctggcttctctttttgagtacttaaactttgccctttccctaggggaatcattgcatgctatcttattttattccttgtcttttcctcttaaagattctatttttttaaacagctaagccttgtgattttttttttttttacctacccgccatgatacctagcagtttcttacaccaccttagccttccaataaatatttatgaaatttcttaaagaattactcataaactatccactggcaaagcaaagattttctttctctgaattcatttaattcagtgaatttaaattaatttcaatgcaattaattgaatttcttgtatatggctagtctgtatgagtagtcttcaactttgtgaggatgggagtccttaactacattccattttcctcatagcaaataacaggataaaatgctaataattagcaaacataaacaagactgtcttctggagttgaagaatttattcatgtgaagataatataactgttatctattgtcacattctcatgctttcttactgtctttatgtgtcttttcaatttctcccttttcttctctgaggaaacaaaaggcatttcacccttgttagcattatttatgtcttaagaaacagagatctaagagcctgctaacattttctatattaagaaggccttgaagtgtgtttatatttatattatatgggaaagcaacttttgttataaaattatattgtttgcttccaaattatatattataaatattagtttggattgcaaaacaaaaaataacagaaagaaacaaaacatgataattatccctaagctaatattaccctattgtctctgtaagtgggaaattacataaattccatattatgtcaaaacatttttctcctatttgagttatacctacacatattacctttacaattttttatgtccttcattaaattattcacattcagaaactcaaaatacttgttttaagacatttttggataggtaacatacacagatctagaacaaatgtcatccctgtgacccagttccacagtatatttttccaggtacaactattgttattagtttcttgtgtaccttgcaaagataattgctcttaccttccttaaaaacatggagaaatatcattttgatgcttaaaattagaatcatgtcacaatttccaattagaacattgtaggttttatttgaaattatacttctttttacccatatttagtcatctttgttctcacaatgcatttaacatggtacttgtttcagtaaataaagaaggatagaaagaactgatgaaaggggggagaacataaggaaatacggaaggaaataggaaactaatgtgtctgatttagttttctgtggtttgttagtttagtgtgacttcagagtgtttctaattaacctagcattgggaagtatatggtcagtcttttataaatttctagtggaagtttaaattggcatcggtttctggcaggcagttataatacaaatcaattatgccttaaaattttgcatttgatttgtttttctgtgtaattcatagctattttctctaagataaccactaatctatgaaatattcatgatgatattgtctatcattagttattttatagaaataatattttcatgggagaattttgacacagctatatatttgatatttttctctatgtccatacaaatatgatacatgaataccaaaggaaagatttcagaaaatctttttgtttcaatttttctcacatttaaatagctttaaattacctcatcccctgcaaaatatctcacaaatttagttttatggatgcatgtcttcattaggatattaatgtaagtttaatatgtgaaaagtagaaggtcacatgcacatataagtttttattttttaatctggtagtaaaacaactcaatttagaaattagttcaaattaatgagttatagatgttattttttttgttttctacccgtgttacacactttggctaaagttatagaatctgtaggtatatgttacaatattaatctcgaatgatagcatttctcaggaagccaaagtgatacatcagctgaaacaaatgtacattatttttcttatattctgtgattttgttaagagttatggaaggtttattatttaatttactttgtttagcgtcgatgaatgacataagaacaaagaaacccagggaaaatgcactctgggatgtaatagtttgaaagttttttaatggttatattttttatggattttgaattttttcatgttatttagtcatttaagttatttactgctgatgattatgttatctcttgctcctaatgtattagaaaatcagggggctttgaaaggacacatactgtgtttaatattttgtttcatgtgtcacccaattagcacctagtttaacccctggcctgtggtgatggtagcctcagacttaccctgaacccattaacactgaattacaaccttacagagaaaacctagatctggagaagagatcactgtgatgcttttatgaataaagcataatatcaatctgatacaatattaactacatatcatacatttatcatttttaagttgaatgattcaaaaatctattacattagtataacctagtctactttttaaagaaatcattcttggtaggcacagcggctgatgcctgtaatcccagcagtttgggaggctaaggtaggaggattgcttgaggccagacgtttgagaccagcctgagcaacgtagtgagaccccagctctgcaaaaattggaaaagttattcaggtgtagtggtgtgtgtctgtagtcttagctactcaggaggctgagttgggaggattactccaacccaggaggttgaggtcacagtgagcagtgagtgataatggtaccactgcaccccagccagggtgacagttagaccttgtttctaaacaaaacaaacaaaaaagcagggcaggaatcattctttctaaaagagagttggaccaggagagggattaggggtgaatggataggtgtggagggatagaacacatctaaaaaacacttgtatatgtggagttgcttgataaaataaaagcttattctgagaaaaataaatgaaagattagtaattcactgtgcaattctatatttccagtgatttatatgttccctgtttattttaatagtagtttactatcattatttgctaaactagttctcatatagaaaataataccaaatggcattagcttacttaatgacattaacctaatatataggttaaataaacctaatggatttttaaaatgtttcataatatcttctacatttatcccagtaaaataagtgacttgtattatataatgtccctattttagttgacattttcctataaagtacttttatcctcgaagagagatgtgcggtaggatatgcccctcacccactcagatatgatacactctttataacacaaaagttctttgggcattcttgtactcctttagggcataatctctttcaagacaattaatattacaaattcttcaagtttgagtgtgccttaaagatcatcaaagataaattagagggtttttttagtctttttatttttaaataaatgggacaactaaagtcctcatttatacttccaacagttcattaatgacagattcaaaagtaagtcacatcttactctttccagtttcctttctcctttgccagtacacacacataatacatatacacacacacaaccacagatatccaaaagcacgcatatataaatacactcatatgtatgtgcacgcgcacacacacacagagccaacaagaggggaaaacaaaagtcaacatagtggagcaagaaaacaaaatatcttcttgaatcatttttagatttccaaatttctatgcattaattccttaatttgggagtactgaatagttaagatttcttttctatggaaatctcaatttacaattaaaaagaggctaaaaaatcctgtagaatattattgaattatttcacattttaaaaataataaaataaagctacttcaataaaatctttaaatattgcttcacagaacaacaaaggtgtaaacaaacttctttattttcaagtagatatttaggttttctttatcatatggaatacttgaaggctatttatgtctgggaagggaagagaaagtaaacttcactttttatatacctctaagtttctgtggtattttagaacaaaagaacacaaattttagcaattaatgattaggaaatgtgttttaaaatgagaacagtgggcacctcttacgtgatcagaaactgaagatttgtgcaggagcagaagttttgctgttttaccatgtgatttctgaccagatctcctctgagaaacctttaaactttaacctctctgcccttgcaagggaaaaggggcaatcacccttctgcaatatctgtttctcaaaactgacttttaaaattaacacatgttaagcttagacattcaggctgtgagctggaactgggaaaacacgtggctcaagagttatgttgagacagtgttttagtttgcaaaataaacctgacaggaaattttaaagttcactatttagcacatgttctttactgtgtctaatgtttattctgcacaaacattatatacaggagaactgtgtttttaagagctgaacataacaattggatcatttccctcctttgtaaatttttccaatgagacaattactactccaaattcaaacagctctcttgttgattttcaagattatttactaggacatcactgtgtatgtattcatcctctaatatgcctcatccttcattataataaagtgtctcttcttttcaatccctgttccatctgatttctttttttttccttctccatcttctcttatagtgttttagacactggcattaaatgttcatttatctttgagaaaattctacactattcctttaatggaaagataaatagtaatttcaaaataaaaattacaaatcatacggtatggcacattttcataatttgaattctggcctcttttatagagctaagaaaataaatcacactttgatcaatgctgaaggttatagtctcttttgtaacatttggacggtgacttgtataattccagaattaccactctcaatcaatactgtaaaggaactcagccaagatgtttataagagtacttaatcagttaaagttcttaatctttattttttctgaaagctgaagtagttctgttatggtgtgtttcaatttgagaaagagaaatggagaccaataacaaataagaatatacaaataatatatagaaatagtttttgctgccaggaagatagattaagggtgaagaggtaagagtgaacaaggttaaaatactgacacaacttgttctgatctttagtttttaaggattttctgtcattatatactctgttgcagagacaaaaactatatgttagatctgtaaaagaacatacatattcaggaacctgtgaatacaactcatttaagcttatatgttacaagctgggataaagttgactagaaaaacaaaacactgatacataccagagttcacattaagcacacttttttattgcagccactttctttttcttccttttttaaaaaccactttgtagtgtataatatgaaagaaaataacaaaaccaagtctgcttttgaatatagggtaatttacacagaaaacaatgtacattatattcatataaacctaaagggcacggttattattcattaatgttaatagataactgagtatcgcttgccagtcagactggaatccaatggaatgttgacatcgattgatggacatacgcatgagaatattcgtaggtagactgcttaggtcagttgaacacataacactatcctggacccatctttgggggtgataaatcttgctatttttctttattcttaaaaaacattgcatattcttcagaattcatataattaagattaatttagagttttaggaccatatttatcaattaagagtaatgatttatttgatttaaagaaaaactgggttcctggtgcttctggctcccatattggaagaagaattttgattttgtttactctgttttatagaaagaaaattctaagtaaaaattgataattacttttcatatacatatttgaaattattggaacttttcttgaaaaactatttacttgagagaataaaaattgagcatcatggatgcacagcctatatgacattaaaaatagaaggaaactgtgttcttacaagtgttggtattgtatttttttaatgggcttctccaccttagtaagtatacttattttaatgattgcggttaatgatacatctagaacaaagcttttggctgaagaaattttcattgatagttattttcaactataatttgataatgttctcaattttaatgaaaacagtaacactaaaaataatattcagaatattcagaatattttaattaagctcattaatagattctatttcagaatcatataatatattatcatatatttttctctacagtctaacaaaagggttaacatggttagaattagtaattcttcatttttagtgaatttatttttaatttccccatttgtactggggattgtcatatttatatttatgttgcatacatttattggctaactctgaagttccagatgtgcaaatatattgttatattttgtatggaataattttgatagctatatattgtagtactttagagctgagttacaactgcatgtttcataatagtcatttttcctaaaatgtgttacatgtaaatctattcgtaaaaacattttatcattttagcatatgcgtttttgaaaagtggaatttggggttatgtaatctctttaacattcaagtatcaataacaaatctcgaacatattaaaagagctcacagtcaggatctcaagcagcatgtaatttattatatcgttatagcatctttgttaggtattaaatatttttatatgcttttagtcagggtaggatctatatcacagcttcagccactagtaaaaagcaaaatatatttctgaaaattatgtagaatttttttcaggtatgtacattttaaaatatggttgtcagtaacagtttatataaaatgactagaaaagtacattttttctacctactgaatagttctgtataattattgtttacacattagtcatcaaaatggcatgagattttgatttttcacctagaaatatgctgtgagattatccaaggttaatttcgacagataaatgacatgtcactttcattaaaatgacattgggaaactgagataaatagtttagcattttctgtgctgacatgatgtttgcctgtctgattgcatcctttccaatagacagcagagacacaattacaaaaaaagacatctgtgccaaggtttagctagccaaaaagggcatgctcttgtatttaaaaaggtagagaatccaatcgatgaaaacgtctggacctgttagcaccaataaaactgaaggccactgggaagctcagagagggtctttgttgtagagatagaaagagacccaaactatgacactttcagaggagaagggtcagcaaggaggatcatccatcttcttcagtggcagctttctgtcagattctaaccctatttagtggaggaactaagcctcttctgttgacaccaaccgattctcagccaagtgtaaatgaagctaatattcactgaccttatgcatagcaaatgaagccctatgtgtcatttgagaaataatgttatctgacacttcaaaaagtgagtgacggacagatgtgtgtgtgtgtgtgtgtgtgtgtgtgtgtgtgtgaaataagtaaagatatatccttatccactttatatttttagttgactttcacaataaccacagttttaccattttgacagaaatttaagtttgtattatttttgtttacatgtcatgacattttacatgcagagcttgactgtgctgcagaacaagctcgtttggctttcttctgtctctaaatgcagtgcctagttacagaaagagaagattcagtttctactaataaaagctgtaaatttccaagacaattctgaattactagttcacactcaaaacataatgaaggaatatatacatctttcacattattaaaacatgtattggtcttgttagagatcaagtcaaaaaggcttttttaaaaaccatttttaaagcattgtctaaaatcttttctttttagttagtaattctgttaaaatctaataatctttcttagtctttaaatcaagattttcatgttttgcttactaaggattatattttaaattgcatattatgcatttcttgtttggaaggattttccatagtactgtaaaaaaaattctcacaaaaaataaagtttaaaatatgccagtaataagaaaaatgctgtacataaaaaatattaagtatttgctgtattttgtaagtaaaatattaatattagcagaaatgaaaaatagtgataaaaattaaataattttaaagaatgtatggaatttaaggatttggggaaaagataggttaaagcatagcactggattttctgagtttcacggaaggtaattatctgacacggtagatttcctgagaatcaccaggacagatctgcatctaattgacatcaatcatgtttgaactgaaaataaacagttgtaaaatttttggaatctgtggattgatttttgttcacctcatcagtcttgtttatttgtacttattaaagaagtgaacttgctttttgttctaccaaacttaaaaagacagcatctcatcagtaagatattctcttcttagttcttttttgacaagtatctaaaatcagatgagatcttacatagtttcctcctggcattgttcctgaacctaatcatacagacactaaacatgtgtttagtcagttcttcttattttcctcccacatttttgttaatctaagcacctttctaagtaaaatggtgctcaaagaccacagagaaattatctgtgttgatagtaacttcgctgagttctgacttttctctctctctcatcaattgtttatcctcagtaggatttagttatgatatatatatataaaaggtgcgtatttgagttgtagctttgtttataaaagatatgcaatatctgcacatacagctactaaattcagccaatgaagccattatttttgaagtagtacgataacaaagaataacttgagaagttttgttattgttagtagttgtaatggtggttgtggtggtggattaaattgagctaattttcaaatctttagaattgcaatagtttgtctaaaaagtcaagataaatccgatggacacaattacatgcaaacacatacactcagaaatgacaggagcctcttattatggagataatttgtataagtgatctacacagtctagtttaactctactcgtaaaaatttatgaaaaagctgtctggagtacagatacaatttgctgtgcattttttacattaatttgtgatggacttttttttcagaaacctcattcaaagagtttccataaaagaggggaaaaatatgatttggctaaaaggcagtggatttggcttcatggaatcactggttaatggatttagccaggtgttcgaatctaaattgaaagggccaattgtactttatgatctgcagaagtcatattagattagtaacactgaggtttagaaagcaaagtggcatttcatgctgctgtcaagtaagtttctacccctttgccctgggagcttagagatttcagtctagttcagtcctagcccaatatagggttttaaaaaatatgttaatcagtgtatttggaatcataaagtcttctgttaactttctaaaattattctttactgaatcatttgaaccagtgatatcatctcactggacctcttagtttaatctgagaggcgttttttttggatggaaacttctaagactaaaagggtactaaatatatttcatatactaatttaacaatcattgattgaactacatcactcaagattatttaggtactgtatttacatatgatactgatttatatttcagatatttattagccaaacaattcctaaagtcactaggattctaggttctggaaagctatcatagctgagggctatggtttgagaaaaagatgccaatagagggttattaaagatgcctaaacaattcacatcacttcgacatgaattgtaatttgttaaaacaggtcttaaaaagagtttcagaaatccttaaatgcagtcagactgtagaattgaagcacccttattcaaagttgattgcaattacagccacatatgattatttaatgaaatgagatttttttcttaaactagtattagtttcatgatcctgtgaaaagtaaggtattactataattaatttaataaataagtttatgtaattgttattcctaataaagaatttctgtttctattcattttcaaagaaatattgaaaaatatttaagaaaattgattgttgatttcatattttatgtttttgtaaagtccttgtctgaaaaatatatcaaaatagacattatgcatattgcttttaaataataaatggtgttttattatgtaatggataggtttgacatgcatacatttttcaatatgaaataaattattttgcatttaagccattaaaatcaacctattctttggtggcaatttgctatgctgtgttaaagaatgcaaaatgttattttgtatctttaaggaattacttgtagaaaaataaggtaaatggatagtatgcacttttaaatgcattttatttttttctgtttaaaaatgtatttaaaaatttgataagatttttgtcatataatcagttagagaatcatcaggtgaatagtgacatctgtaactgagagccatggaatttgctgtttttttcttttgtgtcgatctggagggaaaaataaatcagtagttcctatacctggtttgacatttcccaccttttcctattgaggcagccaggcgaaagcagtcaggacaactgaaaaggtaaccatccctttgagggcatggttgattttgctcctgattcttactgtgctataggggtcaaggatatctggaaaggcttgacctgtgtttcctgtcaggaaaagtgggtgattttcactttctacgcctgcagatctctggagttacgtgtacattggagtttactcttcactgctttgtcagcatagctgtggctttcttcagcagttgtgaaagaatcctgagatggaaggaattgggtgtaaaaattgcgttattctgtagagcaggagaatgtactgtataattttttacaaatttagattgtgccatatgatttaaaaaatttagattattccattttatttaaggaaattgagtctaacgctgtctgatatgctccaaagaattaacactataatgagtcaaaaaccaactacaactcagagtttatatttttagttttttttttaatctcataaaccgtgaagagtttaatttttattctatttttaggtaattggaaggtaaattcggaagcaataggttagaaagtggagtattttttttctgttgcctgtgtcttttagctaggtaactaattaaccagcttccccttcctctgtttctccctctcatccttccacctttctgtctgtcatttgtattcataaatataatagagagagttcataaacctatagatatattcataaatatatagataattttctcaggtcaagaagttctgtagtaaatccttttcttaactgtaacttttctttgtgactggaggaatagttttttagttttgccatgttcaggctccttgccttggtccttctctgtccttttctatggaagcatcaacgtccacatgagaagaggttatgttcatatacaagaacaatttgttcttggtaataccatataattatgtttcaaaatttgaatattgggaagtattttccagttttcttttcctctcttgccagttgtctcttttggtttgtttcttagatggtgataccatattagtagtttctcaagtaaagatgccacagaagtttccatttccacttttattcctataatgacctctcttgctccaaggtgtagttccatctttcagaacctccatgaatctctggagaggtagcacctgctagaaaattctgaagggattgtacttttcagagtacacttataacaaggctacagggattattagactagatttaaatacttgttgacaatttaaattattaccaaaatttaatgcattttaatgagggaaaatgattaaactgatgggaatgtaatatattgggggattaggaattctgcagtgcttcatggagagtagatcaaacacaacaaaaatattggcattaacgagaattcagtactaaaaagactgttgggaaaaatgtttggaattaaaaccaattcaatttagttcaatcaacatttcttgagtgctttttgtttacagattaactatgataaattttggagagagagataaacctgcatgagtttgtaggttgccaaaaatacttaaaactaataatgttaacaatccagcaatgcattttcaactccatttgagaaattaaattttgttttatttatttcctttaaaaatgccaaagtaacaggaaaatagaatagtataatgaacacccttatggtcttcagacactctaattgttacaatttttctacatttatatccccactccccccagccctgtatgtgtataaactttttttttttttttgtcctggctgaaccatttgaaagtaagttacaggcatcatgacagtcaatgcctaaagactctagcatatgttctcaaaatgaagatgttctcttacataaacacaatgccatatttaaaatccaggaaatttaatatttattttaaaatttatcttaatgtgtagtttctatgtagttaatatgccagtttctgacctacttcaaattgccttttttatggctgatttttttcaattcatgattcagttaagtatttcatatttgttttgttgacataatttttttcttttcttgtaatttgaaactttcattcaccttttttttttactgtactgattttttttttgagaatccagaccagttaccttttagaatattccacattgtagattttcttatttctttaaatgttagattcaagttgaattttgggggcagggatacaatatagttgatgtggtttactttccattgagtgacagcatgctgctttgtctccttatttctgatgctaaagtttagtgattttgttaaaccagaaccctgtattataaatttacaaatttcagtgatacttggggacacagaaattttccaattcactgacaatcttttacaaactgctttatcattaagatgtcaactggaatcatttgttacagatagtacaaagtgttgattttgtgtatcttattccttctgtatttattgttttattctgtaagaaagttttttctttctctagtcccaacttcttgttgttattgttgaatagtgctgtggactcagattccaatatcatttttttaagaaaactttcatctttttaatttctagttgaagaagggtgaaattaagtattcatttacttttgtggcagttcataatttttaggattgaaattatagctaatttattccaacgtttgttctatttttacttgcttatttttcctctgacaagaatttaatgatactttacttttatgcatcttttgtaatgcgtaaataagtattccattttcaggagactttttgagacatatttcagattagattgacagcataaccctattaaagtaagtaaataattatcaagaatatttcttccagacgaatagacagaggtgccagtccagaacccaccacgtgattagctgtgtgaaagcgaaagctatttaatctctcaagacctttgtctcctactttcaaagtgggaaatattagcagtatctatttcaagaggttgtgtatggaacaagtgatgtaatacacacaaagtactagcacatagaaaatggacaataaatatgcataaaaatgagatgatgcttgtaaagcatttaacacactgtctaactcatggtaagatatcaataaatgttagctacaattgttattctaagaattgctttctgggtttgtattttggtaaatgtggctggaaatgatacagaaatcttattgattctctctccaaatatctccaaaatctattctgtcaatttctgtacatcctactgcactattttggtttaagtctgtgtcttatctatcttacagagtgtcagtagcctcctaatttatttgtgtgcatttgatcttgctccccttcattattttttctactcactctccagcgtcattttttaaattgcaaattcaatcatgttatgattttctttaaaatatatcatttcctcccatagtttctaagatctttcttaatatttaatcaaaatcctttttttacttacctttgcttatctttttatgcatcacctaatgacactgaataaatatcctaaatgttttattcccccctgtgattataatatattgtaattttctgcctggattgttatctctttacagaaggttcttctaagcttatcacccttcactattctccccatttccttctgaacaagcccacagtcgtgctggtcagagaggctttcaatatgtacccactttactgtaatgtgccccattagattataggttactacaaaataatagcatttctttatatccttcacatagcaccctgcctaactcacctaatgagtaaatagaagagcaatgattacacatataaatgaagtcatttagataacttctgtaaagcaggaagcaccgattatatgtccttatccaaaatgtagtgaagtaccaacaagtgattttgatgatggtaatattgataataatagggattctcttccagggtgagaaaatgccttttgacttttgaaaagatgtcaacttaaatgtccaagaataggggattaagactattatgaatatccttatggtgaaatgtcattgaaactcttaaattatgtcattaaattatatttgctttcatggaaaaatgttaatgatattagactaaggaagaaagaagtgcacaaagtaatgtgatacatgtttttaggaaaagactggaggaatatacaagataatgttcatgtgggtcatcttttgttggtggactatttggattactctatgttctttatattttcctcctggatcatgaattgctatatgtacatgtgtatgtctctgtgtctatctatctattctatctatctatctatctatctatctatctatctatctatctatctatctatctgtctgtctgtctatctatctaagatggtctggctttatgtcctacaccaaatctcatcttgaattgtaatccaccggtattgggggagggacctcatgcaagttgattagatcatggaggtgattaccccatgctgttcttgtgatagtgagttcttatgagatctgatggttttataaggtgttttccccccttcactctgcaattctctctcctgctgccatgtgaagaaggatatgtctgtttccccttcctccatgatcataagtttactgaggcctccccagctatgcgtaattgtgagtgaattaaccctccttcctgtataaattactcagtttgggctatttcttcatagcagtgtgaaaacagactaaaacagtcagttggtatcaggtagtggggtgctgctataaagataccctaaaatgtggaagtgacttaggaaataggtaacaggcagaggtttgaacaatttggagggctcagaagacaggaagatgtgggaaagttgggaatttcctagagacttattgaatggctttgaccgaaatgccaataatgatgacaatgaagttcaggctgaggtggtctcagatggagatgaggaaattattgggaattggagcaaaggtgacttttgctatgctgtagcaaagagactgctggcattttgctcctgccctagagattggtggaactttgaacttgggagagatgatttagggtatctggcagaagaaatttctaagtaacaaagcatacaagaggaaacagagcatacaagtttggaaaatttgcagcctagtgatgtggtagaaaagaaaaaaaaattttctggggagaaatatgctgcagaaatttgcataagtaataaggagccaaatgttagttgccaagataatggggaaaatgtctccagggtatgtcagagaccttcacagcatcccttgtcatcacaggtccagaggcctaggaggaaaggacagttttgtgggccaggtccaggacccccctactgtgtgcagcctagggacttggtgccctccatcccagcccttccatctgtggctaaaaggggccaaggtacagctcagaccatagctttggaggatgcaagccacaagccttggcaacttccatgtggtgttggtcctgcaggtgcacagacatcaagaattgaggtttgggaacctcctcctaaatttcagatgatgcatggaatcacccagatgtaggtgtggagccctcgtggagaacctctgctagggtagtgcagaagggaaaagtggactggagctcccacacagactccccactggggcattgcctagtggagctgggagaagagggccaccattattcataccccagaatggaatatccatgaacagcttacacgtgcacctggaaaagccacaggcactcattgctagctcatgaaagcagccagaatggggagcccccctcttacatcagcgtgacctgaatgtgagacatagagtcaaaagagatcattttggaactttaaggcttaatgactgccctattggattttggacctgcatggggcttgtagcttcttcattttggccagtttcttccatttggaatgggtttattaacccaatgcctgtacccccattgtatctaaaaagtaactaacttgcatttgattttacaggctcatagtcagaagggacttgccttgtttcagatgagactttggacttggaattttgggttaaagctggaatgagttaagtctttggggaactgttgggaaggcataaatgtgttgtgaaatttgagaaggatgaaatttgggaggtgcccagggtggaatgatgtggcctgactctgtgtccccatccaaatttcatcttgaattgtaatccctatgtgttgggagcagtccccctctgctgcccatgctgttctcatgatagtaaatgagttcttatgagatttggtggttttataaggagtttccttgactccactctgcacttctctctcctgctgccatgtgaagaaggacgtgtttgcgtccccttccaccatgattatgtttcctgagaccttcccagttatgcagaactgtgagtcaattaaacctctttcctttataaatttctcagtcttgtgtatttcttcacagcagtatgaaaatagactaattatctatctatctatctagctatctaatctatccatccatccacacatcaccatctctatgtatatctaatatatttatatataattttacaaagaaaaagcctcatgggagtagaacaagacaaaattacccatcattgtctcattcttcagtctcattaataagtggggtgcaagtacttttttggttgttgttaaataaaaatatgagataccattgtagttaataaatatagggttttttattttcaagaatattccagtataaattaaaaaatgcaatctggaccaatttatttaatatactactataaatgtagaaggaaaacaagttttgcgggagttaaaagtatgaaagcgtttgatttttattattcctttctgactgctagatgacatagaggtggattatttagacacactgtattacataatatgtaaatatctattatatattcatatgcgtacacatatattttttctcttctattaatactagttcttgagctattgctgttactaataaaccattatacatttgcaatcagttacattgttttgtgggaatgaatttcatttatagaacaacatgcaaatgggtagcatgagttctaatagtaaatgtgccattttatgtaaggaagaaattggtatataatagtgtattaatccctaaaaggaaaccaaattaattacatagctaataaaaggaagtgcatacattgctataatcttcttcaatggcatattaaattttgccatatattttatattacacacatatttgtgtttgtagtgcaactagtttttgatggtctgttatttcatattccaaatctctgggtttcttccttctattgaaaatatagtaatatagttttttaccttcatgccattcagtaggtttgttttaagaaattaacactgattttcatgctaaattacaagaaatattttaagaagacaaatcgttcaataacaagttacaatataagtcagaaattaattctaattaaagtgagggaataaatttcaaggagggaacaaataaggtctttcaggagataatatgtgcattgaggtttaatagacaaatgtgcgatcctgtgagggcacttctaggcacagtgagcatgatgaacaaaagtgggtgacatatgaaatcgcagctcttatttgatgatcagatagctagggcttgagtgagaaggattatagtgataaagctaggaaagtagaaaagttgcattaagttctggagggctttctatgttgtaccaaagaatttgtactactctttgtagttatggaacaatggccaagaattcttaaggagggcataatgattaaattttggctatagtaataactttaagggaagttaaagttattactgaatactgaactagatatgagagaggctgaaggcaacaacttcttttggaaaaattttaggcaaagactctgagctaagatcctgttgctgaaaatgggagagaagggagggggatgtgttagggacacattatggaggtagaactagtgtttagtaaaacaatgagatgtattaagggtaacacatgacattaggtttctgagtttattttttaactattctttttaagccaaattcacttcagccaaactaacttggtcaataattttaatatttttgagtgtgcttattttactttcctgatactgattttcttccatctcctcataaaaggtttatatattatatgtcctccaaaaactcatgttggccatgcatggttgctcatatctgtaataccagcactttgcggggctgaggcaggaggatcccttgaagctaggagtttgagatcagcctgggcaacaaagcaagaccttgtctgtacaaaaaattaaccaggcacactgacactcctgtagcctcagctactatgaaagctgaagtgggcagatggcttgagcccaggagttcgaggctacagttagctatgatggtactactgcagtaaactgggtgacaacaagacattgtctataaaaaaagaaaaagaaaaacctcaactattactcctccaggaagccctctctgatttttatgatcaaaactaatatctccttagaagtcccagaatattttatttttacatttttatgacaaataaattattgcctaagatattacattttggtggtgtaatttgatgtaatcctaaatgcaagcccttagaaatacattttgttggtgaagtgcaagagttcagggaccagcgtttactctaccacttaccagctgtgaccttgggcgagctacttaatctcacataactttaagtttcctcacgttaaactgaggaaccatgatagaatctatgcattgagtgacatccaagattattattaacattaaattatacacacacacacacacacacaaaatgagttctgatataagtcattgtacacacacacacacacacacacacacacacgagttccaatataagtcattgtatattttatatatatgtatatgtgtatgtatatatgtatatatatacacacacacacactacagtgtaatgtccttggaacaaaataaatgcttggtaagtgttaattattgggtagcatgagagtttatgtttgaattatttagaatatttaagggagtggggaatggagattttcttttaaatgatgggtccatcaaattaagctctcttaacatcgggctcttaaaacaggataaagacttgttgattgggttcagtggacaaagagacggaagcagtttcaaatactcactttccctaaaatctccttggtcattcagaaagtcaagtagtttttcttagaatgaatgtggctctggatagtggctgtgtgtgatggtagtgataccttttgaaaatgacttggctatgttgggaccttttcatggatatttttaaaaagagtagtggtagaaaaagctggaaggacaagttagattaaatcctggtgggagagtttttcacggacacccacatggagcgagtaggatctcattgtatcgcttaaacagtggtgagggaaaaaacctcgttcagtaaaccggggactgaatggtaaggtggggaaatggctggaataagaatagagaggtgtcatgaagaaagaagagaaatgacaaagcaaacttgttagcagagtgaataaaagtttattcttaaattatttatattgtctatagcaggggtccctaacccccacctgcagacagtagtggtcactggcctgttatgaactgggctccacagcaggatgtgcggggcaggcaggttcattaccacctgcgcttgcgctccttttcctgtcagatcatcatcagcattacattctcataggagtacgaaccttactgtgaactgtccatgtgagggacctaggttacatacttttaatgagattctaactaatacctgatgatctgaggaggaacagtttcatcctgaaaacatcccttctacccagcccccaccctggcacccatttatggaaaaattgtcttccgcaaaaccagtccctggtaccaaaagggttggggaccactcgtctacataataaggactccaccttctttatactgtgagataacaacatttgagaggttagttttaaggaatttttctatccaaagttttctaaacttattggattggtataatgtgtacagttgacttatatcaaattctttttatgtaattcttagtggtatttggagcaatgtttgtgaacacatttggcgaaatgattatctaggcatagaaagctggattaaagtggaagaggaacaagatacaaggctgagatcaaagtgaggaatttcagaatttgtgactggaaatgaaaaatttgactgctgatgatgacttaagtatggctgtgcttgttgacagatggaaatgccatcaatttctctctccaaaagactgagcagaggaattgggatgagaggatcacaggtataagaaaaaaaaaagaaataaaaagaaaaaaatctttgtcacagaattccaggatgtaattgttttttctcctaacttgtcagtttatttgttccaacaaccattgacataaagcttgtaaactttttaatttgtggttaattaaatttgtgactaatttgctgtttattaattatccatttgttataattaatagatacatgtgttaattatgatgccaaaagtagcagcttatttggtctatagaataactcaaaaaatcctagtttttaagggccatattttaagtgaaaaagattttctaaaatataaacctttagtttgtttcagataatgtaataaaacacaatatgatcttttagagggatattgcattagatcatatttgggttccccacaatttcttcagtcctagatttatgaaaatgagataggtatcacttaattatacagtaacttaaaataataaattttattgcttattttcctttcaggtgagaacttattgcactaaagtttctcaatttgtaattgtgttgtcaaggacagatgtgcatggagcactaaaaatagataaattttaaaatggcaaatgtaaattctttgaaataaatatacccgataactgataacattcagaaaaaaataattatgtattgtatctaaagaggtctttattattttcatagaagatatatctgaaaatattcaggaggcattgcttaatggcagctgaaacaagtgaaaagcaaatggaaacaaggcagtcaccgtctgcagagcttttaatagttttggtgaaaaattaaggaccacctgccatgttgaattttatgagtgatgcagaggtacttgccaatacattcatgaataagtgaaaaaacagggtttttaatagtaacacaaaccttcaaatggagttaataaaagacaaggctcttctttactgggtggaaagttatctgctatatagaaaggcctattgaatgaaacatttgtcctcaaattccctttaatctactgtgaggttctgcctgttacctcacttggaataatgtgccaattttgtaaggataaggagaattttatccttttttcattcccttagctatttgctgcagcatttccttgaatttcacagtacctgcctgtttttagcagctctaatttcagactatcactttcctgaactaatgtgtaaaaactgatattctcatctttttgatggagaatattcacgaaatgcaatcccagtgagaatgccacttactaatggatatttctttctccggacatcttaaaaaattctgttcaactctttatacctcttgttctttataaaaatggattaaaatgcctggtaccatggtggaatgcttttattgtcgcatattgcttttgtattatatactgtaagtggttattgttcacatttcatgcctttaacagtttgagttaaactatattttcgtttccccctcccaaagtatttgtcttgtggcagtttagaactggagcgcaggaattatgagagatattattagatttgatgtgtttggtctttactctttgcttttctaagataattgggtactgctcctacagattgaaagggttaaatggattaataatggattttttaaaaatgttgctggagaatgaaatctgttttgtcactgaggcaagaaacccagattcttcatactaaatcagggtgctttagttagtatggaggaatgttaaaaacaaacaaagaaacaaaatcttttcacagttttaaacttgtttttgagcagattgatactgggaaatatattgattctaactcctaaaagcattggtagaggaactgcatggcaaaaaatttcacagaatctctaaatttcagaactttggtgtatgtttaggttattgtttgatgtatgcctgctgtatgtctaggtgtatgtctttagttattatatttagaatgaattttactaatggactcatcactataatttcaagaacgcttttatttccctttattgttattttagtgattatggtgacattcattctgctattattaatagctcttttttcactcttgaaagggtcctggtttgattgtataatcactggccgtataaaccttttggcattctatttccacgtattttatgtttccaaaacaatcacttttctaagtgtattcttgcatattttagctttttaaatataaaaagttattgttacatatcgtatcccaagttaaattgatcttcatgtatctgataattacattccctaaaaaaagttattataatgctctaaagttaagttattaaactgtgactcaaatattcatatttcataatagcaaaatgcccaactataatttttggagccaaatctagagctgaaaatgtaaagcattttatagaattatttgtcaaatttaattaaatggaaagaaaaattatgttttggaggaagaggcaattcaaatttttaatttttctttctacctaccagaattaaccttcaattagagtaagtctgtattaaagcaaatttgatttttatagttcattacatatttatgttctgatcatagtgccaactatcccatgtgtaacataatttttacttgagtaatgctaacgtatttctttttcttgtattacttatgttaatataaatacttgtttataattttattcatttcagccatattcaatatatgtttgtgtttttcatctccatttctatgtggaatggctagtgaataaaatgtatacatttatgaaatgattagaaaattgtaattgacagtaatgaagtaccagattgtacagtacacaccaaataacacaagactttgacagaagtttagaagcagaatccagaatctagaattctaaatcctgaagcaccataatttactagaaacagaaatggattcagaaatgaatgactgggttctaagcctatttttactacctagtcatatttcaaaatatagtaagttacttaatctctctgagcctccacttttgtaatctgtctaatgtgggaactttacttgtcttgcctatctcatatgatgcttgaggaccctacttgcaattgtaaatcaaattgcattttaagttccagtgttttaaaatggaatctgcttgatgtattctggataagtgaaaagtataagagtagagactagggaatatgttaaacatctcttgatttcccttctcaaagattttctcgatgtccagttcccgctaaactaattgatgcatactgcctcagtctgccgtcatcttcttacatgtcatcttgcattaccaccgaagccctcccgttagttttctgcctcttgctaatccatcatggctacagtaatctttccaaatgcaagtcttatcataacactatcttttaaaatcccttcagtagctttcttttcctcttagaaaaaacaacatcttacctccttttcctgtctctcttttcagctctgacctttgcctctcttccacttgtatttggcacttcagccactttgacattgcctcaaggcaccatgatcattgccttagatgtgccatgatctttttcctctctattagttatttgcctatgaattgtctctttccagtctcttgaatatctcttacattttctgcaggtttcagttataccaaagacaccaactgtccatgtttctacagtgatctcctttcataacacctaatgctttattagaatggtttaatttattattggctttctacaaactgagaggtctatgagggcaggaactgtgtctgtttttcttcctacaaggggtctagttcttagcataataagaacataagaagtacccagaatatttcttgaatgaattagcgaatgactgaaacaaatcaggaatgtaggatcctgaatgaggtgaagtatgataacgatttgacacagagttactgttatgagagggtcaaaagaataacaaacaggaattgattacattgatatgagaggtagaagaaagtagaaacttttaagttttctgctgttaaaggaatgacaaatttggagggagattttcttctggttttccttttgaaatttgaaatagggacactgatataagataagggatggtggaaataacaatagttctgtcaacttaaatctatgtagcacattttttttttttagtttttcaaagcttttttcttattttacagaattatttcaaagttaatttccaagcaaatcatctagggaactttgaagaaaacctaatattttaaaggatgaaactaacttttctaatgaaattatggttttttttgtttaaatattttgaaaaaaaaactagcaataaccattatttattttgtttagttaggatgggctctattacaaggacatacctggagcctagaagtaaaactgatacctgtttgtattaaaacagaatttctcaacagtagcactattgacattttgtacaggatcattctttgttatggaaggcatataggatgtttagcagcatgcttgatgtctaccaactagataccagtaacagacctcctccacacccagttatgatcatggaaagtgtctgcagatattggcaaatgtttcctacagggcagaatcaccttcatttgaaaactattgcactggagagttagaaattatattccatagataagaaaatttgtaaagtgttggagccttgtaattatcatgtaaattttttatggatctttgatttcctcatggtggttatatgtaaaatgtaaagcatcaaggtgattactttcagatacttccaggaatgcggaacgctagggatgcaatgctgcttgtctcaggaaacatagacatccgagcaatagagtaggtgatgagaacttaagaaaagaaagacaattaatttatgttttgagggtcttcctcagagatggaaggagaaagcacctgagtctgcccaaatctttaacttgaagcccagggctgaggagtcaaaaagctcttacatttcctcaaatgtggggcttccgttacagggtatgcatttatgcatacaatctactttatttttgttcaaatacattgatacggaagacattaaatgttattttataagggaaggacacgattttccagacaatcagctacatgtatttcagtagttggaagaagcatcttctgcttctgttctcatatatcatgatgatcagttatgttctcaaagaattcatgtcagttatttggtggcagactttcagtgctgaattggtttatgaaaatggaccaggcgtggtgacttatgcctgtaattccagcactttgagaggccaagacaggtgggtcgcctggcaccaggaatttgagaccagcctgagcaatatagcaaggccttgtctctaaaaataatgttaaaaattagctcagtgtggtgactcatgcctgtggtcccagctgctcaggaggctgaggtgggagaacttgagcctcagcaattgaggctacagtgaatagtgatcataccactgcacttctcctgggcgacagagtgagatcctgtctcaaaaaaagaaaaagaaaatgaaaccccacacaaaaaaatgtgtcccctgataattactggtgacagtatagcagtgtgccctctctcttcctctcttgattattttcagactcattaatgatgagatgaccaacccccacctccttctgactatcttctgccatgtccacatggcataaatcttttataatgaatgttctgtggacccactggataggagaaataacaatggaagaaattctaaaatattttccttttgtgatcatgaatgaggaaaatgggagcttttgtttttcttagttgcctttagaagaaaaattgtcagattccttaggttaggtgggaagcagattaacagcaaattgtgtatagagacttacatcactgtttagggtagcaaagaaaaagcatgaactgacttcaaatgtaagttatattttcacagaactctattcttttttcattacttttttgattagtgaattttttatctatactagctgcctattaggagtttgttttttttttttaattcaggcttccaaatcttggagttttttttttgtttgttttttgagtcaaggtctctctgctaggctcactgtaacttctgtgtcccaggcctaagtgatcctcctgcatcagcctctcgagtagctggaactacaggcacatgccatctcactattttttttatttttatttttttttagaaagagagtttcaccatgtttcctgggcttttctcaaactcctgagctcaagccatctgcccaccttggcctcccaaagtgctgggattacaggtgtgagccaccatgcttggcctctctgagtttttatcagtcttgttaagttgtttttgttgtttggttttacatttcaagttacacatattggaacatgagtttggcatactttcttccattatagagtggagggtagagttgtacttctaccaaaataacatgctaaacaaagtaagtttatggagatcaataacagaaggaaaacaggcttattttcaaatgaatattttttaatgatattattttcaaggatccagtatacattgtttccttacttgttgaaattattaaaggaatttctaagttgaaactttcagacatttagttacatggtttatataatgaggcagttaaacagattgcaaaaatgttaaaaactattcagaaatttttgtatgttatggaggaagcaatattatcttttttgaaatgatattcttcactatgttataataattatgatgataatattaactgatatgtgtaaattacttactgtgtgccaaacactcttacattgttctttaatttaatcctcatagtgatcctattaggaaagtgtcactattattcctgtattacagatgaggaaaccaaggcagtttcctattggtgatctaatgatggttctagcacttgaactcaggagttgaactcaaggtgtttggctccatagccagcagtctgagcgactagtctccactgttgtttaattattttcttaaccatccatatgcattcacagatacaagtttcttctattttggcaaataaaattacaatgactataaatatacataaaaccacaacatatttggcagtgtcaaaggttcgctagtaaggcatgacacttaaaaggaagacttaaaatgattaaactgtgaaatataaaggtaatatatttgacacttctacatttagttagaaaaatatgatcttgcaagattttagtgagggtataatgtactcagcatgagacagatagatgatagagagatagaaacatagagtatttgtctatgtatataaattcatatctctattcttgtctgtagtgctaaaatagaggagtgggaagacagatgagggactcaattacctaacccagaggtcagatatggcttcactaaggaggtgacgtgttttagaaatttagcaaatatacctgtaatgactctcttcagggagttagcactacatagtgtactccttcatagaactatctctagatttgacctgaatattttttttaaaagctctggttaaatacctctagtgcgacttcatgttattttgaggctctctgttggttaggaatttaatattctgttacattcttaataattcttctgacatgttatacatttttatttatgtagtgttatgctttatttctctgaaaattaattgatgtatttatgaaacatgaggtatattgtgaaagcctttattcctttatgtactagtatatgtcaaatgagctttgaagtgattttttttttaccttttgtaaaacatgtaacaatatactaatccattagtaaatggcacacttatgttaagcttgtgattattcgaaagagaatacaccagaaaaaaaaaagaagagtgacaaatagagcataaacctttgtcattctacagaaatagctttggagatattggtgaatcatgagagctaaaaatactactaatcttgataccatcatctaagctctctaattaaactgtctcacataatactgtgtgataatcctatatggtaaacaactggcaaaaccatgaaatatcagattccagagaatcatgagtagaagtcaatggcaagagtgagaacctattccatacaattttcacaaatgatattgaatataagaaatgcagtgtaaaagtactaaattacacgcaagtttccctgacctgccttatggaattcaccatttctaagaagtcagggcttctgttcttgactcaagtctttttttcacatgaccaagttattgaacaattactttacacagaacatttagattttaagaaaaggtcaagaattattgctcttggagatgtctgttaactttgtaatttttcccttttgatattgaagcaataaagtagaatttgtgattattttaataaaattaaatataatataaagagaactagtggtttctagctgttaattccaaagatatattactataattattgactatatgtcaaaatacaaatatatcttctgttatataatcatgtatcacaattaaatatttgaacagaaaatgtatgtattttaatccagacaactattttgacaattgttgaagacatatgcactctaaattgtaagagtatataccataattcagaaggaagtactacattttcagaattctccatctccttttagtataattttgtttaaaaaggtagtggaagaagtaatttactaaaaaattaatgaaatcatgatatagatattaaggcaaagccaatgtataaacttaactattatatttttcatgtgaaaagtggaatgtttaaccatattgaatagcacttaggctgttatagctgcaagcacaatgcttttgagttagtcactcaacacatttcatcaacaaacagaaaactatttaaaagtttggacaacctatgccatttgaggccataacttagaaggaaaatttataaagcaaagatgtaatggaaataacaatcaaaaagcaatgcatcttatcttgctaaaaattgttttctctaaattctaactttgtgaaatattttatagcattcaacactaatatatgataagagtaggatttcagtctgggaaaatcaaaaaccttaaaaccttattgattctatgtctagacattatcttttaacatctgtagcatgagaagattcactttctagcctcttatttaaacagctgctaacttaaactgcaaaataatcatgttgaaaaatggcaaaaggaatagtcatactcttataaggttgtaactcccctttctgtaattgctgatatttggcaagtattaccctttgttttgctgtgccataggtagtatgctcattatggtgaaatgaaatgaaagcataaaggaaatgttcaagcatcagatacctcctttatcattggtgttcatccactcacaaatgtttatttaataagttcttatacaatgcttgattattcctaagtaatataaagataaatcattcaccccttagcttttagatattctgtttatttagatgcatgtaaaactagttttcttatcagtcttttgaacatttacccaaaagggtaatttaacttaaatgttgaaaaaaaattgattctaaaaatattgtctgatccattccacctggtatccatctgtgacagtatgtcttcacaatctgtcatctgcttttatcctgtatgttcttaaccacttcatttgggtgcaatctttgaactgattttttcccttccttatttctggtgttctggttagtataaattgacattttcaaatctttagtcaggttttgggatgatgtatactaattaattaggaagatgtaatgtaccatcagctctctatacatattcgtttatagcaccattaatatagaggtagaatcaatcattatattctagtttttcatttcctttgtaagaactttcaatgcatttttatttggaaatgtatacatttactttatcatcatttcctatgagaaaacagtacttcacttctaaatttctaaattctttcagattgaaatatatgcacacataggtgttgagtctaatactttgtagcgcttgtcattacagttgcctctcagtatcaaggggggtgagttacaggatccccttggataccagcatccacagatgcttaagtcccttatataaaatggcatatatagtatttgcatataaactatacacatccttttctatactttaaataatctctagattacttacaatatctaatacagtgtaaattctaggcatgtagttgttatattgtgttgtttttaaaatttgtatttttgtattgttgcattattttttgttatttttttccccaaatatttattatccatggttgggttaatccatggatgcagaaccagtggatacagagagctgactgtgctttttctttttttttttctttttgagacagagtctcactctgtcgcccaggctggagtgcagtggcgcgatctgggctcactgcaagctccgcctcctgggttcacagcattctcctgcctcagcctcctgagtagctgggactacaggctcccgccgccacggctggctaagtttttttttcttttttttttttttgtatttttcgtagagacagggtttcaccatgttagccaggatggtctcgatctcctgacctcgtgatccacctgcctcggcttcccaaagtgctgggattacaggcgtgagccaccgcgccttgccgactgtgctttttctgagttcactctgaatattaaggtactttacagttttgcctagtttataacttgaaaaatgtaaagtagtatatgtacatataaataagttttcacctttagttttgtcgtgcccctccataggtcataaatcaaatgaattagtatgtcttagagacatatgaaatgtaataggaaaccaaatgtacagaagggtgtgtgaatatatatgtgtatttatgctcataataaaagaaaacaaaagatgtaatatcccattgtttttaaatcagtgtttttgcttactctacaattgtttaaatatttaaaagagagccagtaagaaataaattgaaattatttttcataagaatcagtgatatttctgttttccaatagaaatgttaattattagaatttattttaatagtggcctgtctagttccaaattaccaacagaaatgaaagtattgtgtacttactgtatggcaattctcagtaatctaaaactagaatattacttttttgggtttgggtaggtcatgtatttaaagaaagatagtttcttaaataatccagagcaggaaaaaactattattctttaaatttttgccttggaaacaaccctgaaatgatagttttgttataacttataattctcagcttagttgttttccttctcttggaccttttctcccctgtgttcagagaaggtattcaattatatgctcctaaaatgcttttaatttcattcgtatactttttgttgttactgtattaaggatgcttacagaatcatgttaaaatcatctaaagtattagtctaaacatggctgtgcagttgtctccctgtgcagcataacagggagacttaaagactgaaagccagtgaagtgtctctccttacttctgtagccaaggctgcactcccctctactaagaatgtgccacatcagtcctattgctctgatgactatgaaaaatttactaagtggtgtcagtgaattaacctttggtaagtgggatggtgtcaccagatgcataatgctggaggatggataagattccttcattcgtccattcaataaacatagattaacctcctgctatgtgctggacattgtgctaggctttgggaatccatggatacatatattataatccctgaacttgagggtttcacggtgagttagaggacacatgcataaagaaataattatggcagtgtgaatgacatagtggtggtatgttgtattgagtgaaactgttctcctaagtagccttaagagctcagaaaagatggaggaggcaaagcgtttaactgattcatgaagaatggatgttgctcttttaaaaagaatgaaactatatagggttattctttacatatgtagctactttttctgcagagtttgttttaacagacaattaaatgatattctgctactggctacgttgtctttttgcaaaattctatggatgcaaagttagtaggataatggatacaaagagatgtggcaaattatttacttgggtgtggaggtaaaaatcagcaattaattaactggttttctcttatgaaggagtagaaagtatgaaaatacagtcagaattcttactagtttatttctaaaaattctatgtatcttgcaagtgtgtgtgtgtgtgtgtgtgtgtgtgtgtgtgtggcctttatttttcttttcttttctttctttttctttgccagctcttttttttaaaaaagaaaggattgagctcaacaacatttttctaagcatttattctgcttgttattttcttttatttctaagaattaaggattgagtgaatacactcattgtcctgacgcatccatttaatatgtcatgcttcagggtaaactgatttctttatgatctccagaaaattttccactgacataacagaaatgattatttacctccccacatgttcaaactgccttaacctgctttagggttatttgcttcacaagacttagtattgatccacattttataactgactaaataaggaaacagagtcttcaccaaacagctagaacgattgctttaactgacaattttgctttaatcatttttaaaattatcgcagaaaactgatagtgaaaagcccatgtcttggactgctttgcatagaagtatagctctttattttaggaaattaagatgaaattaattatcttctttttagctgtggatttttcaaggcttgcaccacaaatatatagatttaaatatattatgggagaaaaattaattattgacaagccactcacaagatagtccaattttaatccttcgaattggactaaagttgcaatttttattaacttgaagtaacctgaccttatagaatattcttatattgccagatccttcattagcctcattgaaaatcaagccaataactgccacagatagctctccagtttatatataaaattggtcaataatgtgtccctgcacacttcctgcatgtctacctgtgctgagtagttttctcatttcacattgatgaaatgctacagctttggcaggaaaggtgacttcagaatttatagtcacctctgaaataggagataattgggcatgctgtaaaagatacaagttaaggtacaatgtttataatttatataagtaatttactattaaatatcagaaatttaattagcttaagctcataatcaactgattatccataccatttgaagccagtggtcaaaaggataatgtagtgtttagagatcctcattatttgtctttttagctgatatacctttttggtacattgcctgcctgacacagtaatagatacacagtatgcaaataataataatttggtcgaggaatgaatactgggctatatttggttaataactaatttgtatttcttatttgcttacacatttgggaatagggaaagtggttcagaggttgtctggggtagaaactacagtgggatcaaaactttgcttggaaattgacattgtaaaatagtcacagtacttaactaattattgagtgcttagtctatgccaggcagcatactaagttcttcacgtgaactatgcactgtaattcataacaatcttataagatagtcttattattattttctctattttatatatgggaaaactggactcagaacttgagcaaatttgtaaagaccacacagtgaatacgtactaggagagcagccagtcttataatttgtgtgtgtgtgtgttctaacagtcttataattgatataaagaacaagccatcctacctctttaggatcattgaagtgagaccttatatagtgagactgacaatgtctatcattcaaaatatgaattttatcttttgaaaaatgtgttaaaattatgtaacagcaaatgtaatgttacttaaaaaggggaattatcactcatattttttaacatagagcctacactctctgacctttctcagtaggttttcataatgagaatgtataataaaactgatgtgcaaaatttatgatactttagtaaatatgagaacaatttgaaaataaacttggcagtggcataaatgctattgaaaattgtgcctcctgtctgaaatcttccaaacactaattgtggggtaagaactctcctaattgttgcctcttgttcataaagacatgtcctcaaagaagatttttagtagaataaaatggtgctgtgtcacaaataagccagacttttaagttcctacaaataaataatttaatgtttgagtttattaagctaacttcctctaatttaagtatttttagtccatgggaaccccagaataatactgttttgtcacagacttgaattagaactaaaagtactttattttactgcttttcctgtccagctactagatcctgagatttcatagttcattttttttaatctatggggtgaactctcagagtaaacctatgaggacattattgagtgacatccagaagggtttgcatttcattttgaatctttccttttttgcacaagttgattctttttaataatttacatgacttaaaaattctatttctggatacttacctgcatgaaccaaaatgaatgtgcacatcttcggaaacacagacaaggttcagcaacaatggcacggtgaaagcgagaggtaaaccggttggcagacggatctctgacaagaatcagacaccatcaggggtgccgtgtggatgcaggacagcccctgtagaacctgttttttaacactgttgcttgctaaggcatctctgaaagactaagtgggtgtactgtatgtttctatatggtatatttgtaggggcggttaggctgatgatggtagaaacatgcattttttaaagacagcatttcaattaaaacaattggaaggtagtttagcagctagacatttcattactgtgttcttgttataaacaatcatttgcagatagaaatataaataaaaactactatgtctgtagcacgttagagttaacaaggaaataaggaagtagaagcctaatgtgaagtggctttgccccaattgtatgctagtaaatggtggagtgtatttgaacatagatcctttgaattaaaatctgaatctctttcactgtatcatattacctcttcaacacaggctcgtatttataaagtagaatacataacaagacaaaaataatactagaatattctaacttgactttttttttcttttttatcatttggataatgacatcagaattatagtgatcatttgatgaaataaagagtcataactccagacctcaaccagattcttaacatattctaagctgaaaatttaagtaaagatgtgttcacataatgctttgttttatttcattttacattctaaactttagaaacgaaactttttaaagcttcttattttacatgtttttcttttccactatatgttattaataaaacatcaaataattaaataacacaaattaataacaaacacacacgtaaaatgccttgaaatgagtttttcttgttagttttaaaaatccccatgttatcatcgagcacttaagtacctgttatgaaaaactttatattctgcatgctgtcttttctaaactcttgcatgttagttccagggtgatagggatgttgttccacaaaccataatgtactcattacatcatgttgtttttatcctccctgctcgctgttcattctcaacgtgaaaaatcatagaatattagtgacaggaggtctgtattttaggcagacttttgtaattattcccactgaggcatagtcaataggattaaaacacagattctggatctgtccatcccagatgaggtcagttctttgagcagtgggagtactatttctataagctgtgctttcccctttgccttatagaaacatagatattaatatgacacaaatatttgaaagctcctatggaaacagactggctttgcctgaattaagatgaatattcatctgcaataaataaaataacagcattcattagaattcttaactacgtttgtatgtagattttacaacaatgttaaagcccagaaagtttcaattacagaacaatctacttacagttcataattaataaactctttacagctgcataactgtggccagcaacatctgcaaagccttatattttacacacagacatacataattccttcagaaaatgttcagttgtgcttaaaatcacaggtctggaaatggggtaagacctgaggaagctgagtcaagttgtattcctttagctcaagggagagaagtggagagatgggagaaggaaaccagacctcatctggcaaagtaatgtggatgaaaaataaaaatgtttaatatctattcagaaattcaatcacaaatatttctataaaatgtatcaaaaatctcctctaaatataagcttggttttggtaagactgttttttaagtgataaaattattactcctcagataaaagataagctattatttatgaaactccaaaaatacatactaaattaacaaataggttaaaacaataccttgataatagatttctaatagtcttaaaagtaatccataggtaatttctttttttagtttttaatttttgtgagtacacagtagttgtacataggtaatttcttttacctaaatgcaactttataaaatttgatgcatatagagtatatatgttagaaaaataaactaatataagcaaataaaatttactattttttcttaatgtttgcctgtttaagtgttcagatttgaaggtacattactgatgaattttttttttttttttttttgagacggagtttcgctcctgtcgcctaagccccacgctggatggagtgcagtggcaccatctcggctcactgcagccttcacctcccgggttcaagtgattctcctgcttcagccttccgagtagctggggttacaggtgcctgccaccacgcctggctaatgtttgtatttttagtagagacaggatttcgtcatgttggccagggtggtctcaaactcctgacctcaggtgatctacctgccttggcctcccaaagtgctgggattacaggcatgagccaccgtgcccggccctgatggattttataatgagagctttattaagatataattcacatatcatacaattcccccattaaagtgtacaatatatggatttttgttatagtcacagagttgtacaactgtcaccgcaaatcatttttagaacattgtaattaccccaaatataagccttatatctatcaacagtcaaatgccatttttgcttactaccccatcccctgaaaactggtaatctattttctacatctatagatttgcctatttaggatattttatgtaaattgaatcgtacaatatgtagtcttttatgattggattctcttatgtagcatgttttaaagattcatccatgttgttttatgtgtctgtatttaactccttttaattggtggattatattccattgttctaattcattcagtagttgatggacattaggttgtttccactttttggctattacaaataattccactatgaacattaatgtacaggtttttgtgtgcatgtatgttttcatttatcttgagtatatacctaggagtagaatatactacttgggtcatgtagtaacaatgtttattcttttgaggaactggtagtctttttgaaagtggctgcaccattttacattcccacaagcagtgtaggagagttctaattcctccatattttcaccaacacttgttatctttttggttatagccatcctagtagatgtgtggttttgatctgcattttcctaatggctaatgatgttgaacatctttttaagtgctcagtagcctttggcacatcattttttatgtgtttattactcatttgtaaagctttcatggagaaacatcaattcagattccttgcatatttttgattggcttattgatggattttaatttttgcactttttaaaaattattgataatatctaattttacctcctcagtgttataggggagatattttattatcatgtattctttagagactttgatagtccaagaaaatacctggaacctccaggatgttggttctgaacacctatacaatttttttaaaatatagaaatgtctaggccctaataatgatttaattatttggatagagtcaagacattagtgtcctatcaaagccttcctaatgttcagccatggaggatagccaagcaagatatggattatcagtgccttaatgttcaggatggtgtgaagtatgtctgagataaaagttggtgcttaagagttccaaaaaatcagtccattaaggatcaggaaatctttttttggctgtaaaagaactctagaagtaggtggattttctagcaacaagattgtcggaagggggatccttagaaatataatcaggtaagatttctcccaagcatgcaattataggtcataaacctaaaaaactggaccaagtatgggtatctgtgcccattcaggaagaagatacattccatttctacttaattgcttaagttaaagaggcatgggaatgtatggcttttgggtggcctttaggattgttcatttacagttgttataccagtaccctgattggtccactgactgcataatgcaagtatagtctcagtggcctggcatcccattgcttaaacaaaacatctattgaagacaactatggattatgtgattgttaggagaatttaatggagaatcagcatagaaggttttggtatcaactctcttgtatatttaaataatttgatttcagaattttggtgcttttttattcttaaataatttataaatgggaaacctgattgcctttcatgttctttgttaaaaattttaaattaaaaatattatttaaatcaactttgtgggacaatatttaaatagttgagattaaatacaataaactacatttatttcataacagtaatatagcagatcttatgacttaatgtgttgtaatataatttagtagatatattgcagtaaataatactattactctggtatatagaagtttcatgtatctcctagatttcctttttctttggtggttttgcatttaaagaacagactaagcaaaaacttgcttaacatatgaaatctgacaagattacaggttttaactctaggataatgagcttattttattcattaaggccctaaggactaaaagaacagtcaaaagaatcaatcctaggccttcatggtatcatgtaaaaatactgttattaaaataagaggtgaaatattatttttacaaaagtaattaaatatttaaaacaatttttatacatatccctaatttttatcaatatagtgaatgttcagttagaaaagcaaaaacatcaaaagacacaaagttacaatgctatatttcgtaatgtcactaactttatccatagggtacatactatatcaaagggcacatgctatatcaattaaagtttgctttgaattcatgtgctattgaacagattgagaaataaagcagaggaaaaatttgtaaaactgctgttgcacaattcctagaatgttgttgtatactacataattatgtatgaagggaatttaaggtttcagaaggcatttacctctgaagactttttactagtagtttccagaaaaccagctgcatttagagagaggagaaattgcctggatttccatgtagcttttctgggagtagttggtgagctcgtctaactttcctgtatgtatgtatctctcagatatgccactttaccctgctttatctcattgagtatttaactctaagtatttcgtgtagatatcttatcacaatttctaatgttaagagcatctgttactgctttcccaagctttttccacccagtagatcactgttattataagaggtactgcttttgttttttttgcatgttcttggctttactctcaacaccattgctccagcgcttttgtacttacttttaataactctaaattggtagtttcctttgagatcaaatgaaaactggcttgcttcaacttattattttcaatattaactgaactgagacagaatattacttcaaagaaaaaatgttaagacttttatgatcacatttttccggtattgcctttatctatttaatgatagtcatacatatattccataattgtgcaggtatcatcagtgtcaaaattcatagtgaaattgacaatatctgtttaatatctcttcttaaggtatgttgggatattatttcatagctttctaagttaaagtaatagctttcaattagtaaaaatgtataataaaaataataaggatccattgaaaattaagttttagggtagctaaagcccttgagtcccattacgtaagtgtcaaactttggctcttttaacagtaaatgatgatggtagaatagcataaggctgagtgtcagtagtcctgtgttttaaatccagttttatcctagacaaacagaattattggaagaactcaggttacttttgctttaaatctgttttcccatctgttaaaagggtaacaaaattcaacgtaatttgaaagttaagtgataagagtttgaaatttctctgcattagtatcatatagattcttgaaatcatgtaagttgagcaaggaatgcacctcatttgtggaaaaaggggaattagcctttatttagaggcttttatttgcaatgggagaatgagaattctgaggaattccactagtaaacatcattttggaaatgttaaatcgtgttgccattgtccccccataacctccttgccctgtaaaacagtaaacatacacacaatgtcatcaaaaacttgtcagcacacacctcttatttgtctgtatgtctactttggttgtttgttttacttgtccaggccttaatgtctcagacagcgagttgtgagtaaagcattgctttctctgttttatggaatgttgtctctgatctttgaattacaaataatacataaagcaagatcaatgaatattttaaaaaagaagaatttccatcccgagaaatctaagctaaaccctttatcctttctgttaaccatattttttaatgtgacaagatcatatatttagaaacattttaaggttgtatatttttgttatgtttagtaatcaatatcattgttctctctatgccttatatttgcaataattgctattgaaaacaagtgaagatgcattatgcatctttgcttaatgtttttgtaactgctttcctcttgtattaattgagaagccaactaaagacaacatagccaactggcttctgagggcagtagtgggtcataaatttacaatgagatggttgtagccctgtataaatctatctgtctatctctatctatctatctatctatctatctatctatctatctatctctctctctctctctctctctctctctctatcatctattgatcgatggatctatattcacaacataacatacctttaaattgagtctttaaattatataaaatacctatcttgttaatgtaaatctactttcttgatgccccctaaattattttgagctcccaaatatatcaaaattgtgcattaaaattcagcatttgaacagaagttaagggatgactcaactgttttctggaaactatgacatctcagtactttaggattgttcttgctttccatgccccgcagagtgaaaaatgtggttaattttttgcataatacccaagtggagaatattaaatgaactttcagccaataaattaaatgctaaatttttatttatgttaaattttcactaacttttctttacagatatgattttcttttagctaaatatgaaggttactgaaatttaagtagatgtttatttaataaatatgaagaatagattgaatgtcttcaatatataatatattatattaataaaaattattgaaataatgtaaaaataacttgctaaattttcattgaaaataaatataaatatatgaaatgtccagtgatattaaatggtacactgttactggatttaattatagaatctaaatgaataagagcaacttcattaggaggtggcagaaatgctcgctgtccatctctgttcgttgctgagaaaagttgctgtgttagtgtgattgcaccctaaccctctctcggcagaggacaaacagggccataatctacttgccgttgatggctttccccttgtttctggtggtgcagccatctcctattcataggatttcattatttttagtaacaaagaagttcacttagtggaaaccagcctgccttgtaacttaaattggttgaaattctatcttggagtttcctgaaaatttgggaaaatatatttctatcattttcaggtgaaaaattttacatagttatttatttctagtctggtaattaaagttacattaatgtttttcaacatgaaccaaatcaacatgtcaaaagttagtttaaagctatattatattaagaaaacataacttgaagtgttctaatgcagaccaacaaacagttaattatgttgaaatccaagttaaatttgaattatatatcggaattaaatgttctaaggttttggctaaataaattatgcctgtattcagttttctgctccagactttggcgtggtgccaactgcaggtgcaagtttgctgtatcattttgtttgtattattttgttttaagatgaactatcataacatttggctagtgaaataccctaaaatgaatattttatcatcaagagcttgttttacatacatcacatttaatatttgattccttgctaaataatacaatttttttttaaagatcgatttgctctcatgtctcaatttttgctttcttttgcattcccagcctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcatgcacaagtgagttgtattatgaaagtaaaggactttccaatcccttccactcatttgtactgttgtgacatcaatgaaatagatattgaatttgtgatacattcttaattatacttaaatattaaaattattttaaaatattaagataaaattttctttcataagcagataggtttagtaatataaatatatcttacatcaactttggtgttatttccgtgtctgcaaaattaagatgcattttaatatttttcacatgtatctcataagaatcataagtaaaattaaaagttattagggtcagtcaggcagggtggctcatgcctgtaatcccagcactttgggaggccaaggcgggtggatcataatcacctgaggtcaggagttcgagactagcctggccaacatggtgaaaccccgtctctaccaaaaatacaaaaattagctgggagtggtggcgcccacctgtaatcccagctacgcggaagactgaagcaggagaatcacttgaacctgggaggcggaggttgcagtgagccgagattgtgccactacactccagcttggacaataagaatgaaacctcgtctcaaaaaaaaaaaaaaaagttattagggtcttgcatggatattaaatgttattaaaaagtaatggtttctgaattaaaattccattactaaatagagcagacctcactaaatagagcaaatctcacatcttggttcttcaattaatgaatgtttgagagatccaaatccaaagccaatctcagacattgctataaatcattcttgagtacattaaaatgaataaatgtattccctgttatgtggttaaaaggagaactatttttaaactactgcacagctgttttttttaggtgcattaactgtactgttttaattgcttggaagaaaaatagttaaagactgtggcaaaagtacaaagacagttgttatcctgttttcattttgacgtattaaaaggaaaataaataaagcctcttgccaagtgaattcaaggaggcttttatacagcttctctagtaaaggtaatgaaatgtttatgtgaaagaaagcatttcaactcgttttctctttggtaattgagccactagcttaatgccccacacagatccttttgttctttttgtttgtatgtttttttttctatttttgcttatttacttatttattcttggtttcccaagggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcaggtatgttttgtgtttatcttcactgaatgaaataatgtgactacctaagtgaggtgtcttacttgaacatttagttagtttctctgcacagagcttgattcttccagcttgttgattatttacagctttaacttttcctgttgcttgttacaccattagtgtactcattaacatcttcagagatctggcaggagaaataaaaggagataaaattggccaggcgcggtggctcacacctgtaatcccagcattttgggaggccgaggcgggcagatcacaaggtcagcagttcaagaccagcctgggcaacaagaaaccccatctctactaaaaatacaagaattagccgggcatggtggtgcacacctgtagtcccagttacttgagaggctgaggcaggagaatcacttgaacctgggaggcagaagttgcagtgagccgagatcgtgccactgcactccagcatgggtgacagactaagactcttgtctccggaaaaaaaaaaacaggagataaaattgtaaacccttaagactgctataaaacaaataactccactgaaagatctagaggaggggagtgaaaatagtggtcaaaatgaagtaaaggatgtattcacacttttacctttttgtttgttatgctcatgatcataaactacatgataattaggaataatgaaagagttggcttcattgtctcacataatgttacccaattttttactacatagactatgatctttgtaatacatgacgagtctgcattttaatatgcatgagggaattttaagttcatcagtagatttgtgatcatattaatttgcatttttatattcgaataaatggcagatttcatgaggatttcagaagaaatggcataaccatgataatagtgcacttgtagcttagcctaaaggtagtttacacttattttcttactggcacttgaaatgccctccttaacttattctttgttgtggttagttatgttttggaaaatacgaattggagactttctaaaccttcagaaaaatcttactgctgaaggaaatctcagaaattaggggctttctcagtcttttcaaaaattcttattgctgaagatagatgctatgtagtaaatgcaacaaagtgctacgttatcaacaatattaaaatcgggcctttactagagtagtgtgttgtgtgaacaatgtaacaagctaataacaaggtcctcttggtctttggctggctgtctaaaagcaaccagtgttatcccaaattcctggacacagactaatctattcttcatttccatgctaattttaaccaactgttacctatttagattatatctacataatgaaaactatgtatatgatctcagacttaccattttttaacaaattagtgggtttttattctaaaggtttcattctgatgcttatttcaaaggctgtttgaatcagatctcctatttataagagcagatatcgggaggtaaaacatagaaatgtaaatctttaataattagacaaaaaataagtgatttagctaattacctggacttacctattttactttggacttacctcttttattagacatatttatcctatttattttaaaatgctgttgtcataagatagttccacttgcgttgttttatatataaatttgttgtcataactttgcagtgagtggatttgaaacgtttttaggtttatgattttgacataagagctatcttttggaagcattaatataaacttggttctactaagttagaatgacattcttttattcctgctaatatcaagaagtgacatttttatttttgaatataaccaggagatgctgaactgataccagaaatagtgtttgtcaaattggccactttggggatgtcttttcatgttcctaaaatgtctattgtttgatttctcaagttaatactatacaggctaaatatattatcaaatttctgtaagtttctggaatcaaatatttcgcagttgttatgtaaaatggctttggatgttgattcccttctggttaagaacaaactaggttggctggagggttttttttttttttttgctttatttgtgggggaggttgatttaaatgtacaataaatatattgtgatgattgtacaacaatcctgtaaatatactaaaaatacttaatcgtatattaaaatgagtacattttatgctatttaaattatacctcgatgaaaagaaaaaatgataaaaagaatacctatacatttattaaataacataaacataaataaaggttaaaaaactaggtttgcagttttgtattaaaatactaattcatgattgcctagtctgactacatctcaaatgctaaaactcatgaatttacagttaactttttctaacagagaaaatttggaatgtgttagtgattattgttcttttgtgtgagtatactcagttccctccattaccatatttttgctcttcctaaaggggggtgatttgagactttgtccgagttcaaaactatccaaggaaccctgtaaaacccttgaaattatcattctccattaaacaaatagcatcatttccaacctagttcatgctgaaatcacttcaacaatgaatttaagtctatatttctggttggttatcttcctcctcagcaatccactgatgcctagcataaaagggtttattaagagaatttcatgtttctgggaaagcttagagagtcaggataacaaataatcagccagtgcttgaaaggtagtgtgtgtactttgtagttccttttctgttaagttttgagtttggagcacaagaccctttaccagtatttgtgtgagtagaagtgtattgaatatcctttgctcacaggaagaatagggccattggtatcaagggccctgagttctagtttctagtctaccactatgaggtatatacattttgggttgatcactaaactcctcatgaaaaaaaaaatggggataaaataatatctaccttcctgtattatcatgttaagtgagatgatgttagaggaaactaaactcatacattgccataaaaatgctaatgcagtgaatagcaaaatgaatgccaattagtcctctttttatgtaactctttgggaacctgtcaaggcaaaatggaccaatttctttatctgcagaagcatgagggaaaataatgtgagtgcagaattggcagttaacgtattataacattggaagagggagaaattaattttgtttggcctgtaaaaaatatgacttatctagttatcaattatcttatgatagaggttcttatgtaaatcttagctttaagatagatttgtattgaaaagcatattttaatattcatatttatatacttttaatatttacttatcatgaacatgccatacacaagctggctgaaccatacatttttgttcttgttgttttgttagtaattatattgacctattaaggctgaagtcacaaagatcaagttacgtacaacggagatattttttaaaatatagaagtagggggaaaacatatgtatttaatttatgacattatgacccttattcttccttatatttaaaagttctctttaaaaaatgccttttttaaccttttatgttaagttcagtggtacatgtgcaggtttgttacataggcaaacttgtgtcatgggaattagttgtatagattatttcatcacccaggtattaagcctactgcccatttgttatttttgctaatcctctccctctggccaccctccaccccacagtaggccccagtgtgtgttgttcccttctgtgtgtccctgtgttctcatcatttagctcccacttataagtaagaacatgtggtatttggttttctcttcctgtgttagtttgctaaggataatgcccacccacttcatccatgtcactgcaaaggacacgatcttgttcttttttgtggctgtgtagtattccatagttttccattcttaagcactatttaagtgctgctttttaatattagtttgtccaactacactaagtacctagtgcatgtcaagcactatgggggatgctaaggataggaaggtaaagaatggttctcttcttaagtatctaacaatagaacactttattataatgttgtagaacaacattgggaacaaaatacaaaactctgaagaatgattcattcagagaacaaatgaaagcccttccataaaagatgttagtcagtctagagtttcagaatggatgtgattttgctagatgtaagagtataaaagtaaatcctattctaggccctgaagaatactaccccttttctgtaatcagaacatggtaattgccactaccttccttcctgagactaagtatcgtagcacagaagtagtatgcagaagtatgaacgttaataaaaacagatcactcaaaaaatgctgtttctttctttaatacttcattcactctgggattatttaagcaattgtaatatgtggtctctcctcaaagggaaataaatgacttagcaattatccttcaaatcaggaactgtgtcatgtttatctgtgtcaccaccatcaaatacagtcttttctgcatactagctgtacaaaaaatgttgtggaattaggccaatgggaaaaccagaaaaattaaatcattatacaagagtgaaaccattaaggcattaatagaaaagacttattatttgatattagatgacataattacatgattttagacaagttacttcacctctttatactagaattttctcctcaagtggtacactatttgactcgtcatattgtaaaaattgagcaaatagcttaattccaggtacatttattagaataaaaaggtgtgttactgtcctgaaacaattataagagcagtaattaaaatattactatttattgaacacttactatgttcctggtactttttgaaatgtaaaatgtgcatgaaaagagtgtcaaagttgagtcaccttttttggcctcatattttccccataggcaactgagagatttgggacataagacctctcagacctccacatatatttataactaaataaataaagtagtaactcagtatagagtacaaacgtatcactatgctacactattcactgtacactattaataggtgagtgatactgtacatatactacagttcttaatgagagtgataactattttaacgctctggaaagcatctggaaggaattaggatgaaaactgaaacctcttgaaagaggttagggatagtttctcaagttgggctccccaggaagcaaatacttatatggagattagcgtgcatgagttttattaggaagaatgtttgggatcaacaccatcagagagaagggaagcaagcaggaccaagcagagcagggctgagctgtgatggggtctcattggaatcatcagccaactccatggggagtgctctacctgtaatgaaccctcaggttgtccctaggtgacagttttatacgtctatgttgtccagacatgggttgcagtttttcctaggagtgagcaaggtgttacttttcagaaaggaaattctaaatgaggcagggaactgaggcctgttttctggcaaatatctcggcagctgggcaaataatttcttcagtgcttttctaaggagaatgtgggcagcccattacaatatccattatagagggttaaattatgcaaaagaataagagtggcagcattcagagtgtgattatggaataatggtatgaactggatgaataaagatttgtgggaaagattactggggaatttttatttttaggaaaagaatcttttctgatagacagcggggaaaccggagtgtttttgaacaggaaagtaacagattgaccctggtttaacttaaacttttgtgtatcttccgcagtacatttcacatattacatatagtcgtttgttaaaaaaaaaaattcctgcctagtgttactgtggaaaaaatgtgcaaaacatacagtttctgaaaatataagaaagcttcaaagaatctgccatcagggtgtggagacatctcaactatcttcaaaggtctctttagagtctctcaaaaagaattatgttttatccccatcatcaattttgttgtgtatggatgaatgatctatatgacactcactcagattatattaaaatttgaactaaatttgtggagttgttaagacaagaactgatatcattttaaaagtaaaattttgagggttcgaatgactttacaaaggtcacacggtaaattatatagtgatgacccaaatgattgcaatcaaatacacttcttacctcaaaattattgtttatgcaatcttaccatagagtgctatctttaaaaatgtagctccataatccattacacgagaaattgcagattggtttaatggtcagtgataagagctgttaagtgaaaaggagacctactaagaagtgttatttcctgagaatattaacaaatgtaatctttgtgggatagcattgctaaatatagcatttgccttctcattactgttttattatctttcttcaagaaactttaaaaatagccttgcatattttaaactgaccgactttcctgtgtttttcaatgcccagatctaatttctcagccaaaataaaggtttgcgtcagtattccctttactttgatttgtaatgtttatataatgtaccagatgaaatataacctgagtcatgtgatataacattatacataagcaaaattatccccaaaaaagacaaaaccaacaatcattttctttatttgtcagaagtagcttcactcacatgaattaatgtgactcaactgtgactgttttctcataaattaacgtagatcatctcttttcaatgatttaatggacacacatcaagttatatgtcttttaataagtaaattaattccatttaaatttgtatatttttatacttgttaggaatatataagattgatttatattttaaaggaacatgatattgagaaaatatattttcttattttagaacatttattggttatataaagtaatattaaacacagcattctccacagggtgaaacaaggcataattgttttatcactaggttaaaaatatataaatgcaaaaaacaggaaccattttgtagagatagtgttattgttattaaaacatacattcatatgtacacctatgccgtctgcagcagagaatcaatcgaataaatttcctttaacagtaaactgttcaaaatatgcatttctgttacatttagacattttataaacctgaggtatccgaaagtgcaggatttagtcattctaattcatgccctgcagggcatgacattttagtaattcatatgctttgcttaaacaaggagtaactttagactgttagtgaaatttatttaagtatttttgtgacaccataaatatgaaaacatatatatatagatacatttacatttttatttagtggctgtaagttattaaaacatacaaaaaggatgatattttagataactattttaataaaattttaattaggtaacatactaccatgttgacattaatactaataaccaggatttatgtagtgcttagtataaaacatgttgattcctttacacgtaaaggcccatatgtttgcacagtatcttcacattccgaatttatcatgtaagtttaagagaaaattacatgtttctgtgatatggtcttatactaagtgtatcatatatttgtaatattcttcacatattagttgtgaaaagtttatctttcctcttaggcttcatgttataagaaaatggcggtacctttgatcatactctctagccccatcaacatattgggcccagggtagatggttagtaaatatttgttggctgagtacataaattctttgtatactgtaatatgcaaagaaaatttcttagactatctaggttgttacagaagacattaatttaattcaaatgatataatgttatttaaattatgcaatgagtacataagttaataatttcaagtatagtcattttgcaatttggtcctaaaactgtaaatatatttaaaatcttaaactgtttacagccataatgtggtatttacacaggaattttaaacaaaagcttaaccttcttataaaatattaaaggtacaaataaaccttaactttgaaaactttcgtaatgcttcatattttgaaagcttgttgaaaatataattaatttatatcttttatataacattgaatatgtagaagcacagagatcaggattggagatgctttctttagtacctaggaacataatatcagcttttcatacattattttaatattttttatagtttggtatatttaggttttaatatttttgtattttttttggtttggtgacagctttaaggctacagcacatcactgtgccatgactcttctcaattaaaacatacataaggaaatacctctaagtaacctgtgttctcatccccacaccctaatcttgccacctcaactccctgatctccagtcccagtatctttctgagttgtcaaaactatccttttctgatatggttaatatttgtaatgaaataggcttatgttgaggttatggtgacaagttgatctgcatactgtttaatggacatgctcttagtagactcttgaaaaaatcctagtatagagtgttttaagttgcgtctcatatttccaatttaatgcttctttatcttttcttaaattatttgatctttgaattgctactttgtaaataatgatgtttacatacttgggaagcaagagttcattttttgcaataacccagttattctactgctgtgatggaattgtgtcccctcaaaattcctatgctgaagccctaacccccaatgtaactgtatactttcctccacacacactgagaaaggccatgtgagcacatagcaagaagatggccatccccaagccagaaagagaggcttcagcagaaactgaaatctgttggaccttgacttgggacttctagccctcagaactgtgagaaaacaaatttcaatttaagcccctcagtctgtggtattttcttatagcaacaaatgcagactaatactcatccctgagataatttaattccatcctgaaaagtctttattttccatatgcatgaggacagctaaggcatgtaaaattttatttatgggacaagaaatgacagtggtagaaattttatgcatttttatgatttttcccctccaaaaaacccttaacttgtttagtgcagtacctttgtaagtagcagaaaatgaccaatagtaatgttttattttcaatgtccaagacaggtttttattttttaacagagccagttaatcatctaataaattttagaaggtgatacattgatggtaacagaacatccaatataaaagttataataaattttgttcccaagttttgaagcttgggtaagtttgtcaaattcttggcaatttcaacctaataatttctacaagattaagaagtcagtaccatttcaggattttcttaggaaaaagtgtttatagctctatattttggagatacaaatttgtaatttgctaaatttaagcatcctcttcaaaaaatatgacttcccattaggatcattatcctggaatagtccataatgatggaattatgtaaagtaattcttattacatgcattgcccttaatagaagatcgtttattttgcaattgcgagtttatgtagtagacattgtaagtaagctgaatattcatctactaaaataatatttgcaaataaatagccactttagagtaaagaagtttgtaagctgaatattcatctactaaaataatatttgcaaataaatagccactttagagtaaagaagtttgttcaagtgatatatagaaaatctgttttaagtaaaatgtgactaactggaccacatgctctttacttttaggggaaaaatacaaaaagcaagttaacaggaggaacttaaataaaatatgcacagtttttcagggcataaccttaggtaaatatatattgaatacagtctctttttctggagatagtaaacaattataaatcataaaaaataacaaatatgttatattttagtaataccctgccaagaatacaaactaacacatttgtaataggtttccaatatacattgactaaagaagtgtttttggttaatccttccttgactgaaaccagttacctgatttgcttggttctatggtacaaacaggttttgttccatgagtcatgaattagtttttatgtagctagctatcgtgcccatttctctaagtgttattgaagcggtagcattgtggagacagacgcagtttcagaaaaatttcatttaagagcaagaaatcaataagctgcatttcagagaatgaaaagccaatggatagtaatttcatacattattcatgtaaagacaaagacacataatatgaattggtaataatgatgacgacagtagtaaaaacatgggcccataaattttaagtacatatttaggttttcccccaatcccaattcctatgcactgccactgtcaatcatatacaccattttcagccctggatcagctaagggacatagccttgaaagctatgaaatgtaggtgaaagataggagattgtctttaaatttggacaagcatttagttgttgttctgttttcactacatgtgttcagagggagtaaatgttgattattttatcccttgcttcgttggtgatgaattgaagcaaatttgatccagacaagcaatctggtggaatgatgcagagccatccaaaaaaacatctgtactaatctaccaatgcagtaaattagagctacaaggaaaaggcattgatccacaagaatcattaacagttttaaccaactgatccaagtaatagggtaaaggagagaacactatcaagatcttgtttttcagatctgtcagttacaactgctaaagcatgattgttacttgtttgaattttaactgtttttatgactttggttccctttgtactagtgtaagcaatgaacaaggatcaattaagaaccctgggaaaaaattacccaaattctctgcacttaatttacaaataggtcaatcacaaagggagagataattgctgcagccttaacaaaattagtcagggacaaggcagagcagatgatgtatgttctgtggcaaaatacatggcagagatgtacatacagtcatgtagctgcttgccttgtttaagacacaaggactacagaggaagatttgtgaaaaacaattagcatagctttaaagcatgcagttcttaattatccatagcgtgttgacatcagataattagtgtcttaatttttaatatttcgtcattaacttcagcatatagaaagatgcagaacgttgtctgagcatagcatccataatggaaattgtatatgatgataaaaacaaaactggttaagccatatcactattgtattattcaaatactgctaatactcttaaactcagcacccttaactctagttacgtcagactataacactgtgaactgatgtatttatgtgtatagacatgtatagacagtaataaacatatgttctttaacctcatacattttatgagtacatatatattcctaagagaatgggcattcgaatggtggtagggcttaaatgttacagctttaggaatcttttgcctatagatggtgagttaatgagtggcctctccggggaagaggagtggaggtataatttaaaagtgtgacaaaaaagttttgagaaaacaaatagttaggatggaagaatctcagaagcacatgacaaagaccaaagaggggtggccaggccagttgaataagggggctgtcacaattaccaaaggaagggaaattttctcattaagttaatcatagaatcaagtgtcacaggaggtcaatagaatgaagacacaagaaagtctactggatttgaaaatttggaaccatgagaaacagtttttactgataacttgaggtagaaactatcataatgatgtttaccatggtcaaaagcaaagcctgacactatggcatacgtagtagagtattcagctcaatgatggctgaattgaattgtaatagattactttttatgctgatttcatacaacatttatcagactggtaaagactttaagacagagaatgagtctgaattatgtttggaaaaaattactgcctttgttcttttctaatacattatcataaccttgttttctccttgttttgacatctcatcctattttctcacatccctgacatcaccaagaacccaaatatagcctcacacaaatttcattgttgagaacctgataatctcagaaataaaggtcataaaaagaaagatgttaattgtacaaagataaactatgcatttataactatctgtcatctaagatagtatcattaatattaaatgctataacatcaaaggactgtttatacacatctaatacagagactgtgttatgctagatagatgatagatgatagatagatagatagacatatatctcttctttctccagtagattttaaattatatgtcccatatcatgtacttgccaatataaaaagtataaccacctaaaaatttggaaattttatttttgctatgtgcagtatttgttaatactgataaatcttttatttttagacacatttcctttatctttgaaaattatataaacaaagaacagaaagccattatcttatttcaacaaacgtcagatattaatataatttgtaagtgacttctggtacacttgctgcattaaacactggtgttatgtttgaaaatacaacagctgacctcctttagactgctgcctgcctactttgatgtttcattattttcttcaatccaaggatgaaatggatgaatggatcttaattatagtgtcctggtgactcttttttcgaccatttttctggacaagcatcagctaatctgacaaatcatgaacagtttactttatagtttggctgggattaagttactaactggaacctgcagggaacgcaaaaagcaatgtctcctgataaaatgcactgggtgtttgctatgcctgttttcaattttaattcataacctttaggaatgaagaactataaacagataattctctgacagatatatttttatacacttaaatttatagcacttcaaacacaaaccctgtatatccaatttacatatctaaaatctacatcatgtgtttgactttgaatttttttatttctgaagttttcactgtgtaaaaagagctgctttgtaaatttttttatgtaacacaattttagaaatatttctttcttagaactaggttaaaacatctgcagttattatttaaattgcatgtaagtgattataaaaatttgattatgttttaatttgaagtatttttatgtgatcctgggacagatagattgttgaaggaatttgagttcaaattttggatgtttttcaagtttaaattaaaaagtataaagttttggaaaagtcaaatgactatttgagggtttgtagtaactgttgtagatcagtattattcaaagttttccaaagaacaaaaagtgttcaacttttatgcttaggttattattatttcttctaatagtaattgatttttttgtgaattccatatgccatctgctggatgacacgattttcttgttcagcatgaagtttgttcttgcagacaatatgtgttttctttacacatatcagtaaagacgtgttcattagttagagtaggcaaatgaataacatgtaaagccatattttctaataactgtcatttaattggatattttgtttcatctttcttctcttagatgcataataaacatatatacgataactcaatatagaaattagatttagtatccttctaggtaactgaaattaccctgccatccttataaaacagtattttttattgttcttacactgtaaataaatgtactggcaataaagaattaacagcacatccaggaggactttatttaataatgacaatgtaaaatacttcttgtgccattctatttatctaatttataactctatttgattactccagcatgcctttatctgtaagaattgcaccctagggactagtcaacttattaattcatcacttgtcattttttatggttgcaatctccattatagtatgagcatagagtgatactctcttctgaaagctgccagccaactggttccagtctaggtgaccttttgtttgtaactatggtcctaatggtttttctattggcttctatttctaatagattacattacaatctacttttttgtcttatggtatcatgatgaggataggacagcaagagtgaattccacacctgcaattacagagttttaaaaagaggaaagacttgcttcaagttaacctgtaggctttttaaaaaatgccttttgatttatctgtcacctgatccatcagcaatgaataattttcatggaaggtgcactttaattacattcccatttgacttgcattatcaagccctatctaggtaattaatctcaccaagtatccaatttcggcctttattgctggcagacagaccttcagaattatgtgtgcttgagtgggtcttgggcctttttcaccaggcaggccctgaaagagatctgaggccttccaaatcttgaaagtatgcctatgaattttttctcttagatattgtgaataaattaaattatatttggcatcacaaatatacttccataatcaaagaaacctatagattattataatcatgaaaatgatattaaaattgagtcacctttcacttctaggtataaccaatctgcatgtcattttgtatgtagaggacctgtgctgaattattaactgtagctaacatttgtatcagtttgctggtgtaagtttgcaaaagctaccatctaaacttcagcatgttggtttagttcaggatttaaggtttatatgaattgaagtgaattggggttaaagatggttagataaaattagaaacatttacaattagccttgtactttaaattcagttatatactctgttttctataactttctttattctgaattaatagatacctcactttttatactttcctatcttttgattttcataatttctatctcttaatttccgaaactgattaatgtcaaaggtcagtgatcctaacaacttagttgacacacacacacacgcacactcaaagtaagtttgaaatataaaatttgccttctgttgtagtcttattttatgatcttgtgcaaaaatgcataaatgttttatgatttgtatatttggaaattatgattactgtatatgtaatattttgtttctctgagaatatttcaagaaaccctgggggttctctgaaaatcaaattaaaatatagagtagatggattggctgtctgtttgaaagtgacctaaatatctgccattattttaagctatagattgtctgatttgcagaagagaaggcagtccaatctttaatagactaaataggttataatgcttacccagcaagaattttggaaaatttggactgatggtactaggagaaagggtgagtacttttccagtttccactgtcattcctatgcaggtgagcccatgaatctctgcctcttgccctgagttctctcacagactactacctgtatcttcacaaggccatagattgtgatggcatttataagtgttccactataaaaaccaactttacacagctaactttgtttttttttctctcaatgtataactttaattggaccttttgatttttacaaaaataattgaagacatataatatggatttctaaaacatttaacatttctttgtaaaaatcacatggaactttttacccaagtattagtttcccttgtcatttagaaataaatcttcaatttttaaaaagtggcttacttgcaattatatatagaaacgttttactacaggttgagtgtcccttatttgtaatgcttgggaccagaagtgtttcagattttgaatttttttttggagttttgtaatatttgtattatacttactgttcccagtctaaaagtacaaaatccaaaatgattgaatgagcatttcctttgagcatcatttcggtgctcaaaattctttttaactttggagcattttggattttaaattttcagatcgggtattctaaacctgtatccataatatttctagaatgaagatgtgataatttaataatgttttcattagatacattcatgataattgtttacaaaccacacagtaggttaactcagaatttaaattggtcaagaagattcattactgaatgatttactattgtgaattctgtagtaaagtttatgtatgcacatacacatatacacacgtatacatacacactcagatatgtatatatcctgtttgaatatatatgaattcatattttacatttttaaagaaattgttttgtttatatagtattgacatacttcctgtaataatcaggcatatatagctaaacaaagagtttgtggcttattaacatctgtccctatgtttatttccctttggaacctaggaatcatgagaatttatatttctcagtaattgttattgttccctgtaacaccattttgaattggaatatggcgaatataattgatctgacttatatagataaagggagagattatttgtacattgtatagtaaataaatagggtccagtttagtatttaggaatgatttgttaaccagaaacattccccaaagttattttacttttgtatattctttagacatatgttttttcaatgtattgacatgccaaaaatatgtattgcctgggctgtttacatagtcaataaatatatcgagcccagtggattatttttctatatcaaaataaaatcagtttctatgtaataatgcatctagagaaaaatagacataaaagacatatcagagaaattggacactggatttagaatcaaaatgtttgaatcccaggttgatcaagttgttttttgaccttgggcaagtaatgcaatctctttatcttattagttaatctcagtattacatgaagcaatatatgaaaaaatgttttataaaataaaaacctcattcagttatgagttagtggtgttgatgtagtagaattgaattctttgctataaatttaactgtggcaaagtgcagttttggaaaaagtaacaaaataatgctgattattatacaagattaatgttgtcttcagtctcacaatatgtaaccctctcaataaccgggactacaaaagaataataaatcgttgactattctttaaacaagtaatgttgacacttttaaataccaatctctaggcaaaattttaccaattaatgagttgtattagatataatcagtttctaaaaatgaactttgaattctgaagacactatctcccaataaattaaaaacttattttattgccagtttttgtattatatgtttttaaaaatgatgctaagtgttcatgtaaaattttattcctgtacactttgagaaattgttatttaataaaatgttggtatcctacggtattatatgtgtgcatatatttatataaaatttaatatttatttaatttaacataaaatttgattatctctctgtacatatagatatagctataaggagagatatataatatagagatatatagagatatgtaatatgtattacaatatataatacatatgattttcttctctatcagactacaggacctcttccatcattgcactcaatttatatcatgttttgaggttagatagtataactttggaagacaattattttaaaggggaaaattgaaaagattctaaagatcaactctctgtagctgttttaagtttttaagatatattctgtatctcacctccattaaacaaataaaagaatgaaaaataaccattttattgtttcgattattatttaatattcaggtataattgagaactttgaggaaattttaaacatttgtgaacatctatttttgaaatttaagcctatttatagccaaactgggcaaaaaagaaacatgatttattggaatactgatttggaaagagagttgaatttcaatggttcagaggtgacataggaatcacaagcagaatatccctctgtaactttgtaggagcttccaaggtacctgaaagtcactctcttatttaatatatttgattggttttaagctattgaatccatacacactaacacatacaccctgcttagactatttcaaactattaaatgtaaaaagcaagaattaggaagctgaagaatgtaaaacacaagaaaagagagagaagagagaagcatgtgatttcctcaagcactctgaatttggatggaattgcatatgaatgacagcagtcccagactttccttaaccgcagaaaattgttttttcttttacatttctactcccagaggctgttggtggggatttgggggcaacatgatgatattcttaggctttctgttcaagacttttgtactgtttgatgagttatctcccttttgttctctccctcccaatgcttcttcttccctccctccttttctttgtctccttccctcttttcctcacctccctccatcctcactccatttcttccttcctgtttgttttggtggtaaggaactatgtacagaggaaaaagcatgctacaatatgaaatcattattccagtgtcacaagagtcatataaacggtgaacaaagagcaagctgttcctgagaattcatttatttgcttccaggatgctgctgctttttccatcctgtgatacttacttctctttctgaggtatatctaacttgagagctccaggtttgagatcagtggtgagaacaacaggcttgtctgtgatactctactgtttgacatagaaaaatattgaaatattttcttttcctgccagctctctatgagagaaatctctcaattatctactgaatatgtttcaacaaatctgagtgagtttcttttaaagtagttgtttgaggccctttgaaaatagattttctttcctttgacacttatacattcttgtaaacaaaatacagcacaatgcccaaactgattttatgtttatacaagtactttttttctaagggtagaattggtcaaaaaactatccacagaaaattaggtctcatttctaatctatattccagagaataaaaatagacttttgttgcagccttgtgcaatcagtgtgtaaagacattcacttactaaaagaacttgtgattctgaccttttggaaatggtgtgcagtcactggaaccttgcttttgatcactggtaatctttgacattattgagcaaccttatccttgtggatctttcttcagtgttctgggtcagtctcccatgggagaaaagtggaactttgaattgcggatttgaaaacacagcagcaatattctcttctgttgtttaaggtattttctgtgaagattctcactgtactgactgtgcattcagccaaacacagtaaaacaaaaccagcagccacttttaattagtcattgatacttcctttttatgtcttttttctaactacttcaaactgccacccctatagagggcaaacaaaaggaataggttggctgataaaagcttctttgtttttccttttttttttttacaaaaataatactttgtaaactatccaatttatattactccactgatccttcaaatttatggtaaaattgttaagttggaagaaggatgccattcaaagcaagaggttactcttggttacttgagcagtggctgctattggaactggtattggggatgaactattcacttctgttcttaaaagggtaaaaggagctgggcagggtggctcatgactgtaatcccagcactttgggaggccaaggcgggcagatcacaaggtcaggagatcaagaccatcctggctaacacagtgaaaccccgtctctactaaaaataaaaaaaatagctaggcgtggtggcacgtgcctgtagtcccagctactcgggaggctgaggcaggagaatcacttgaacccaggaggcagtggttacagtgagccaagatcgtgccactgcactccagcctgggcaacataatgagacttcatctcaaaacaacaacaacaacaaagtgtaaaaggctttgaacagttgtacatttgactgcccactacactttcaaagtgagatacacatgaaatccaagcaatttgtaacatatgagatatgaagagaatctgaaactttcatgtataccttgcatttgcctcgttttctgatgctaaactcattgaagaggttgtgagaaatattttattgggcaaccttaaaatataagttatgtgatgattatatattatttttctttcttgtattaaaatacttttattctagtagtagggtagcagtaggcttgaaagttttagtgctcaatgtactacatgaactattttttaaacactactttaaaaaggcttttaaaggtacatcaattataatgaaacattatccaatatgttttgggtaccaaggatagtacttgtgcctctcttgtaggttatagcaagaaagattcattatatgtctctcatatactggatacatgttcagatctctatccagccatttctggattatatcaagaaatgaattagataatttcactatgtgtgatttgaattttaatgatctctttctaaatagaaaattttccatttgtctatttaaattttcacaaaatacaaagaaaaataatgtaatttattgttactcataccacaataagaagctaataaggattcaaagagtgtagtttccatgtctgtattttaattgttatagatagataggaatgggattaaaaatttaaaaaaaaaatgaaaactgtggatgattattactggttaagttatgggtctaacaggttattcctttttgctcctattttcccactactattctacatctttgctggtggtctcccttctaaaacacaggtgctttttaaaaatataattatttcactttttaaaaagtatttccttatgtccttaatgatactgagaactttaacaaatcctttggaattataatataaataccaatgaaactgtaaaatttgaaatataattactgtgccaggtttggtcagggcaaaacacttacattacaaccctacacggatagtgtatcacatatgttgatgattatgttttacattagatgaaaaatctcattttgttctaaaactaaaaacagaagtagaataatttttataatatttcttgaatatctcccatttttggaagcagaaaaaagtaagactagattgacgtaaaatacattgaaggatacattctggtctgttaacacttaattgaccctctaggaatcaaacttgcgatagttttgtgaggaatatgttattactccaaatgctgagagaagttaaacaaattgccgaaggtgataaagcccatacagttgctgggtgagacaacacctgaggttatatgggtctgtggcctgtcttgttgccttctaggttatttatttcttcctgtccttgattttcacacttgtgttgtcctatttctggggaaaaaaaatcaattctaataaaagtgatgcatactaatactggaaaattttaaaatatgagctacacatcgcaatctttactagttttggattaagtttaaaggtgaaacatgcaaatatgttcatggttatcagagaatgaaatggatttgcatcactcgtttaaccttgatatttgtggatttgagtcagaatagcctagttataatgcatggaaaagccacagggatacagttttctatgcacagtagcagaaatgctaacaccttaatgtgcttctttggagatatttttttctacattatatattaagtttgttctctagtagttggaaagtgttttagattgtaggtattatatatgctggttagagaattatctttagaaatataaaattagtttaagttcctaatagattctggctattagatttttgttggatgccaaatttgcaaatatttactcccattctgtaggttgtctgtttactctcttgatagtttcttttgctgtgcacaggctctttaattacctcccatttgtcaatttttttgttgcagttgcttttggcatcttcatcatgaaatctttgccagggcctatgtctggaatggtatttcttaggttatcttccagtgttttatagttttaggttttacatttaagtctttaatccatattgagtttatttccgtatacggtgtaaggagggggtccagcttcagtcctctgctaatcagttattcgagcaccatttattgaataaatagttcattccccactgtttgtttttgttgactttgtcaaggatcagatgactataggtgtgcagctttatttctgggctctctattctgtctagttttgtaccaataccatgctgctttggttaccatagcattgtaatatagtttgaagtctggtaacatgatgcctagaattgtcctgagtaagtcagctcttttttggttcatatgaattttgaaatggtattatctaattatgtgaacaatttcatcggtattttgataggaataacactgaatctgtaagttgctttgagcaaatggccattttaacaatattgattttttcctatcatttagcatggaatgtttttctatttgcttgtgctatctctcatttctttcagcagtgtttagtaattctcattgtacagatctttcacctgtctagtttgcagtattaaacaatcctattacaaagtgggcaaaggacatgaagagatgctttgaagagaacatacaggtggccagcaaatacataaaaaaatgctcaacatcactaatcattaaagaaatgcaaatcagaattgcaatgagatctcccaacagtcaggatgatatcattaaaaactcaaaaaataacagatgctggtgaggttttggagaaaaacttatacactgctggtgggaatgtaaattagttcagccattgtggaaagcagtgtggtgatttcacaaagaacttaaaacagaactatcatttgatccaacaattccattatgggatatataatgaaaggaatataaattattctgccataaagagacatgcatgcgtatgttcgtcacagcacaatttacagtagcaaagtcatggaatcaacctaaatgactatcagtgttagagactgcatggagaaaatgtggtgcataaatgccatggaatactacatagccttaaaaaagaatgagatcatgttctttgaagcatcatggatggagctggaggccataatcctaaacaaattaatgcaggaaaagaaaaccaaatggtacatgttctcacttacaagtggaagctgaacactgagtacagagagacacaaagaagggaatgacagatatcagggctacttgagggtggagttttggaggagggagaggatcagaaaaaatacctgtcagatactatgcttattacctgggtaatgaaataatctgtacaccaaacaaccatgacccaaaatgtaccaataagacacctgcatatgtacccctgaatctaaaataaaagtttaaaacgatataaatttaacataaaaataaatatgaaattagtttctattattttgatgaatttgagccagcatttcttatgtttaaattaatactctgcacaagttaattgctttaaatctgccatatcacgatgttgatcatatcagtttatttgaaattcaaaaatactctaaatcatattttttacttaattgtattgaaattttaaggcattttctgaaatagctcttgcttttgtcttcagaatttgagatgtattaatccaatgtgcacaataaacaatgtttttataaacttgtttacttttgtcatgcacatatatattaccatatagcacaaaaattaaatttaacattataattgagttcctataaattgcatataaaaatatataagccacttagcaaagagagagatggaatttgtaatataagtatgtatcagataaaagattacaagtatacaaagctcatgttctgtagataactgttcattatttatagtacttactagaaatataatttgcctgagttggggtgaaaagagttatagttaccattattgtacttattttattttattaacatttttatcaaattattgcttttctcaagtttttttgtttattttttgcttgctttattcagttctccttgtcaccttccaccgggtccactgagctccactgtactacacttaatcttagccatgatgctgacaagcaattgagcttcactgtaaatacactttgaaaccaattctgtgagaatatttttaaacaagtgctattactaaaagtcttatcaaaagtcaagtacctgtttcccgtgatatcagtgaacaacaaaaaagtcaagcacctaacaatgtcaggtgtgtagcagttgtatagtatgtatttttctgagaaaatagattaatatattatttctattgaactgaactgtgtgaggcaatgtggcatgttgtctacatttgccttaaagcagagttatataatgaaagcctattaattcagcctttgcttgtggatgctatgaaaagataaaatgacatagtggtttacaatagtagctgaaaaatagaaagtacgtatctttgaagaaataattaattgataaactaaacaaggtataatatggttgaattgctatttgccacacacatacaaattacatggggaagttattggatgagaaagcaacattgcctcaattgtttgtatatttcatgtaaagtaataatttgtccttaggtattcagatgatttccttaactctccatgatcatttctttgaaaaaatgtttatgtgtgtacatgaaataaatttagtatgcattctagacagaatctctgtttctaaataagttataaatcaaaaagtaagactcatgtctaggtttggtttttaaaagctctgaatttttttttttgtatttttctgctaaatatataatctgcatatttcaggaaggcatgtattcaggagttgcagaatttggaaagggattaaaggtaaagaaaactgagaaaagacctttgtgtttagcaagaaagatattattgaagatcttaaaaaacacgattttattatagtggtgtgactatatatgtggaatataaaactagggagacttgtttaggccatctctgtttacttcttttcttaaaatacagtgatatccttcatttttaatattgtaacttatacttttgttgccaaagttataactaaacttttacagatttactgcatttccatgttgctaattttacaatttggcatctgcaatacttttctccaaatagccattagtttatcaaaatgtttgacatatatgcccactcttgactgtgaacctaaacagaccgatcatctaatgaaaagccagttaagaaatgttcaatattgtgggtaggtgtgcatgttctccatacagcaaagtcctaagatcagttatagagtaaggagttaataaatgctttacaccttttgaaatgccttctcagctgatacccaaggtaacataaaaaagagaaaagtaaatattttgcccttggagaaaatgctgttgattggcttggataaataactttcagaaaggaaatcagcatattgaagagctatctgcacccctatgtttactgtagcactattcacaatagcgaagatatgaaatcaacctaagtatcgatcaacaggtcaatagattttttaaatgtggtatatatctacataatggtatactattcagccataaaaaagaaagaaatctggttatttgtagcaatgttgttgagcctggaggacattatgttaagtgaaataagtgaggtacagaaatacaaatactactacatgttctcacttatatgtaagggctaaaatctttaatagaagcagatagtaaaatagtggttactgagaaggttaggggagagaggaagatagaggttggttcacatacacaaacttatagctatataagagaaataagctatggtgttctataacactgtagtgtgatatagttaacaataatttattttatattttcaaatagctagaagagaggattctgaatgttcccagcacaaggaaatgatattaacaaatgtttgaggtaatggatatgctaatcaatctaatttcatcattacacattctatacttatatcaaaatatcactgtgtacctcataaacatgtaaaattattatgtgtcaattaaaaagagtcactttcatcctatgattaccattttgtgtactgtttgaaaacaatttaattgctatgtttgacattgtataacaagaattatttcaaattctttagttatctccttctctcattccactgactgtggcatttttctcaattcctccaaaatatagtttttcttctaactagtgtaaaaagataaacctgcttatactttaggtgagagtttacattgctaataattaattagtattcttgttcagtatcttctgctccaagaatgagtctttgttgtttttgttttttttaatttcacttcagctgatgagtgtaatggaaagaagatgggctgtgaagcaagagacttgttttcactttccagttctgccgcagtctccttgtataaagtagaacatatgtataacaaaagtatttatacaaaatataatttaaaatatttgagacaataagattatttgagaaaatcaatgaagttactaagtttatttagtcagtcatactctataatggatacaatgtattctttaagcaatgtctccttttttaaaaaaagtatacaaagaatagctgtgttggaaaagtatttgaaaaatcaaagatgtcaggattcatacacagttcatggcatagcactcatgttctttattaggtgtgaagtaaaattcttggaacagttcttggcccatatgctgttgctagttagcatgtctaaaaatgataattgtattttcatatttacattaatattgcttataatctggcttatatactaattaacaaaagcttttaaactttctgtttgaaataaataacgattagcaattaaacatttcagttacttctgattttaaaagtatgataaatgtttagtggccagtgtctcattcagaacttgtaggtcatactctgcagttatttatctttggtgtgtattacttatattattacaatgcagatctgaagaaagaggattttcattcagtctgacactaaaatataaaattcttaaaggaaacaaaagttaaaagttattggtaatgaaaaaaataccctacatcactttattcactttagttccctgaagagttagttatttgtgtgtatatgttattgttaaagttatttttaatattaacagatgaatatggatttttataatgcagttttggttaattcattctgcaaaatgtgaccttgacttgctgtttttctcttccctccttaataatgttatctttaaattagaaaatagtacttttcatatttggtctattttattgtataatcaaagtattattttgcccatgtagtcttttaaggagaccatgccattttctattcctctttctccctattatttaagatatgtgcttagagggagcacattgattatgtagggcttctatgagaattcgctaatgagaatatattattacccagattgaatagtgcccctttgatgcattaaaattgccatgactcaggaaccaatgtcctaggagaaatcttggtatccaagataataaagtcaggtaagaaagaccagattacctctattttgggtgaggaaagatgattaaagtatgacttatgatgcactttagaaaagtgtggattccatcatgccaaaacatttcccagctggctaatacttgaaaagtcaccagtgaaatgttttcccttaaaactctcatatattgttgtatcattcaaagatatttattcagcatttcacatgtttcatacattactctagatgctgggaaaagctatagacaaaaaaagaaatctctgtctttaaaaagtttctagtagaagtggagtgcaagtagaacagacagaaatatactaaatgtgtaaaatataaaaaattagatgatgttgttcaaacaaaatacataggaaagccatgaatggagtgtcaagggattacagtttttaaaaatttccaggaaaggctttattggaatgacgtttgaataaaggcctgagtgagatatgaaagcaaagccaaacggaagaagagtgttctggacagagagaacagcctgtgcaggtcccaaggaaagagcatgtttagcatgttcagtgggggagataagtgtatctggtgtgaagagagaaaggaggagagtagaataaatggaagttgggtgttaacagagttgcaaggacacactgtgttagaccttgcaagtcattataaccactggctttagatgaagactgaaagccattggagggatttaaacggaagaatgacatgaatatactttcataaccatctcattaacaatctcgctgctgtgttaagaatagctaagaggggttctcaggagcaagagattagtttaggaggctattgcaataatctagaaggtggctttcactagggtggtagcaatggaatggtagggagtagtgaattctgaatacattttgaatacagagtcaacaagattagcacactgaatgtggaatatgacagaaagacagtggccaagggaagccttgagtattttaaacctatgcaacttttgaaaagatgaaataactagtaactctagacagaaaaatttgtgggagagacaggtttgaagaagtttaggaactcagtttctgtcatgctatgtttaagatgctacagttgcctctagtttatgtgtgatattggggttaattatgtaaatctggagttttcagcatcgacatggaatttaaagtcatgaactaaatgagataaaaggaagtgagtataaatagaataaaaaccagggttgaggtgtgagtgccagggcactggatgatgaagaacaatcaggaaaagtgacagagaatgaatggccattgagataatagaaaaattcaatttgatgctcagaaagcaaagaaagttatttcaaggaggaggcaatgatctgtcccaaatgttgatagctctgcaaggtgaggagtgagaactgaactttggatataatcaattcagtatgagtctagtggccatcagaacatctcatgtgtcttagactgcactgatttatagagtaaaggtggctgatactcagctctgctcggcacatgccacttccaactgggaatattgtgcccaattctagatagcacagattaaccgtcatacaaatgtattttaaagtgatgggaaatatgaggtaactcacaatcatgtaagatggataccagttgaaagaatgggtttggctaagttggagaaaactaagaagatacaacaataaaaatttgcagctttatatcttagaaagttctttcttatattcagttacaatatgtctttctgttgtttctgcccattcattgatgtgcttaataaatattaagcacctgtcatgagtcattctgctcaccgctggatgtgtgttagtatgaaatagacaagattcctctgttcacagaatagattctctgaaagattttagtccaaacacgtcatatgctatgatgggatcccaggatctattcctgtattagcaggaaactcacttgctaaaaacaatgaagaggagagaccttacctttcagtttcagtgaacaaataatttcttagttttaaaacttgcttctacttataattttcagtgaaactggaaatcttcacatagagataattttaggtcactttctagtcagcctttctcctaagtaagttctagttatgccattcattagatatttaacagttaacacaagaaactatcttcgtatattttatataaatagagcattcatttaaaatcactctttaatatgtttaagatgacactgaatgttgtgcagtgttttattgaaattagggttgtgattttacttgtttgttgaatacttattgagtgcttactgtatgccaggtaatttgctgagggctggatattcagtggtgacatgaacatagcctctcatggaacttagactatagggagagacagattttaatctctttcctttttacttcccactattaccacggcataattctttagcgttcttatgagattttcattacatgaatattagactatgaatagaattatctgctatgtaactaatgtttggtgaacacagcaggcagtttataaatctagaattattattcttgactctttgttagatctcattgatggcgaagagaggatgttgtgtcatttttttctcagcaagtgtgggcatcagcactacatctatcttgagccagcagagcaaacagataattatttaatatcctgtgtttgatgataaccatttttcttggcaaatgtttgaattaagcaagttttctttattgaaattttcaagatatgaagtccttctttttagccacttagatatatttagaaacttcaaagtgtgtctagtaaatataaaatattaagtataccagtagattcgtaacagttttttactgcactgcagttaaccttggttaaatgtacacctgttttcaataccaagaaaagtggtggttcattttgttggaatttttaaaatttccttcatttatcttatctattatttttaccttgattctctaggtagatatattttggtaagattagaaaatgtagaaggtgggaaggagtggagtatagttggatgatagatattaaattttactattttaaacaaagcttacaattacagaaaattttagacaattgatcatagaagatatttattttaagtcacttgcgcatcactggtttggcctatattatgtagctaaataagcctggcttttgttttgataaagaggcatatatctttttagaaggacttggtgatgaactcctcacttaaataattttatttattaaaaaagaataagtgagataatgctgaagtttctataatatagaaaacacttaggaccaattgtttctgaattccattgattgtgtcctttgaatttagggttaaaattgagctatagcttattttgtaacaagtgtttccctatatgcatatattattcctggcaattctaaatatttcttcagctggtagaatcttcactcagtctctgtctgtacacccactctctctcattctcctcccatacactctcattttttatactacataaccccagttttagaaaaggtaggttcactggaaaaaaaatgccttttttcaggattgttattaataagtacaaaataaaatagtgagtgaaaaatctatcaataaaaggcttgcacatatcccttctgccctctacaatatgaacctcttttgcttctattcttactatgaatacacagaaacattttactcagcttcctggccaaggccttgatttgtaaaaaattatgaagttctcaatgcttttatgtttgtttgccttggtgataaatagtgaatatttgtctttctctgtatacgtgttgaaggcacccttgattccctcttttcttgatcatgtttctgcagtctcaaagaatggaattcccctacttgctgtagcacacttacacgcatatttttttagagtgtggcaactgatattatttaagaggtaggatacatatgttgagagggtctagtttccttcttccagatttaacttattgtgcacttacatgttgtatgagttctgtgatcccatttttgcctcaaggccaatcctgctagattattgtatttcatgcctttcatctgcccttgggtttacaaaaatctaataacggtttatagatgacttccccaagctagaaaatctagtggcactgatgtttatgaggatcaattttattttcagatagaaacttttttaaattacctgagattttctttgccactcttgtataatcagagctcaattaaaaagattctgatgaatattatgaggatttaattagaggcatattttatgttagttaatatactcatatgttggtaaaggaagttatcccaggacaaacttaatgcagatttttaaaaaatcagtctatccattaacagtaattttgcagtatttttgtaaggaaacacatcaaaagacagtagcaatacttctgccttaggtgaaaaatctcaaaaatatttgttgtgctcaaaagagtctgtctgccccttcatggatggtttaagataacttctggcaacggaaagcagaccactgataatacttggaggtagttttgtattcatgatttaatacatgtgaaatatgtaatggagggtctcctggagttaagattttaatatttcagttgtagataactctctttgaaaacatagctttttatacagatttggtgtgaaaatgtttagttgagcagatggagatccagctggtagaatatatgtttgtcagggtatctggcatttagctacatccaaaaatgatatcaaactgaaagatgctaaagagcagcactgtatgaaagccagtatgatcagttaagggtagagtcctttcatttttgatttcctaaccttgtagaaatacattttaatccagatggaatttttaattttaaaaataaaatctgagaaaatgtaaataaaattgtcaaacatctgcctttccaaaatcttgattctagtaggccaggaaaaacatgctactttgtgtgttaaaacttagtacctaatgaatagtatatatttgtacgtgtacaataaacatgcacatttcccagaactttatattctgtatatttggtatcattattttggtttcttgagctaaactgtaagaagtggtggatggtaatcgagtagaatattaagagaaagaaggaaagaattcgtggaagaatgacaagagtcctaaatgcactcgaaaacgttttaccccattggattccagtatttaagtccccactgaggtggataaaaggccagcttagcaaggaatcatgtgtttactcctaaattttagagcctttacatttaattgattaatacagtctgcttatttgtttctttcataaagagacgaatatgtagaaataaattattttgttaaaatgcttaaatatgtataatcaaaaaattctatgttatgcatttgaagttgtttattttaattgaaagcaattgagcaaaaccaaaaagttttcacatcttttttttgtttcccctttgaataccatattaataaaatcttcattcaaacttttaaattaagtccactgaaaatgcccaacttgattaactgctattctatgtgaccctcaaaaagtgataattgacatattcattcatagtgctagtaaaacacacacacacgtaaagcacagatgggggacagtatgctccctgaatctgtaaaactgcttaccatagtgagtaaaagtatctgtaggtgacttttggaaggcttccctcagggatttatttgaatcactaaatccaaagagaatatttaatccctatttgatacaatgagttcatgaaaatgggtcctaattttgaaggtataatcagagttaaatagtcactagtatgcctctctaattcagtcattgatataacctgagctacgtgcactgctttaaaatattcccttaccaaaaactaaagctgggaagagcatgttccttaggagcatgatttagtaaatccagacttagaaattaattaatgaagagtatgcctctgcaaaactccagtatatttatcagaaaagcacccctctatgaaataataaatcttttggccttcctggggggctttatattttataaaacaagacaaaaaaaggaattgcttgcagtagattttaagcgatacaaaatttccctctaagtttttgttggaatatttcttcctaaattttaaaaagaatagtaattaatgctatattttttcttcaaattccatcttaaactttacttcttttatctcactttcctacagtgtaaattatatagtatactttacagatatataattttaaaattacatacagtgtaaattttatgcatctgtatatatgtgtatacatacatgtttgcgtgtttataaaatatgtgcgtgtatgcatctgtacagtgtgaaagcctgtgtgcttagcttatgacatattgagccttgtattgttttttacattcattattcattcattaattcaatgaatcttcacagtgctctataacgtaagtagtattaatgtcctcattataaatatgaagaaattaatgtataaagagtttgaataacccaaggtcgtacagtggcagtaatcaaaccccaaattgtgctcttaatcaaaatgccttatggctttttctaattttctaacatttctaaaagccaacattaatctcaaaaagagatagtttggacatttacctgagtaactgaccagttagtttaacaaattcctgtaaaactgatcaatgaatgttgatgcagtgtggagttgtgtggaccacagggacctggagagggaatatctcctttataaggagtaatcacttccctgttcttgctgaagatgcgtaagtgcccagtggggtcagaaatgtcaattccagaagtctagtcagaaatctaaatttgtcagtgaaatttcagatattataatttttgtcttgtaattaaacttaataaacaaacaccaccttaattgtgtctaacaaaacaaatatagagagaagaaataagaagagcactaattagtgagctcagtcatatccagacattggagattgagttccaaggataaacagactctgagacagagatacatatgcaggaattttattggggaatgctcctgggatcaatgactcacctattgtgattgatatatacataatcaacaaataatatattactgttgcctactgtttgattcttctattctcaaaatatcttctcaaagttgatattaggtgcttgttacaatgcaaatactgagaaccacactcaggaagttttgattctgtagacaaacttggtggagaccagttatatacatttttataagtatgcaggtaattctaatgattttaatgcatatgccacatattgagatgtactgatttaaaagagacatatataaatactaattcatatattttctcaagggtatgaattgtatattgtagatctttttataagccctcctcataacacgtgataagtagattgaatttactgctattttatttagcaattattacatgatacaaaatatacacaaactatcttgctaactatataacattttataagtgaaattatatttcaatgaatcaaaattatttttgaaaatttctgacttggtaagctcctacaatcccatatttcagcattttaatgctgcctcaggacttggctaattgtgttgggccatcttgtctctaaagcattaaatactagcaaagctgtgtaagctttaaatataattttccaaattatattttcccatgaatgcttatgaaatttcatgttatcaaaattgcaataaatttctttattatgaaatatacttcccttagctttaattgcacctctgacctgtgtctaatagcatcttttaaaaccatgaaagagaatactaagcattatacttctacagaacttgttttttctagctacattcttaagtaaatttagtaaatatgaaagggaattgtttttctcccaagtgaagtaaaattgcactacaaatcattttctgctaatgattgtattcttttaaaatagcaaagcatatttggtctctaatcactttgcctatcattgtaatgtaatgttaattttaaagagttctgttttggaatgaaaaactaatatactgaatctttattcgaaatgtacttatatattaaaatgctttgctaagcttttgttaaatctgcagaatattccaacatgctgaaacttcttaatattaaaatatgacatttattaaagcacttctgagtaaaataaaaccaggcatgaaaatataatatcagatacaatttctacagtttcacaaggaggttagctaatcaatgaaatggatcagtgatttctcctccttcaatgagcagcccattaatactagcacaaaatacatgctagacagttcaccactgagtcacatctttaattatctatcatactttcttattataatattttatccaatttatccctaaatatctagtaaatctgtactagtaagagggagcctcagcatagaatatttttcagcttaccacagaaattgaaaagatatataaaatcaacttttattgctgtatagatattatttttcatgtgaatttataattgtcagttatcaattattaaataaagggtataatatttgattatgaatatatgtaatctttcaggaaatcttattgaatctaccttccaaatatttgtaaaacatgtgtatatggaatatgaccactttcttcacttccacagctatgtagcccccagcatttcctatctggattactgcaaaacttcctagtaggtcttcgttgttctatacttgactctacatccagttctcaatcacagcagttacatcctttttaaagcatagaccattttgttcctctgctcagaaagctgctgtgagtccacatctcactctgagcaagagtagaagtctgccaggctttatgtgatctgctgcctatcccacctcctcagcgtctgtggtctcagctcttaccactaaccccctcattcatgtattccaggcatgctagtctctttactaatccttaaaacacaccagaagtgttcctgtctttgggcctttgttctagctgttcctgctcccttaaaattatcttctcctggatatctgtttggctaccaaactcatctctatcaaatcattgttcaaaccctgcatgctcaatgacagtgtgcaaacaaccttacttaatataacaacttgtaacttcttaacatttttgaccccctaaccctactctttctagagtattttgcaacttccacaccataaagtttccttagttgttaaatttattgtccatctttttggggaaaatatatgttttactaggatagagatatttcttttccttgatattacttcctaaacgcttataagagtgatgtgaacatgtgaggcccttaataaatatttgttaagtagaattgaattgaattctagtttgtgacattaggaggaagataaattattgaatgcatatcatttttatttaagaattgaaatctaaatttaagtgacaacaatggttcagaggttgaaatgccagaaaaattcattgtatttttcagaaaacaccactgtttttcttttcctttcagccacagcaatagtttcctgattctagaatttgaggtaactttaaaattgagaaaacaatttttaagaaggaaaagctgacaaatgattgctgccttcttttaaatctttgttattttttcataaaaactacatgaagttctaataatgagtctcattatggtatcattgccaaaatggtcatgccatagacaacaaagcaaaaacaaacaaacaaaaaacaaaatgacatagtacttttatgtctactgtttattaaaagcagttgtctttaaaaactaagcagaaaatataattttaagattaaggtcattttttaaattaaatatatttacctttgttaaaatgcataatttattgcattacctgtctttttctcatttctcatgaaaactgcatcaagaaattgttcttatctgccaacctgcacttagatacaatgaattagggaacttgttggcttcagaatgcgtggttccaagtagcttctttctgtgcatatctttcactttctcaccaagcagatggcagcatagtggcaagttatggagacatgcaggccaatttattctgccatgcactaaaaactgtgctagaatttgtgggcaaaataaaagcaagagaaggaaactaacactttttgagagccatattatataccaagctctgtgttagtgttttcatatacactattttattcaagaaatccttgaattagcaagagagatatgttaacacataggagtacagtatgtcttataagtacattttttctttttagaagggtaatgccataattggattagtcatttgaactttatgcagtataatatttctatcaaaaagaaatggtgggactttccagatacagtaaatgattatgaagaaggtattgaggtgagaatgaaagttatgattactggatggctgacctgaaggaggatgaagagttccaattcatatgtaacctcattagataagctgctttatctctctctagttaatgactctccaaggggttcataagccagctgtgatggcagcaggagccagcttcacatattgtaggtgctagacacaaccaaggatttctgcctttataacagctgaaggggttggaggtgggttggtttgatatggagggaggatacaacttaactatgttttaattcaggcaaaatgggctctgctcaagcagttaatatctgaacttgttgtgattatgtgtaattctgtgaccaagtttaaatgcagcttaagactaaatctttatatgccaaggcctcattaaaaagaaaattaataattaattcctttgctaatgttaaaattgaatgacctgaaaaatgtatctgagaattaaccatggctataattcatatgtaaaaataccaaggccatcaaaaaactgggtcctatagaagtgtgttcccccaatttagtacctttacttgttgaagaactgttttttctcagctagtttctactgccttttataccatgcattcctaggactggctcccacctgttatgtatgggaaatgtgaattcattttcacattagcttatttaagacataattaaaatagtaaatctttaaaatccctatagtaaattccaaagccagaaagttgtgggatttctgcaagaatattttacatctacctaggcaaacataccacttacacactagagaataaagccctcaagagcatctgcctgtaagtttgcttgcatcctagaagaaagaaagaatgaggagagaagagagaaaatccaaaatgttgagcatgttattatatgtttaggaaagagcagccagggagaaatgaccctcataagcgcagcaggtagttttactaaatgtacaaactgaaattactatgttccatcttaggactatagtttagttttcctcttgtcaaggctaattattattttccaactggcttctaaatgttttcaatatttgtttgtattgctatctcacttgtatagttagaagccaagcatatagggaatgtattcagagaatctaataatgcatactattcatttacgtaatgcagaaactcagtatcaataggaaattcttgaaaatatataatccttctgaaatataatcagacatagtaaacaattttgctttaagtttacttagtcatttttactagttaatatagaaagtaatttctttgcacaattgatattttatatgtaaataatttattgcatatcagataagcagtttgtatctgataggtagatactcagaagagtatatattgctttaaaagtatagatgttttcacagaaatagtgttacacactatctagaaattctataattgcagtatgtaatataatacaagcaatgttagaacagtagctttcaaagtctctgaaaacatatgtaacctcacagggaaaactcctaaatattttcaggttgattctacaagtaaattctgatgttataagctaattgacatattcagttcaataaaatgaaaatcttaaaatgatacaattttaaacactgttaggaagttagaaagggggtgttattgcaattattcttaaacataaataatctcctacatatgcattgttaaatatgaaggtttttagaaatcactccttcctgccttaccagttatggtttgagggagtaaagtaggctcattttaaggatctgttagcttcactgttattattataactacagcagtgcaggcccttcctatgttagcacagctatttcatttgctttctttccaataatatgttctcattgtaccctcttatcactttcaaaaacataggagcttagctgagccatttctttgacttagaggaactttagtttctacaacaggaacaatgaaatcaacttttttccatctatatagtttagggtgcatattccagggggtctagtcctacaactaggttcttaaaatagaacataaactgtggattcctaaagagaggatcaaacactgagagtgaattattagtacttttagcataagtaaaataacacactgtgagaagattagtttcataggccatgaaattgataagacaaaacacagtacttcttaggtaaaaagttgaacaagaaaagatcagcagagagtgaatctgttgattttagaattcagtgatgagcactttgaaaaatatgcagcagaagccaaatcacttattcatctacaagagtaacactaatgttacagagatttttcaaatacaaaaaaatagacttgaccattggtttccataaccagagataacagctgaaatcagagcaagctgttatatgaagggggatgaagtttctgtcatttagattgttacatattaagtattttcttttgaaatttgtcatagatttgcatgatttaggacctttgaagacaaagacagaccacgcaactgctgcatattcttataattatactctttattctatggtttaatttgaatctttgagatctttgacacatggcttacaagaaattaccctagtttttgttaagtgtgaatacctaagtggtacatattttaatcagagatttaaacccaatgaaagcatctaatattctggtttatcagattttgataatatatatttacttactaatcacttaatacattttatttaagaaaattatattgtcggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaaaattatattgtcagtcttaatgttaattttcaagtttttaatatataaatatcatagtgacttaacatttttaaagtttgcaagcatcattaaaatatttattcaataactataatatctaataaaattcatagttcaattccagacaattatcagttaaatctaagttcagttttcttgagtaaacatttgatttttttatattcccacaaaattggttgtattcttcaaataacacctactcatatggctttcatgtttggtcatcgttgtaggtcctgtctgtaaggtggtcttgttgctcttcgttgaactaagagctctgcaaatggtcagtagatgtatgcttcacttaaggattgtgaggcaagttaaaacagatatggaggttggacctgtcagtgaaagggtcagcttttttgcagttaaatatgtttatgctactttgttaaatactcatccaagcctgagattcttcatctctgcagttgtaatcacaatagtaataaggatgattactatgctagttaaataatacataaatgattaatgttagacaatataataagagctgtggtaatgggtgtattatatagggtttttgccatataacagttcttagaagaaaaaaagcagtttagccaaactgaaacttcttgacatttattttctaatgtaattttgagacagctattgttaagtagaactaataccttataaaaacaaggcaattgaaataaatgaatgaagagaaggataaggaagttaatgaaacagaaaaaaaaacaggagaaaagactgtggactgtaagacatagaagaattgaaaacgagaagaaagatgaaatgagtgaaattataaaatataccacaggagtagaaaagataaaggaggagaaagaagagaaacatcgtctctaaactcattattcctaatgaatttgctaccatcttacatctgtctaccagttagtactaggccatggtactgttgccccagatttttctccttcctagcctaagaccaccttccttagtctggtcctatttcttaatcatcacctcattacagggtaaagaaacttctgcttgagtctttatattgcttgttccatatcttttaagaaaacttaagcttaatgattaatacttacttatttttatttttttaaatcagaaatcatatgaaaaaatgccttgggtctaatttaacaatcttaattttttatttagtaattgttttgaaaatagaatgtattttattctgcttagttatccatatttaattttgtttgtatcttttttataccaaataaggatattttgctatatgaatgagattcttttaaaacatatattgtttctggctataaaagcagttaagtgtttcctgaagaaaatgggaaatccagatatgcaaaatagaaagacaagaaagaaaataatcaccagctattaaaattttcccaacttttcatctatagtatatatttcatcttatatgctactttttcctcaataccacatagcatcattttctcatgaaatgaaatctttttgaaaacattaccaccagtgtttttataatattaatatctgaaggatatttagatagtctccaactctctaccactacagacatacctggttttattctgttttgcagatatcgcattttttacgaattgaaggctgtagcagtcctgcattgagctagtctatcagcatcagttttccaacagcatgtgcttacgttgtgtctctgtgtcacaatttatttcattttttttattattattataattttcatagtgatctgtgatcagaaatctttgatgttactactgtaattgtctgggagcaccataagccatgcctgtagaagactataagatagcaaacttaattgataaatgctgtgtgtgttccaactgctccaccaactatttccctatctcactccctctccttgggctttcctattccttgagacagaataatattaaaattaagccatttaataactctaaagtgcttctaagtgttcaagtgcaagaaagagctgcaggtctctcactttaaatcaaaagctagaaataattaaactcagtgaggaaggcatgtggaaagctgagataggccgaaagctagacctcttgcaccataccattagccaagttgtgaattcaaaggaaaagttcttgaaagaaatgaaaagtgctacttcagtgaatacacgaatgataagagagtgaaacagccttattgctgatatggagaaagttttagtggtctaagatcaaaccagccataacattttcttagtccaaaatataatcaagagcaaaggcataggtctcttcaagttaatgagggctaagagagatgaggaatctcagaaggcaagttagatgctagcaagggtaggttcgtgagacttaaaaaaaaaaggagccatctccataacatgaaagtgcaagatgaagcaagtgttgatatagaaactacagctagctatctaaaaggtctagctaagataattgatgaaggtgaccactctaaagaacaaattttcagtgtagatgaaacagccttatattggaaaatgatgccatctagaacttggtatctggaaaggagaagtcaatgtctggattcagagattcagaggagaggctgactctctttttaagggctaaatgcacctggtgaattggagttggagatactgctcatttaacatccagaaatcttagggcccttaaattatgttaaatttactctgtctgtgttctattagtgtatcaatgaagccttgataacagcacatatgtttacagcatggcttactgaatgttttaagccctctgttgagacttactgcttaggggaggaaatgccttttaatatattactgctgattggcaatgcacctggttacccaagagctccaatggagatacaggagattaatattattgtcatgcctgctaaaatgatatttattctgcagcccatagattaaagagtaatttcacctttcaagtcttttttaataaatacatttcctaagactatagctgcaatagatagtgattcctttgatagatctgggcaaggtaaattgaaaacttttctggaaaggattcaccattccgtatgccattaaggacgttcatgattcatgggaggaggtcaaattttcaacatcaataggagttaggagaagttgattccaacccttgtggatgatggtgaggggttcaagacttcagttgaagaagtaactgcagatgtggtgaaaattgcaagagaactagaattagaagtagatgctgaagatatgactgaattgccacaatctcaagataaaactgcaatggatgaggagctgcttcttatggttgggcaaagaaagtggtttcttgagaagaaatattgtcttcatggagactctttgaatattgttgaaatgacaaagaaggacttaaaatattacttacataaacttagctgataaagcagtggcaaggtttgagaaggttgactttaattttgaaagaacttctgctgtgggtaaattgttatcaaacagcatcacaggccaggctcatgcctgtaatcccagcactttgggagcctgaggctgttggatcatgtcagccaggagttcaagaccaacctgagtaacatcgtgagatgttacaatctctgtaaaaaaaaaaaaaaaaaaaaaaaaaaatagctgggcatgatgcacatgcctgtagtcccaaccacttgggagactgatgtgggaggatcacttgaacccaggaggtcaaggttgcagtgagctgtgatcacaccactgtagcaagacactcaaaaaacaaaacaaaaaaaaatacagcatcacgtgccagagagacatgtttcacaaaaggaagtgtcaattgatgcagcaaacatcactgttgttttaagaaattatgacagccaccccaaccttcagctgctacctgatcatccagtagccatcaacatcaaggcaaaccccctcatcagcaaaaatattatgactcgctgaaggttcagaggattagcagtttttagtaatgaagtattttttaatgaagattttagatataatgctgttgccacttaatggactacagtataatgttaatgtaaacgtaactttttttttttttttgagacggagtctcgctgtgtcataggctggaatgcagtggtgtgatctctgctcactgcaacctccatcccccgggttcaagcaattttctgcctcagcctcccaagtagctgggattacaggcgcccgccaccacgcccggctaacttctgtatttttaatagagacgcaatttcaccatcttggccaggctggtcttgaactccagacctcatcatccacgcaacttggactcccaaagtgctaggattacaggcgtgagccaccgcacccagcctttgttttgttttttaagttttgtgaaactataaagtgaaacattgtgtaaaaacattgatgtcatctattgggggatttttccattgcttatttttatttaattttcagtgcgtatcacaatataactgaaaaatcacttgttgggggtggccgtacaactttctccattgaagtcataaccaaagtttctatgaacttgactcatgtcataggccaagtaatttattccaaaaccttttagcaccatgaaaattaagttaatttaaataattcatttttattgaagactgttcaaaaacatacctctttttagtcttcattcttttaaaatgtacttgctagatgcctgataaagcaattaaactgtcaagaaattaaggactgtgaaccaaatctaaaatgactaaagtgattaaaatccacctcttaaaaattaattctccatgcttctgatctcactttctttatttgccattttaaaaagtcaaaattaaaaaatgttattttctgatattagagcattaacagaatacttaacgatattgttcatttaattgtgcaactactcatggcctttaacatcagaagttatgttaatgcttttacttgctagtctctgtgaatattcattttgttcttcacatatgttgatcttaagtatagaatgttttatgataaaatattttataatggtatatttgaatgggtatgaatttattttcttatataattatcttgaattatataggatcacagtttatgaaattcaaaaaatagatttatttcaatagcatatgtaataaagatattttaattagccttattgggcaacagatactttttgcaatgtttaattaaaaatgaaaatgtctttataagtcattattttatatcaagttgagctttttaattatgattataagtgctgaaaaaaaaattgtgcccaaaaatattttagaacttggatgactacaataatttcttcatatcagcatttcatatggtaaaatatatgtatagaacattttgaaagtagccttcataacatgaagaatttcagaaataaagtcttatttatatgctgcttttaaaagaaaagacatctctgaaatgtatttgttaaaagatgtttgaggctgggtgcggtggctcacgcctgtaatcccagccctttgggaggctaaggcgggcagatcacctgaagtcaggagtttgagaccagccccacaaacatggtgaaaccctgtctctactaaatacaaaacaaatagctgggcatggtgacacatgcctgtaatcccagctactcaggaggctgaggaaggagaatcacttgaacccgggaggtggaggttgcagtgagcggagatcatgccattgcactccagcctgggcgacagagcaagactctgtagtttaaaaaaaaaaaaaaagtttgaattatttgtaagtaattgtcaaactagttggggcttttaaaatctacacataggtagtcagctagctatcttaactatatagcttaacacctatgtgcagaggttagagccctaatctaaaagccattaggaatgatgcctttaaaaatgtggtatttatataggactgggaaatgttgaacctacatttctctgctgtggattcacttagtatgttagtatattcctaactagctattaactcttaactatatagttgaatacctatgtgtagattttaaaagtcccaactagtttgacaattatttataaataattcaaacatcttttaacaaataaatttcaaatatatcttttctttgaaaataaacacgtaagtaagatgttgtttcctttctgtgtacatctcagaaagggatatactaacatattaagtgaatcttacagcagagaaatttaggtccaacatttcccagtcctacatacacaccacatgtttaaagatatcattcctaatggcttttagatcaaactctaaaaaaagtaaataaataaagtagtgcttctaattgtaacagcaaaaaataataagatatattttcctttggtatattgtaatctattctacagtagccagagcaggtgttgaaaagcctgtgtactccaatcatcaaaccacagagaaaaaatcctagtatcccgagcaagaggggatgctgacagttagagcctgagacagtttgaattatcatgtaagcatgtcactcgagtgattaaacctcaaaagattaaaaatggtcagcatctcatgagatacaaagaatatgctttctgtttggacagtgccagttttcggtgactgattattgttagctttttctgcacactagcatttctcccagcctacaccctgcaccaagagcacagcaactcaggatcatattctctctttattctgatagtgatgacatctgaacaaaagtgcacaaatccatattcatcgggaaaaagtcttgatatttgagaactaagtagatattgtttactactttcactatttttgagtaaccatagaagttactctcattattactaaatcttcctggtttctcccaagctcaacgtatggatgagtagtagtactatcctcaaaatgaagaggacagtacatgtttatccactcattagggaattaaaacataagcataatgattggtctgtatgaatatgtaatatatgtgcatacatatcttaccatatttattttttccactgtctactaactacttaatctgaatgtcataagatttaatctgtattagtcagcctaaggggagtgcaaataaacttggctcaaaattgcatgctttacagtgtaaaacttagaaattattttttagttttcattgaatagattcaatccttagaatctgtctattttgggaagaaaaaagtgggattacatccttctttttattttccacaatacctattctttaaaggattgtggaaatggtttagcccagagtaagctagaaatcactgcatagggcttattcaatgtgttatcagtgtcagaacaacttttacctaaatacattcaaagctttcttatctttcatttatttctgttaaatgatgtggacagtgtcttttaactagaattttgtatttatgtttgctatcatggtgaatttttttttctttttggtaccacatattgtcacattggttgattttctaaaaaaatacagaatatctaacatttggttgatgcaataattggtatcattatttaaatattctttataaagagatgcagtttagatgggtttgataatttatagactgaatttatttttattagcagttatgtttaagtcctgtattcaaatattataattatacttcttttatgcaatagtattatattatgatttaatggagatatgagcaattctaaatgtgtcaatcccctatgatattttctgttaaaattaattataattgctactaaaatgtagaatttatttgatccatcttcataaagagagtttttttctccttctagagggaattgatttatttcacatgatgaccaaaactaagcattcttacaataggtcataattcggttcaaattgtagcatagtgaaaataaaactgagggatgattgtctaatgctttggaaagttaatttgattatttttataggagatgtattatttacacatttcatgataaatattgatttgaactgcacatgggatttagtttagaaatcaggaaaagtgaaagcaactgacttaaactgaacattttattaaacattggaatttgttttacattaaaatgtatatttagttcagtataacatagtttacatgaaatatgacctagctttatttaggtctttgttttactctgagtcctttggttttgtcatttttaagtccatcatactgtgccatgcacacacatttgtgggattggctagttcaaaagaaattatttgctttaattaatccatttggatatttaagaaatatattcctaaaactttttagtactttgtgcaaacatgattcttggcaaattccctgaggacatttttttatattttcaccccaacagaagctaacattattgtacccttatcatattaagtgagataaaatgtaaacttctcaatacattctctggcctatcagcaaaataaaaagtcattcaactgggatttcgggagactttataaaagcagagaaaaattgtaggccacttacaaaattctgcagtcaaattatattttaaaaaatccatctagagttagagacatgtttggactaatttagttcaagtaagtatgattcttgcataaatagtgattttcacactgcccttttttatgtaaaaatattaacaagtatttctgctttttagaccaaaataaattatattccgatattttattatgatatccattgtatagactgatttattttaaagccaggagtttctaggtaagtactgaatatctcttaatgagaataatagtgactatataaaatactattatatctgtgtgaccatgcaggttatatgacaacaaagaagaaacttaaattttttttattttcttctgacagataagtttgcaaaggtggctctagtagaggtattgacaatagcaaacaaaaaaatctattcccgtaggtaatgaaataaattaattacttatggttttcatttactaggtagtttagtctgtattattttcacagtaacctcaatatgtctagtaagtctaaataaacattaaattttattgaagaatgaaaaagaaagccacactcagagtcactagttgttggtaaatacatactttaattgtatgtattttgcttctttggttaccaggaaatatttctttctcacacaggctctttaggttggaattgcctgagtggcttttaatgtttatagaggaaatgtaggaggaatgatttcttttaaaaaatgatttataacccctatagggattcataatattattaagaaattttaattcactgaattctggatagcagaactgcttcagcctcttactttttttttttggacttttactttcataatttctcctttcactaataccatcttttacttttattttggtcttttactgttcaccctgcttaatcaaatctttccccatcctataaggtctaactcatgctttccttccatgaacactttcagttgtgcattgattctacatacatatattttgtaccaggaagtaatagggaagctatagaaatagttgtggacaaaaaaaaacacataaaaattgctaatataaaagcttataaagcttacattctagtgaggtggggcagacaacaaaataaattaataatctacattgtattttagaaggtgataaacaggaatggaagtagaaatggggtggtgaggcaggggttgattgacaattttaagtaacagtaagagggtgatatttcataatgtagaagaggaaaggaagcaaaccatgtacatatctaaggaaagaatcttccaaacagaacaccatctgtgagccatgaggctgaggcatgtcttttgagttctggtaatggtaaggaaaccaatgttgaaaaagcaagagaaagagagtaggcagtgaattcatgtaaatactctcaggagttgggctattgtactgaggcaagtgagaagccactggagaatttcagcagaggagtgacataatctaactctgggttgaaagaattctcctcctataaaacaatggccttcattaaggcaatcatttttatctaatttcccggactgacttcttactttcctaacctgattatatgctccttttagtcaaggacatgagatataatcaatctttttatattccctacagcatctagaataaagtaggtggtatagtggcactcagtagagaattattgatttggtttgggaggctggagcagaacagataaaataagcattgctgccagcattggcagctccagaaatcttttctgcacaactccgttagtttaccttgtaaatacaaacagtccaatagaagctgccttcctgtcttcaatctagaactgagaataaatcacaaataatcaagttcatctgtattgtctttcaaaatctgagcaagtgtacacttgctcagtgtatactacaagtatatacttgctcaatgtatactacaagtatatacttgtagtataattactatactacaagtatagtaattattcatgacagccaatccattctagaatgcctactattcctttacaatttgttttagcagatcctgtgatttagtcagagaaatgtccaatgtcctcttcgtttgagtgcagtgaaggctgtctttaacaacagatgcaaaagcacctttctcctattcatttctcagacatttatgtcttgcagcatgtgagaagcatattaagtgctagtcaggtaatagaagaaaggtttccacagataatacctgacaattcaatcaaagaaaaatcggggaaaaattcatggagaaaggtggcttatagacgataggtggagttccttggacattcacagaataaacagcattgccttgatttccttttcaatacttcagaaatataacttcacctatcattttatagcatcataaatcacctatctaccgatgaaattacatttaagacctcaagtaaaagcttaattaatttaattttaaaacgcagagcagatactatgctgatccatatgattgtgtgtatgcctttgtcttaatttatttccatgttgtttcttagaaatgaatgtatggtaagatgtactccttaaggtaatatgtatgctagatctaaaaatgcagccatcaacaaacattcccatctctacatccagcttgattttttttctctttagcacttcttactattaacagagcatatattttatttatttgccttattttctatctacccccttcccacccctattagaatgtaagcttcttagactcttctggaacgagactgaaacaggcaaacacagaagtaaggagataggttagcaagctatgagaaggtacagtgctgtcttttaatgtagtgagaagtgcttaacactggctgtattttgaatattgagccagcaggatttggtgtaatagacagaggagtgttcagtataacttcacattctctggtctgagcaaatgtaaagatgaagtttccactgagacagcactaattgtgagcaaagtaggatcacgggcaaacatcagcagttaggtttttcatgtgctcagtgtgaggcaactgttgtatgcctacacagtacatggccttgtgattcctgatccattcttcttgattcccttgctctatgtgtatggcaggtctttacccctgcaggtagtgtttcccaggctaccttatcagctaacttttgacagcatgtggcccctattaagaactggctagagcttggaaggcataagaaggcaaaaaggcgagtatttctcccttttttctgtgctttaagtgtggtttccatcggcaactatttctcttccatgactccaggtccctccatgctgttccagtttgtcctcatttattcctgtccagtaactctgccttctccttttccctctccagtgaaaggatagcaaaaacatcttctcttgcctgaggcttgtcagctcttctaacatctgtataaacaacttcataaattaaattatctctgtttcaaatatatgttgctgttcttgcatccagatttatataatttacaagtagagataaaaggtagagcagtctacatctcagagaattatatgcgccaatgcagttgaagaattctaacagtccaggtaccagagggagtgaggtgagaatgataggaagtaatagagagtggcaccctggaaattgttaagtataaaaagagtaatgatgaggtctaggctatgccatgggaggggacggttgaagtatttggagacatgaacactgaagaacgagaggtcaaagaacccaggagtcatagttcagtaagaattatttacctggaatttgatattcataaatattatgacaggagtagtatcagtaaaaatgtcagtgagctagggactaaaatcttcaaggagtgagaaagactgacctggagtctgaatagcaacagcttggagggacagaagtcacataatcagttgacataagcattatagctatgggattttatatggaagtgaagaagtagttaagactttcaaggttatagaagagaagagcaaggagaattacacactttccggcccagtgacggtaagggtggaagaacaaccaaccctacttaagagggcttccagagaagctatgtgctctcagaagtaagcaagattctgtgaggatgttagaacaagaaaggatagggaacgttgaagaagatggtgaagattttgctgatgactaaggatagagtaaggcatgtggttatactgttatgggtgcagatttgtgtggagatgataattcagatgtcgagcaatgacttgggagtactgggtagttgtggtaactgatgtatcaaggacaaaagacatggagggattattctagattgtctttgagaaagatcacattcactatgctgtaagtatagggagcaagggagaggcaagggttttcccaggattacatagaactttggctcctctgtcatcacttttggtgatgtggagatgacagacagttgctattattgggagctagtgataatgttgacatttttactagagtatatgatttgaagtggtttctatttgtctgtaaaaaaatcgctattaaatttattatataaacatttataaagtatttaacaactttgttttgaatggatttatacagattttacccttcaaatgttgtctacgtttcccaaattgtaagatcagttttttacagcagaaaatatattttaaatttcttgtatatttcaaattagctagaagagaactgtcatgtttccaacacaaaaatattttaagtaatagatatctatctcaattactcttatttgatcattacacattttgtacttgtatcaaagtattacatgtaccctcaaaatatgtacaaatatgagatatcaattttaaaaaaaagaaacttaaaagaaaatacattttagagcagagtagataatatatttactgtggccagatatttaaattctgagggtcacttcatcacctgtatgagagatacagtcatatgctacataatgacattttggtcaaggacagacgacatacacaacagctggcccataagattataataccatatgtttactctgccttttctgtgtttacatatgtttagatacacaaatacttacctttgtgttacaattgcctacagtattcagtacagtaacatactatgcaggtttgtagcctagaagtggtaggcctcatagcctaggtgtgtagtaggctgtactatctcagtttgtgtaagtacactcgatgtttgcataatgatgaaataaccgaatgatgcattattcagaatgtattcccatcgttaaggaatgcatgactgtatatttgtttcatgcaacagaacaaattaagagacttttaaaaacaaattaaacaatattccccttatgttatctaacatatctaaataaatctgaaatatttattgaatgcattattaaaatatgaaggtcaattgggagaattttcatagttatttgggttatagctttaaaaattacagattaagtgttagcaaaatttgactaaacatcgaggactgtttattattgtattcatgtataattctttttaaaaaattatacatgtccagaaattcataaaattataaaaaattgtaagaaaataaaaattgtcctaaatcttactgcatgtatttcttacatttctccaggtgtgttctgtatggctctttactatgcctgtatttttacatatgtagttaattatttttgataaaatttagatcatactgaatatgttgtctcattttcattcaacaaagtcatcagcatgttgccacaaatgtttctagctattatctgaatgcatgatttcaactatcactgaatcctgttctatgattgtagtactattattttaatcatgtatatttaagcagttgttactggtgcttctcacgtgagaaacaatctgtgtttaaatcactatacctatctttttttaaaaaaactttcagttcagggatacatgcgcaggtttgttatgtagataaactcgtgtgtgacaggggtttgttgtacagattatttcatcacccagatactaagcctactacccagtagttatttattctgttcctcttcctcttcccaccatccatcttcaagtaggctccagagtcttctgttcccctatttgtgtccatgagttcccatcctttagctcccacttacaagtgagaacatgtagtattcacttttctgttcctctgctactttgctaaggataaagtcctccagctccatccaagttcctgcaaaagacgtgatctcattcttttttacggctgcatagtattccatggtgtatatgtaccacgttttctttatccagtctttcattgatgggcatttaagttgattccatatctttgctattgtgaatagtgctgcagtgggcatttgtctttatggtagaaagatttatattcctctgggtacctacccagtaatgagattgttgtgtcgaatggtagttctgtttttagctctttgaggaatcaccacactgctttccacaatggttgaactaatttatactcctaccaacagtgtataaatgttctcttttttctgcaaccttgccagcatcttttattttctgtctttttaaataatagctaaactgactggtatgagatggtatctcattgtagttttcatttgcatttctctaatgatcagtgatattgagctttttttctttcttcttttttttttctttattttattttattttattttatttttttgagacggagtctcgctctgtcgcccaggctagagtgcagtggcgcgatctcggctcactgcaagctccgcctcccgggttcacgccattctcctgcctcagcttcctgagtagctgggactacaggcgcccgccaccacgcccggctaattttttgtatttttagtagagatgaggtttcactgtgttagccaggatggtctcgatctcctgacctcttgatccgcccgcctcggcctcccaaagtgctgggattacaggcttgagccaccgcgcccggctgagctttttttcataagcttgttggccatatgtatgtcttttgaaaaacgtctgttcatttcctgtgcccactttttaatgtttttttctcttgtaaatttgtttaagttccttatgaatgctggatattccactaataaagcagaaaagagagaagatccaaataaacacagttagaaatcactatacctgtctttgattattttgataatcaattttcagaaatagacttatttaggtagaaagtattggaattttattgtggatagccaaactgacctccagaaatatttaactaccaagagcccttatcaaaactgagcattgtcttttggttttcaatctttgccaatgtgataggcaaaataatttctcatttaaaaagggattactacttggtttaaggcttagtatttttcatatccttattggcagtgtatgtagtgtgtatcagtgtctctttaggcctctttactgatttaaaaattaggatgctctactattcatcaaatatggctgtgaactcttttgcatatatcagttcatatatgtatatataatataaacatgatttgttgccatttaattttatatatgctactctgcatttttatgagtctatcttttgcttaatggtttatggctctgatatgatgtttgaaagccttatccataacaaagttaggaaaatatttatttctgtgttcatcttttgttaaatggcttaaattttatgttaaaatttactttatcaagattatggtttgtttacaatgtgaaggtatttctgactgtcggctcccactaatctattcagtaacgttgatacctttattattaaacgcatccttcccacattattttgaaagactaatatttttttccaaggccaggtagagactaaagcctgtttctagactttctggtcttatttaattctttattatttattttgtggctaatatggcattgttttacttatcatagatatctgtttcacagatattgatataccaaacatgtctttgaaagaatctctgaaatgatacttatttaaagctaaagtttgctgcactgagggctacttttgtttctacccaaactaaggataattccgtctctaatcaatgggcaattacatataaaatattataatggaaataagggctaactcaggtattttggagagagatatatgctgaagtagaaacttcagtggcttgaaaagcaattagctcaagcctttgtagtatgtcttggtgcagacttggagatatagtgtatatggacctcaattactgagttcctgtttttagtaaatagctgccctgtaggtcactaagtgctattgctgacaaggttgtgtatgagaaagcttttattttaataaccagtggcaactggcacttacaaagaaccttccatttctcaaaattcttctttggtttagaacggctatacagaattgcaggcacctcagggatagtagaactaaaccaattataaacaaaggaataaatgagacatcaaagaaaaggagtttttaagtagagacagaacaccaaaacttattcttatgaaatgtggtttggtgtctttatgactatattgaccaaaagaactttggtttaaaaatatgctttacttgagatccaaacacaatatcctgcagataagtaaattcattttcctcagaaagaaaaataagctatgcctagttcatgtagagtctacactgtagttgtcagctttaatgttacaagtttggtgatcttgggaaagttacttaaattattttaacctgtatcctatctgtaaaataatgaaaatgccttctgtgaagacagttttgaggattaaattaggtaattatatagagtgcctttctcagtctgcagtatgcagttgagaaatgaatggtgaccaatgaaaaagcatgattatatttttatttttaagtaaattatattttatatatttaagttatacaacatgatgttgtgggatacatttagataataaaatgattactatagtgaagcaaattaacatagccatcatttcatatagtgacctgtttgtttggttttgtgacaaaaccaggtaaaatctactcatttagcaggaatccaaacacagtataattttgttaactattctcatgttgtatattagaattctatgaagttgccaatgtgataggcaaaataatttctcatttaaaaagtaattactacttggtttaaggtttagtgtttttcatatccttaatggcaatgtatgtaagtatgtatcagtgtctgctgctttctagcctctgacctgcatcatgccattttctcctcacccccttcttatccctggtaaccattattttattctctatctctgtttatttgactttttcttagattccacgtgtaagcaagattatgcaatatttttctttatgtacctggcttatttctcctagcgtaatatcctctaggttcatctatgtggtggcaaatggcagtatctccttgttttgtttaatgctgaataatattctgtgtgtgtgtgtgtattatatatatacatatatatatttatatattttatatatatatgctatgaatagtttatccagtcaccaacagatagttaggttatttccttgacttgactattgtaaataatgtttcaataataagggagtacaaatatttttagaaggtggtaatttcattccctttgggtatagtcccagaagagggattgctgggtcatatggtatatctgatttttagctctctaggaactccatattgttttccataatggctgcagcgatctgtgttcccaccaaagtgaaacaaatgttcctctgaggaacattaaatctataaggggctatgtaatatataaggttttatatagaaaaccacaaaacattttcaaatggcattaagaagacctcaaaatatagaaaggcataaaatatttattgctcgaaagtattaatattttaattatatataaagccttaaattaatttattaattaaatatgaatatgatataacttccagtaggaagtggtatgtttgtgtgtgtctgctgaattaaatggaagatcaaaaatggctaagaatagctaaaattatttgaggatgaagttatggggatgtattataaagccatgaaattcagaaaatgcattgtcagcagaaagataagtggcataaataggacagaaatatcaaacaatggaaatatatataacagaggtgacaaaaatagatagtagtatacatgatagataaaatcagttccatagagtaaagacaattatgtagggaaaataaataaacactttcaaagaaaatatagactatcttaatgacctttgattagagaaggaattccagaaagccctgtctataaagaaaatcttgataaaattgactataaaaataaaaatataagacacacagtggaagaaaacgtcatatatatttgtcatatgtatttaagtataattagataaagaaatatctattatatatttatttaaaaagaaaaccacaaaaccgtaagacagagacaagcaatctaatcacaatgtgtgaaactgaaggaaaaagaatgtctactaaatacacaaaattacagaaactaccaaaatggagagcaatgaaaaattacttaagacataattaagaagtgtaaaatattaactaaaaatatagcagcatattaaaggtcatcccaaacacacaaaaaatggaaaatttcataaacggctggttgaactgcagatatgtaaatctgattacaagtaatgtagcaatatttatcaaactgaaaattatctcactactgaaattctagtgtacacattcacacaaagttcaaaatggttgatctctctctctctccccattctccctccttttgttcctctctcccttcctcctttcctcgttctctttatctctttctctctctcccttttcatcttcctcccttcccccctcagtttcaaaaagtaaacacactgtatgatttggaaatttttcttagaaaaagtcaattcaaaacttttcaatattaatctttgagaagaccattaaacaagccaatctggttttaatataactattacatatttcagataaattcagtaaaatatatacaagcaaagaaaaagtactgattttattctactttctataaccctccaacattgtgacttatcaatgccatatgtgaatctatatctattaatgtatgcattgaaaaagttggatttaagctgagcatgtaaaaataaacagatatattagttaattttgagagctggcatgttataattaatacaactgtagctttatatgattatacatgttatatattctttgaaataaaacaacatttaactaccaatttatgacattgttctatttgttaaaaagaaaaactagacatatggactatttttttcttcttaaaaaaatgtgttaaggaacattccccttaataaaaatcagggtagttacccatcaaaaaatatatttctccagtaaatattcatcttcaggtttagtatatcagtagttatatataaattcagctttttgaaacatcacaatagacattttaaccgtaatagtcatgggacttaaatttagactaccttgtcacatcatccctgatacactgcccatttaagggcaagaagaatccttattacatgaaaaagaatttattttagtatattctattcagagtccgtagttaaaacccaggctatgttgtcatcttcacattcaaaatcatagtgtattaagactttttccatagctaacatccttgaggttgacatcttcttgtgactgagtagatagcagcaagaaattcaattacagcaagccagctttgtcattgcacctgtctgcttgcacgggaaatgatttgtaaattgggctttatctttcccgtcccataaatctcctgtccataattgacacttgtcagcatagatgaatagcgggagaaagaaaacagaaagtaaatgagtagcccacctgggaaaaatgatgtcttgttgcctttgggagtcatttacaaacagcagtacctgcgggccagtttttatccataagcacgttgcaaacattttactattgaaaaatacaatgccagggctgaatcataacaaagacaagacaaaggaaccataattaacatataacatttttccagagaacataaacatgtcttccaaggaaattgaaagcttttctttactgtttgtgatgctcacttattgctgctgcacatttgtaagtatcgagttagcatctgacctgtcaaaatgcattcatgaagcaagcattttggttgtcttgggagttgatattgtcacttgttacacaactcaacatgagttcaaagttgtttgataccagtgtcgacagattggttttaaaaagacgtgagaatgacgatattttctttcaaatgtcaaagaaaaacaggattccataatgatgatcttgggagcaagcactacccataaaaacatgacagataaaccttcatatctaatttttctaaatgtcttatatgacttcacatctctttatgaagcttatctcatattgcaaaatatttttactttaaaaccaaaggaaaatatttcagaattcattaataattcttaatactaaatacctaaatattctgaaacataattcttaaattatcactaaaatttgattgttttaaattttaaaaatacctaaataagattaaatgatagattgaatattttgcaaactaaattatgaataacaaaaaattatatatatatatatgggtttacatagtcttttctatgtattacctgatttttaataatctaattcttaaatgtgtatgattttgtcaatatttttaaaaaatctttaacttaatattagaaaaaagaatttatcatttcttttcaattgtacaaggcctcaaactatttctcatctctatcatttactagcatcttctaacttaaaagaataacatctttcttaccctctttgtgcccacagatcagcatgaatttaaagagtttataccttctccaaaatgagtgcaaacaattagaaatggagcacttggcaggagcgcagatttatcttgaatacctctctctatcactatcttccagtcttatcacctgtagttcaatgggttgtttgcctttctctctagtattcatagaagttgtaagcattatattatatttacactacaaaatgaaaagttgtctgatgatgttgttacttctctgtaggttattgttagtgtaaagtaacttatttatttatacctactttcatatgctgagcttgtaaaaacagttgggaatttcttggatattgatctaaagcaatagatattaatagcctaatacagtagtactccataaccttttatctgggtcagctttgtcatgtggcaacttaactgaataccgcccccccaaaaaaaaacacaacttttcaatacaaataagaatgctgcatttctgcctgtctcttcctaaatcatcaggtttcccataaataatattgtttttctaaatggtatcagcagtttagacagagatatttaaaatactagggtaaaattaaaatattaggtagcattgaaagtagagatgtgaatacttttgtatttatgactgcatttaccaagtcatgttccctattgatatgcaaaataaaaataagtattaaaaaataaaagtaataagttgggggcaaggggagggagagcatttagcaacttggacaaaatgacttaactaataagtgacagagctgggattgtgccttttcttgcatgacttcaaatcttgtgaaggagtgtggggagtgtcttcagtaatacactttctgtttactgtagttaactatatatgcttatgagacagtacccaatcatatgttattgtttaattccaaatatgagaagtaaaatttatgttgatttgaaaatattttttctaactttggaatataatggaattatattccatgtatgttacataccttgaatattttgatgtgtgtgtggctaaagttcttttgcaccttatctgaggagtaatgtacagttttgcaaatgaatcattgggaagcaactgacaaataattcttgtttttgtacacataacctggtaatctggttccagaaaagtattttttttttttttttttttgagacggagtctcgctctgtcgcccaggctggagtgcagtggcgggatctcggctcactgccagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagaaaagtattttttatctgttgtttagtgatggaagtttaatcaattttgcagcttttgtcaaatattttatttgcctgtgtgattagacgcttaatgataattctctttggtctttgactaaaaaaacaaaaaccgtaaaagccttagaattctgttaaattcaaaagttcttattttaaaacattgcataaggaacattgcattcaaaataaaattttagtaagtacaaactgtagagagtattccttttatttctcattgatatgtagtactttataaacaaaatatgttacacaattgcttttgcttgccatccaagacagtttaggacagaaatcagggatgtatccataagggggttttcagagacacgcactactgaacaaattttattactatcaaaatataaaatttactcattttaaagaaaaattcggatttcttggtcagtgatttgcaaatagtaagtgaacatctacagagtagtatttgcaacataaactactgggatctatttcaatgttgtattcattgtttgcagctgtattttttgtttgctttatgatgatgatgatgaaatgcagaatccagtttatattaactattagatagaattccctttaaagagtcatttgtgtgacttttgctgggccacaaatcttaaaatgctaggacactgggcattcgtaagagcctcgctgttatgtttagtgagaagtcctgtaatggaaggtactcataccctgtgttgcttcacatctcagcaagcaaacattactgccaaaccttggttatagtttgtatataatctaatggtttaagcaaaagagatctaaaactgaataattaacctaaagctaaaattaaaggagagagagaggaaagaaaggagaaattacttctattccagaggaagattttagataactgaaagttatcagacttctagggactaattccagtctctctgaattagacctggcaaattgctaagagttgaagaaatttccaatgccattttgtatgtattacctatcatttgaatggagagctgaaaccttatcaatcttgtacaattattatatatagaattcatttttagagaatatgagccaatacagtttccatgacagcattatattaaatgagaaatatttccaagaaggtacaagtcatttgttacataatacttttctgtagttatcatattatggaattcactagtcagagaattaccaaaatatgtttgttcatattttatatgtcatattttatattactatatatagtcaaaattgcttttgactataaatatgaagaactttttatacaaaaatcattacatatgtgtatatttatgcacatatacatatatgacaagtttaaaaggaaactcttggcttagatactataaagaactataagcattttattacatggaaaattacaataaatattaagaagatgcatgttgtgtataaaatagagtgtatatcagtttagacaaaaattgttctttaataatttgttcatattttgcttttccatccaaaacggttttaaggcaaagggaatatataaactaaaatccttcattgtgatgaccatttaaatgaaaattcagggaattgacactatcattttgatgggctttgttttattagtaagtgtgttatatgtaaccaatgattttatatgtcctacttaatctccaaattcctgtttaggcatgcagacaaaatgtaatgagagaacttggttgcatttggaatatttgtttaaaataaggtaaaccttaagattacttttaacaaaattattctacatactttcttatttttttatttttttatttttttgagatggagtcttgcactgtcacccaggctccagtgcagtggcgcgatcttggcccaatgcaagccccacctcccaggttcacgccattctcctgcctcagtctcccaagtagctgggactacaggtgctcgccaccactcccagctaatttttttttttgtatttttagtagagacgggatttcaccatgttagccaggatctacatacttttaaaagctatctgtttataaactatgaattaatagttgtaattcattgttatcaaaatttcttagtgatatattaaaaattatcaaaaaaattattgctgactttcaagttgttattctaactatacatggtatcactaatttgcttctctgtcatttgagagttaatgatgtttccctcttagagaattgcaatatacattgcaagcactagttaaaaatataaagtgatcttgaggtgtgtgtacaattttacaaagttttataagatattttagtacttgagcaaataaataacctagaacttatatggggggaaaaaaagcttcctatccaagagggaaattttagataattgatagttgttattcattcatttaaacagaatttaatatatgtctaaagttgcatgctgtgataaataatgggaacatattggttagcaaaaccaaatgtggcctccccatcactttatggtacttgcagtctagtggggaaaacaaatagtcatcaaatgatcatacaaacgcatgccaattttcagctgtaaagtgttataaaaagatatttgctaattccactagaacacataagagatggattttactcagagaagttaggaaagtcactttaagaaaagaacagtcagaatgatatctcaacttggtgtgaaaagcagctgggcagagccaagcaacagaaaagagtataaggtgcacaaaatgagggaagatttatgcatggtgaggctggaaaaatacatggggctcagacagtaagtcatggtaatgattttgtttcttattctaaaagtcatgcaaaattaagtattttaaacagtttttattaagtataatttgcatatgataaaattcacccagttcaaatgtataattcagtgattttaataaatgtactgagctgtgcaagcatcaccacaatccagtattagaacatttccataaccccataagatcccttctgcccatttacatgtattcccattctcacccctagacctaggcaaccacgaaactgctttgtgtctaaaattgtctgttctagacatgtcatataagcaggatcatacaatgtcgtctggcttctttcacctagcctaattttttgaggtacttctatgttgtactgtacagcctatccatccatttgtattgagcacttctatttctttgtatgtattctaccttatttgtttgctagtttatgaacctttatgttgtttccacttttgggctatatgaataatattgctgtgaacattcacatttaaatatttgtgtggacctgtgttttcatttcttgcgggtagataactaagagtggaattactaggtcatatggtaactttatatttaactctttaaaaaaaactgcttttacatagtggctgcaccactttgcatttctaccaacaacgtataaagaattctattttcaaattcttgccaacacatgttattatctagattttttaaaattatagtcattctagttgggtgtcaagtgatatcttactgtaggtttaatctgtattttcctaataactaataatgatgaacatcttttcatatggccttgaagaaatttgactcttgcttgaggagaaggggtttgcaaaggaaacaaagtggtagctaaataaggagaacacatggacacacagagggaacaacacatactggggcatttcggaggttggagggtggaaggagggagaggatcaggaaaaataactaatgggtactaggcttaatatcttggtgatgaaataatctgtacaacaaacccccatgacacgagtttacctatataacatacctgcacaggtacccttgaactaaaaataaaagttaaaaaaaaaaaaagaatcaaccagacaggagaaaaactagaagagaatgtgccacaaaagccaaggagaaaaggacagagagattaaaaatattaatgctactgagagtccaagaaaagtagggattgagaaaagcacttcagtgtgagtaaccttatcaataactcatttaatggaatgaggtggaccgaagccagactaaagaaggttgaaacatgaaaggagttgagaaatggagaaaaagaatatggacaatttttttcatatttggctatacagtgaagaaaagagattccccagcaggtggaaagagttataggcttgagaaacaattttattttcatgggagagtttacacaaaatctttcaggaagaatccaatagataggaagacactggcttatataaaagagtgaaggtaatttgtagtgtcacaccattattcgtttatttagcatatactaagtgccaaaaatatgcatggtggagtattccttgttagtactgtgaatcaatttgagactttttcaaataaatatttctcaattataaaacagagaaattaaatgttattgaaagtcttttaaaaagtactatattcatgctagttaacatattatatatgccatctagtaaatgacttctgtcactggaaatatgtttaaatcaccggatgtgactgtttcagacgcaacctttgccctgttcagggtctccacagctgtctggtcctggagggaaaagcttcacctgaaaactcccagatacaagcaaaaaatatttttctcacctgctaccttttaaacctgacaaatgaaggtttaatgctatcatatatagtcttccaagccccagtttaaaaacattatttttatccatgatctggtgccttcacttaggaaatctgaatcaattcctttggtttcttctgttctatattcagagaagaaattaactggggagcagggagaatcaagttaagtgtgtgatctccctctcctctgctattgggatgatgaaggtgacagacactgctagttttctccctaatatcttctttcttcttatttaccatattttttagtgcagcagtacagccagattacattttaaaaatccatttcccagcctagggaataagatgcaaacagaagatttccatagcttactggaaactttggctttcctaattcaggtgctgagcattcgcattgcttattccttctccatgccgcaatatagatgtcataggtgtggtagcagcaacagccaagagggaaaggccatgagaatcatctgtatagccttgaacaactgaataaaacatagatgcccatctgtagaatacatttgtgtgggggtgtgtgtgtagggtgtgtgtgtgtgtgtgtgtaaggaaaaacaacaacaatcaaattactagttttttgagttttcttacttgaagccaaacagactgtaactcagagaaaggcaaactttttctgaaaagggccaggtaataaatatttcacatcctgcaggccatgttttctgtgttagaattccccagcactcacattttggcacagaagcagccagagggaatatgtaaaaaagggtgccgctgtgttccaatgaaaccttatttacaaaaacaagtggctagccagatatggcccatgggccacagaccccagctctaactgaaaaaagatgaaagtcagtacatcatctactttatatttatatcctagttagtttttgagttcgttatttcttgctggctggagattatttaggaataaagccggaacttcatatgtggcaagagaaggagacaggcagacaacaagcaaaagtttctgtccttggctaagagatatcagaatatggggagaattcagggagatcttcattcctgtaattgaagcaactgcatcagtagaaatagcaaacacattttattctttgtcttggtttttctcttttgcatagttaataatattaaaacagaattgttttcgatttcttatctgtgcaaatttacaatagtttaagaacattctgggtcaaatacatgtttgttggctggcctagcaatctgctatttctgatattacttctgtgttaactccaaattacaaacaatgaaattacaaattaacttttggagccaaacttattcataaaatggtaactctcactctgtataactattcattataagccagatcttcccagtgcagtgattcttgggtattaattagctgcgttaattttctcttggtactaaaatattatatagtaaattaatgctgctttgtaaaacaacaactttaaaatagaagttgcaaagctaatcaaaatgtatttagcagaaaatattaaacttaagtgctcagtttgtaacagattcttgcaataaagtggtaaatcttgactaatattgagaacttattaagcaatatgaatttcttaagtttatgcacttttgagatacaatgtattcagagtacctggagcaattgaaatgataagttttttaactgtacttttttttaattatactttaagttctgggatacatgtgcagaatgtgcaggtttgttacataggtatacacacgccatggtggtttgctgcacccatcaacccatcatctacattacgtatttctcctaatgctatccctcccctagccccccaccccccaacaggccctggtgtgtgatgttcccctccctgtgtccatgtgttctcattgttcaactcccacttacgagtgagaacatgaggtgtttgggtttctgttcttgtgttagttttctgagaatgatggtttccagtgtcatccatgtccctgcaaaggacatgaacctatccttttttatggcttcatagtattccattgtgtatatttagcacattttctttatccagtctgtcattgatgttgattggcatttgggttggttccatgactttgctactgtggacagtgccacaataaacatatgtgtgcatatatctttataaatgaggtagtattaatgagtctcaagccacattcattttccttccttttcacttccttctccccctgctgctgctgatctttcttattcttttctttctcctttctttcctgtttcttttcttcttccccttgtaggataatccactttacagatcatcactctgaggaacaccagaatgatgattttgaaaaaaaaaaataaatgagcaaagccactaacgaggaagaattctgcaaaaactaacattgttaaatcatgtttaagaaagtcaatttatgtttgatatatatgggttttaggcctggaaaacatacagtcaaaaaatatagcaggaaaaaaggagagaaataaaataaaaagatagaataaaatagaaacaactatggtactgatagcagccaaaatataatgaaattgatcattctcttcaaccattattgagaactttgggatggagtaaattaatggtataatatggaactatcaagcatttttgctgtatgaattatgttttgtattttatcagcttaaatgaatatcactttaagaataggcataccttcaattatattttatgtaatatagtgatttccaaaactttaaattgtatttatagtaattagtagatgcatattatatatctttattttccttgatccatatgcacataaacatgtgaagcaaaggttctgtgaaactatattactgtgtccggaattggggggttcttggtctcactgacttcaagaatgaagccgcggaccctcgtggtgagtgttacagtttttaaaggtggcgtgtccagagtttgtttcttctgatattcggatgtgtttggagtttcttccttctggtgggctcctggtctcgctggcttcgggagtgaagctgcagaccttcgcggtgagtgttacagctcttaaggcagtgcgtctggagttgttcgttccttctggtgggttcgtggtcttgctggcttcaggagtgaagctgcagaccttcgcattgattgttacagctcataaaggcaatgtggacccaaaagagtgagcagcagcaagatttatcacaaagagtgaaaaagcttccacagtgtggaaggggacctgagaggattgccactgctggctcgggcagcctgcttttattctcttatctggccccacccacatcctgctgattggtctgttttacagagagctgattggtctgttttgacagggtgctgattggtgtgtttacaatccctgagctagacacaaaagttctccatgtccccactagattagctagatacagagtgtcaattggtgtatttacaaaccctgagctagacacagagtgctgattggtgtatttacaaaccttgagctagatacagagtgccgattggtgcattcacaatcccttagctagacataaaggttctccaagtccccactagactcaggagcccagctggcttcacccaatggatcccgcaccggggccgcaggtggagctgcctgccagtcccgcgccctgctcctgcactcctcagcccttgggtggtcgatgggactaggcacggtggagaagggggcagcgctcctcggggaggctctggccatgcaggaacccatggggagggggacggaggaggctcaggcatggcagggtgcaggtcctgagccctgccctgcagggaggcagctaaggccgggggagaaatcgaccacagcagctgctggcccaggtgctaagcccctcactgctcggggctggcaggtcccgcggctctgagtgaggggcccgccgagcccacgcccaccgggaactcgcgctggcccgcaagcgctgtgcgcagccccagctcctgcctgcccctctccctccacacctccccgcaagctgaaggagccggctccagccttggccagcccaaaaaggggctcccacagtgcagccgcaggtcgaagggctcctcaagtgtggccagagtaggcgccaaggccgaggaggcgccaagagtgagtgagggctgcgagggctgccagcatgctgtcacctctcattactatctgcagtgaactcaatttttattctaatttattttttaaaacttcggttgtaatccattcattgtgttcacaataatgaaaaatgctggtgtgatggaaaagtatttgggaaattataaacagtgtagtcacctattaagcactcagtgttccgtaatggaagttttatttaaatggataaataggatttattatgaatgtgtatgattaacagaatgtgtaatatctgccttaaagacaaatctcatattccctttttcttcagtttccttctcatggaccctgttcttaataaacaaattatatattgtttaaatacatgatttactgtttcttaaaagtaaaccaaatctatgaatttccagagtattattatgtacatgacaacgttataaacattgtgcacatactttggaagaggaactaataagcttacttaagcacatagtgacatatatatgtaaaattgtatatattacataaaattatttgtacattttatgaaatatataatatataaatttaccttatctaaatgaaggattatactgatgtgcatgttgtaaggaaatacagttattgtacatcaaatttaaaatataatttacctgtgtaatacagaaatccatattgtaaagaatttaaatatagctatggaaatttaaagatacccatagtatgacatttagactatgttatcatgtcaaaaattgtcaactggcattataatatttttgagattggaatactattatttctctctttatttaaaaaaaagttctgaggtcaaagaaaatgtgcacaactgaaaatgttactctgatgacctgcaagggaggtcattaactaatgtatgtgtgtgtttgtgtgtgtgcgtagacatgtatacacatattctacttaaaggtttattgttaaaggagtctggttgtaggccatagctgtcccatacttcctgataaatcatttctatgattattttgtcattaaagcaaagccacagttatatagttgaccttgtgaagtaccctttggctatgaattcatggaaaattaaagatggagccagtttactgactgtaaaagtacgaaagtagtttaaaacaaatcattcaaagtattagtttcctcaccaatcaaaatagaagttacttcatccgtgtatttctctttctcaatatattttataacattttgaaaagagtgtgtgttgttggtcttcgtctcattttggtagtcatttcattttcttacaatgatgtatcccttctaagtgacttaacattgatgatgtacttttctagctagctcatgcatataaaacagtataaattatacaaatggattatttactgaaatagctattttataaaaattatcaatgtgatttcaaaaatctaacattgccagcatttattatggagagtgctggtatcccaccttagaatagcaatttatgttcctgcaaaagatttaaaggaattattctcaaactcagctgtccgtcagctttatctatggagtttttgaaaaatacgaaggcctgaatctgatcttagaatcagagtattctggaaggtgtcccaggtatcagtaattttaatacaaacaaagtcataatagaataataatactttttttttggaattcttaccacatgctaggaatgattttaaatatttaacatttatttatatatttaatttccataacaattctatttatgatgtaagtattctgattatccttattttaaagctgagaaaactgagacacagagaggttcaattttctgctcaaggtcacacagcaaataagccacggactagctttctggcccatgctcttcattcctatactctactgcttctctaagttttctacctttaaggagcatcagaatagctgaggagatagacaggtataacataattgaatgacacattgtgtagccactcaactatcaacagaaaatgaaatctgtattagttgaagcagaggaagaatgattcaaggagttgttggttattggtggaggccactagacagaaaaatgtgtgcccaatcttgaaactgagtttgttattatctaattgatataaagttatcacttgcagattatagatatgatgccaacagtcttgataagctgtttaagtgcatggctatataccaaccaaatgctgaattacaaatggggttgacaacaggaaaatattctgtgtgttttgctctttactgtctcccaggaatatgttggcacttgatttatatttcatctatgttaggatatttagttttgcatttagattgtttgtgagcattcatgttctaacttgttttctggatttaaatctcctggaaggtagtaactgagacatcatcatctttgcaattcatacaactctttatactataatcagtcatgagaaattatatgttgaaggtatgaacgaaaggagttttcatcagaaatcagtaaaaatgttatagtaatcataccttttgggcattttagtgttacagtgaagggtatttaagactaatgctagcgtacttttaaaagtcagtgctactcaaaatgccagcatatgacagataagtagctagcaccagaaagaaaatgatcaaggaagctgcaaagaaaaagaaatgcttctttcatcaagaaatcttactaagaaaaaaacgtcagctgagctacaaaaaagtgcttactgatgtagttgatgtacatctgacacaagttcctctcacacaccaacaacttgcagctgtgttttgagtagccagcctgcactttgagtggcactgctctagaatattttaaataataataaccaaataaattgctcattttcttttctaaagcaaaacctctaaaggagttttaacaattgccacattttgcctattcagtccatgtaactttgcctacctcttttcacctgtgggcactagaccactttgaaatattttactcttcttataggattaattaattagataccagtttgccagcagtttcattggatcataattagtaagaaaaagaggtgggaaaggaccatgcttattgataagtgtctggtcaaataaatcatggtgcatatgtataatggaatacaacagagctgataaaagagtgatgcagatctatatgtgttaaatgatatgttataaaatacagcataaatcaaaaaatatcattcatgtaaaacatgcacatatttgtgtttacctagacaatttctggaaggataccaaataaattgctaagagtggttgcttcagggaaaagtaccttagttacatggggacaggttgggagggagtgtcagttttcacgctttagtatttttgaattttgtcgcatatacacacattttccatttaaaaaatctctgctcagcttaatctcttctagtatctgcagcttctgagactgctactgcctactgagcagatccctatgggtcttttgatccttatattctcaaaacctaatgtcctggcacatcatggattctcagtaaatattaaatgagtgaatgactgcttagctttcctcttgctagtttctgctctcaggaagtgtcagagcctagaattttgcagtatattgaaaaaaagttgggaattagggctttaaaacgtgaattaaataaaaaatatgactctgagatgatgctacttaatttttaaggctcagcttcttcacacacacacacacaacaacaacaaaaaaaaacagcaagaaaagcagtatttacctcatagggttttagaagggaagaaatccatctgtctatctatctaatgttgcaaattctaaggaactataaaaatccacaatgccttgcatatagtaaatgccaaacaaatacttgttgaatagaactaaaccagtaaaaagatagtattacttgttgattgaaaagatagataatgtgtgtcttactatcaggaactccttaaccattctgaattgtcatgttaggtcattattgagttattcttttgtaagactggtatgaataggacagccagtttggggaatttgcctaatttatacctactgtgttcaaaattttatctttttcacattaagagaaattctattaaaataaaaatttatgaggtgttacacattaacctttcaacagttgacattttagtcagtactttagcagagattaggaggagtcctagtatgtgtttagcaacaatgaccaacagtagctcttctccacaaactgatgccccttaaagccttttacttatagatttttctgagaagtgctaactcctataataattaattaaatgtccaaacaattggtttccaattacctggtgataaaaaagaagaaaactttattctcagaaagatgtattgtcagatcatttttacaatcgctgccttaaagaacagaatgattcttggttgatcaaattgtgaagtggtgacttttgtagttcttattaggtattttattactctactgaagatatattgatttaactcacatgtatacctgactggggccactatgcaggatgcttttattttcctactttttcagctcaacatcatatttttttccagaactttcaaaccttatttcttagtcaaattgtctttttagtaactgtttcttgaatttatttagaaattcattctgttatatatcttactatattgtatattttacattttgaaaatcattatcctaattggtatgttaagtagatagcaatgcaaataacataatttaattttgaaaaaacatcatttctcttccaccgattttttcaaatacttattatagaatgaaaatttatgttggttttaactacagatcatgcttctctccagccaaagataatttgacagacgtctatcacaaaagaatagctcataattgctacaggttcaattacccttagttcctgtacttatttttttagctaaaattgcatatgtatcattcttaatattattagccaccctgtttttccaaagccaagaaattgaaatgttgtgaaattatgtgtttagcattttttatgtatatctacatactctagaaatagaattgctgtgttacatgatacactgcactgcatgtataattatggccaagtatttcattatttaagcaaatttgtatgtatttttatgtgtttttcctatagtacaaagatgaacacctgtggggaagagtgagaaagctaaaagttgtatattttaaaatactaagctcatagtaacacacgcatttgttatttcaaggattgctaaaaatgaatttcttgctgataacgtacaataggaaaagcgttccatgaaagagcatcattctactattagcaggttttcccttgactgtattccagagatatctttatttttcctttttgtatttacctaatggatatctaacaaatttcagtggatttaaaaacttgatatatttgctgaaagatcattttatgcttgttgacccatcttacctcattgtactgttgaaaaatacaggtatatttttccatccattctttgtttaaattcagttagaaacatgtaaatgtagaaaaaatgaatggtataaataaatgactttttaaatccaaagtgaaattcattatcttggttaagttcttttctgtgaaacattgtgttttgggtcttaatcaaggtcaatattccttgattccatgctatttcaacatacaatttaatatcacgttatttaaatatgcaatcactagcctgttttcataatttcataaaaatttcagtaggtctgctttttttactacatgtattcattttctattgctgccataacagattaccacaaacagtgaacaatttaaaacactcatttattatctcacagttctgtgggtcacaagtctgggcacagcaaggttcaactaccagcctcacaggctgaaatcaagttatcggctggtcttggctcttacttgaaaactctggggaagatccacttccaagctcattcctgttgttggaagaattcaaattctttgctctgataggactgaattattgatttctgtactggtcaatcagggccagtctgatcctaaaagctgcccttgtatctttgcatgtttctctgaggtcccctccaacaatggcaagttggttcctcccacagttgaaatttctctgacttctacagcatctctgtttgctcttaagggctcgtatgactagatagtgcccactgggaagaatccaggataatctctttattttaacgtctgtaaccttaattatatttacagtactcttttggccatggaatttacatatttacatgtttcagagattagggtatagacatcttcgtggggtcactctgcctactttgctgtgctttaaaattgtctttttccctacttcatgctaagaaattttcctttacaaatagttaagcttaacctgttggcagggggtagagggaggcagtacatagaccttatgaataaattccattctgtaatttaaatacgtgttttgtaattgaattttagttggaaattgattaagatcaaagatcacatatgagtgcttgaagctcaaaatctgtaaaaatgctgattggttcaggtctgtacataaacccaccattcttgttactgattatttttcaatttaaagccttatactaacaaacccattccacaaatttacttttgtgcctgtcattagacttttgctttactctttcatcaaatttatcaattttgtttttatgctgttgagatttaccactttgaactctggaaacaaattttgaatttcctaaggtcttctgtcattgtcatttgtgaagattccaaatatgattaataatttgcttcatggcttagtctgttttatattttatttatttgttatatcttatatccctgataagacttgaagatctttaagggcaaaggaagttccatctgttttttcagttgaatttaatttttatttttgaatacttctagaaactctagtgaaaatgaatctgttaattatttgttagaaaacctactaaaaatttatgttcaaaaagctctgttatatacagtatttgttttctcctacatctttcaattcggaactttattgttgttggttactatttattatcttcacataattccaattacaacatgtctaatttcattttgataattatgaaaattataatttaaatgttataacaccaaattggttcttgaagcatttaattcatttgtatattcatttgtatattgtcacttgtatatttcatttgtataattcatttgtatactgttattttcttttcagaaatgaactttagattgtagttaattgaatattttggtgtaagagtgagcacatttttagtgagattgttacaataacgttaatttagtaaatcaaatatattgaccatagaaatcattgtgttttaagattaacataccttatgccactttaattttactttaacatataactttatctgaaaataattaccttgttagaatataactaggctagagatgtttttgtttataagctgtatatcctgtgagttgtgtatcctttatacctaagatactgaagctcagggaaaatataatcacgtttcctgtaccaaatgttgtatttgaaggacattagacagagagagatttttcctatcatgcagtttatccattctcaagggccatgtgctagtgcttccgtttctgaccctcttaaaatgtgtgacttgatatagtatcagcaagggatacaagaaaaaaagaaagaaatatagaagaattcaggagtatattcacttacagatatggatcctgtgcaaaagggaaaatacgttgcagcatatttcactgtcagcactgtgatatgagtttcaaaatattatatatttgaagtatttttagcagcttttctttttcagttcccaattgctataattttattggtaaaaattattttccaggatggaaataatgaatgtaattttagtgtataacttgcaaaaatcatctcattttatatttagatcttgtttcaatgtatcagaaactaaatagggtagatttataacccaaatcttttccataacctgaagaattcagagtctcctgcctcttttatcataccaagcaaagtgatagttagggatagaaaccaagcaacatgtcttagtgtttgacttatactgaaaatcacagtaggctattggtgttatttgaaagaaacctagagatttacacatacgagctctctaacctatttctagctaacttattttcaaatggcacacataaatggtaaactctgatcagagaccagcaactcctgggtaactcagtatgttaaccattgcagtattctcacctgtgctgcagtctattgtttttactagttaaaatgtaaattttttggaatgattttgttaagtaagttatgctactagagattatttgtcaagtagagtctcatgtcacaattagttggagttggattcctaaggccatggcctaaggaagcagcctcttgaacgttgcagtctactgagttatgctaagcaggttctgggtacagagatgtgtcactttagagataagttattgtttactgtatatgttcaggtttcaaaagttgtgacaaaaataagatttcttactagaaattagcttcattgaaaatatatcagaaatgcatttagactgtaaacacagtttgttgagtacttcagctacatctccttcaagggaaagttgtcccacttaaactgccctcgttacgcttttgttagtaatctgggaggaaatgagagtcatgtatcttccatgtccttccttcaaaatcgccaagccagaaagaagtgaaaaatgtggtttttagacattgatacaagaaaatattaagtagaagaaacaaaataaagccaaagggataaacatcggaaggttgcttaaacggcttggtcccatataattgcttttctgtcagcaggattattaacagtttcagacatctgaaaattaaattaatagcctgaaaatattttacagaatgagatagagcatggtacatgaaacataatgaccccactgaaattcagccaagccagtgcagctactcatttagacagagtagacaactagttaatcatcactgagcaaattagacgagcaaattagtttgctacattccacagacttagctaccaaaaagagtatatgtcactaattagaatgaaagaactctaagcatattattatctatatagaaagagaaagcaagattgtagctttgaattgctcctttcaaagcttgaagcctaggttacgtaggtataaattacacatgcaagagtccatgtgtatgtatgtgtgttcatgcacataatttaagtagcaggcagcctttgcattttcttgcatcttgacctaataaagtctaaaaatgttttccaaagttgtttggaattctttgggagtatacacacaccaagtgaaacatggaaacatttttaaaaatatgattcctttaattgaagatcaaagtagccatttcatacactttttcttgcatcatattaaattattttttcttttaaaaagtgtattgctgttgcatgtgaaataaatatttggacttagtttatcactggagattaatctgaaatcatattttctagccttaattagcattcatttgcttaattgtcattctcagccccatcatttccatttttcactaacttgaacaatgctatcttctgctgtttgcactttaatttaaatttctattaaggtttatgaacagtaataaggtcctgtttgaatattcattagcttctgaattgtgagctatgaaaaggtgctttcttttaccttaatgaaactggcacagcatgggactgatcagttgtgacatttgatttgaggcatccagtgaattttctcattgtttattgacacatcttgtccaaacagctccctcgcaagtgagtggagtaatgaaggagagagtactgcagcggagtgtcgagctttcctggcaggaaccagagcatcccaatggagtcatcacagaatatgaaatcaagtattacgagaaagtaagtgctaagagcaactgaaatgtacaatgtgctgtgtgtctcatgtcatcctactgtattgtagactaaagttggtcattatgccaacaatttggagctacttcaaacttcgtagttaattttagccatttataataaccatctctgtgaatctctggcttatcattataaatgtgatttctgtgtattaagtttctgtgttacacaaatgaaagtatcccatttgtagcatatatatttatttatttattcaatttctgatattgtagtaattagatgtaggatattttagtaccacagaaaccacacagcccaatgcattttgaaaaatattttctttagtatgtctgtttgggaccttaatggtttgtttaatttatgtggtttcagtgatgataatgacctcaaataatttaataatttgaaataataagaatattttgtataataaatatgtagttcttcagacttacaaatcagatgatgttatttcactcctttaaattcctcctgaaatttattttatatatgttttaataatcatgtatgggacttatttacacctctccttccaggaaaaatattatggctttttagcacccaagtgctgcctttttaatccacctataatgactaaattttagtaactagcgatacatctgagtatatgagtatatttatttctgtttcatttggaaagagagagaaaatgtttatgtgagccatgttcacagatcgtgatttaaaaccccacctcacagacagactcagtgcaaggtttgaaacgtggaaaccattgctattaccaacagtaacagtaataagtgttactatttttggcttacctgagttacctgaagtgctataatacacataaccattttaactgtttagacaatagaattagaaaataggagcttaaagctttgagaaaactttggggatgaatggacatgattaaataaattgaaatgtatatagtacattggcaatagatacctttgtttttttaaagaaaaattagtttaaaatatgattttgttttaatgttcagattaagtttaaaatatttttgcttgttacttacattatgaattcatgacttcatggctaaggttgcattttatatgcttcatttatcgtcccaacaaatgtgttttagaggggattattgtttttaatgctggttttggtatatctgttttcccatgagagctatcagttatattctctgcttaaattgcatccaatttcaaaagcaatgaaacacataggtggtaagagtaaagtttcttacaatataaatctgaaatattttgcaaatattttctctagaataaatatgttcaaatcattttttggccttacagaaatctacattcactaaatttgcatattaggcaactaaaagacaataataatattgtattgtattatattgtaatgtatatgcacgcatgcgtgatgtttgtgtcacctgagttatgcctaggtctttcgtttgagataaatacatgtaatacaaactatcatttttataaatgattataatgaggacaatcacagatcagtttgagtgaatcaagcttaagtatatatttatttacacttttgcaaatctcactgtgaaggcaaatcaaacaacttgattgacattttaagatttcaatgaagaatttcattgccagataaagttgaacacatgtatttattatacaccaaataagaactctctaatattgtatattatgaagtataatttttacaacttttattcataaatagcttgtgagaatcatatcaaggaagatttaaatttttatttatttaaatattgttttgatggagtttttatatgcttgagtttttacatttattcccttcttaatcttactatatatgcacataaaatatgtttgataatgataggataaaaattgttaataagcatataattgattttagtaaatttgcattagcttttatatctgaaatatgaacaaaatgaaataaatcatgtttaaaatattttcaaaccataaatcatatatatttaaactttaatatttataattttactttaaaaatatttcattaaactgttttgcagaagtggtttattctgtgagaaattcagggttgttttaaaaaaattggtatgtcagtatagtagtagtgttatctgaatttcttgatttaataactttctggatttttagcatctggctttttttcttgctgaataactttcagaaaaaacttaagagaactacattatgatttgatgacctctactaaactgtagattgtacaggtgtacccactgtttgaccaataggatattttattatattatggctaaatagttcttgtcacatattacttctgcgaaagctaaaaacaccataaatgttttaactaaattatttcgccctaaatatatataacaaaggcatgtgtttcacattttcattttatattaccttagaagtgatttaactttataatattccacaaagtacaatgtagcctctataaaaacaatggagcaaattgaattaaattgaaacagttggctgtcaaattgtctggttgcaatcacaattaaatatttcctctaaatattgtttctaggatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaaggtaattatgcctttggtttggattcctactctcaataactctagcatatattaatatttttttcaatattgaggtgatcatttgcaccatcataatttttacatttacaaataaatatatatgtacatataaatgtactttgtaaaagttcataataatttaacatttgctgttttgtttagcaattttagaaccttgtgatttaaattagtttctttaacgcatacaagatttattttttgaaaaaggtgaaattagaaacagaagcaggactgattcaatttgtgtattgacacaagatgtgtttgtcgacctcgaaacaatcttattctaagtgtgtccatcaaagcagctacttcacagaaacccacaaatgaagccagaatgtgtagtgaggtggacaagagaaagatggtatctaagaacctgtattaatttaagtgaattgccctttagcaatgatttcaaaaattagagttcaggaaggtcttagaacttgtttttatttttgtttttgacatttttcatttttgttatggaatatttcatgcatactaaggaatctatttaaagtagatatgaaatataagggagataattaaatgaatatccctatgaccactcatcttaaaaatagaatataaccagtatctttgaagcccctttatcattttatgttttacaatgcaacaagattatagtaaaaatgcatgtgtatatatagtgtataagaagtaagcagatatatcttgggatggatgtccccatttgctgtcagagtccaagttcagaacaccctgaataccactgctgttgctcctcaacagagctgatgtctcagtacatgtttctatattttggagttttgattcctcctgatgttactgctcaggcacatggtttacccaggtgttatctcttctccttgccaatccagccttcctccaaaattctaatcaaaattaagttggaaaatattatatgacttttctcaattaaaaatatttaaacaaattaaattaatattttgattaaagaattattttggctttaaaggaagaattgtatagatcttcaaaaggtggagtaaattgataaatatcctttgcattaactaatgtttgtaaagtttgctagcagtattattcttccacatattttgttacactttaaaataaatctgtaactcttatagccacaaataataaaaacgtatgctgaaatcattttgacatataaatcattcacatagagttgtaaacataaaggcatcagtttaaaaatttactacataatttgatgtggtaaacttaataccattattcatgattattctttttaaatagattatataagatcaagaatcagcatatcaaagtttagtgtcccccaaaacattaaagcattttaagttaagatttcaacatttaaacatttgagtggttagtgttaaaatgtgctctagtaattttcaactcagatctatatcataatatcaccctgtaaattcagatataataagatacttcaaattatgtttttcatcttttaataaatagtttaaacttaaaatgtcagttatctcacatttacccaaccattccttattatttaaaaacacttttagatttcaaaagtttcaagatgaatttatgccttttcctgactttgtaaattgagaatattaaaccaaactatcatttaatgtgtgctgagattcatagatatcatttttattatttaaaaaagaagtaaccaagactcagagattaaagtagtggaacctgaaagatcacatgaaatgtatgttaagaatggatttttgcattagaatttagtgatttttactatcaatatattctctcctactggaatgtcaagttgatgaaagaagaatccatatgtctttttcttactgttgtcttgccagtgcctactatggtttcaggcacagaaggcactcagtaaactagcaataaatgaatacttcacactgatcaacatagagtgaattattaatatcaatcagtatcagtagagagctgcctggtttcaaatctctctgctctgccatgtccggttataggagtttggatgagctgggtctctgtaccctaatttctagtatagtagtactcaattcacaaaacattctgaggtttaagttaaatatacaaaatgtcaaggagagcccctatcatggaaagtcttaagtgtcagctgttattaaacacagcctttctcaaaattttccatcccaggagcccttttactattaaaaaatgttggggatatcaaaaaatgttttatattggttatatcaattaatattcaccaaattagaaattaaaatggaaactttaaaaacacaagaacacacaaacattttattagccatcagagtcatagtattatcatgtcatataccttctgaaaatcttaactgcattcataagcaagtgagagtaaaaaagtcaaataacatcttcatattatatgaaaatgactttgaacttgcagactctatgaaaagttcttgaggactctcagagttttccagactactctttgtgaaccagtgagtcagcataaggtactatgctaagaattaaggaggcacagaaacacacagttcatgatctttattaaaagttcagtgaaagacagggacaggtacacagattctggccacacaattaagcagtggtggaatgcatggtccagtgatatcaccatgtcagggagcagtgacttgctgtgccagaaagcaggtcagaaggtaagatgcagcctaaaagaagtcacttgagcactgtttgtaaagagaaatttgacagtctcttccattgcacatacatcctaaaatccccttctgtgcagtatcctatctactgtttcgagtttttaaaccatgacattctgtttatagccttagcaaattacttttaatatgtattgccctgaaatagatgaaaatattaaccataatgtcaactatggaaagattaaagtacgaccctgacaatatacaaaaatgtataaataaatatgcacaaattctgattcatcattcacctgagttcatttttctcattagagttctctttctgaagctaagggaaaaactgagcctaagacaagcagagaattaggcccatgggacacatcggttgaatggaaagaatttcataacatatgtacataattttttcttcctcatgactggaactactccattctttttctttcttaaaatgtacattaaaaaacagactaaaaacaaaaaataagcaaatttttaaaagacttgaagtcatcttttctctgttgtgtgataataggctgtaattcagaaattagtatttgaaagttgttttcttcttctgtttttttaacctttttaagttccctcagggagcaattcagcaggtgataaattagagaatgtgtataatcttctttgttcagaaagtatctattagaccagagcgatttttcctgtttttcaacacaggagctatctcttgttagcataggtatacaaaattaagagataagttgtcaaaaggagacagacaaactagagaaaggccaatctgaaaaaaactttatacttcctattgtggcaagatatgttttgccttcatatgaattacttctctagagatctagtcccttgccatcaacaagaaggaatggtatttcccatcctgccttaaattaaagattgcagctcttgattgtttcagagatagcaaattatattagtttgacattatgtattttatgatatttgcaactggatcatttattggaatattcattttcattgtttcatatgtccttgatgattttataaagtctgtattgctactgaaaatatgaaactctgggaaaatatgacaattgtgaatcatcatataaataaaacttcactagtttggaaaaatggaagtgataagtgcaaaaattctatatcagaaggtgttttaaaagacatgcaaacatgtacttcttcccaaagagactgtcagaaaagttcagccaggtttgccttaatgagcatagaagaattatttagtattgtataggaagggtttgcagttaggtaatgatagtgttttttaaagcacttgcagaaagtttgctttttctaaaataggctagctactttgtaatcttaaaatatgaaatgtgtttactcatacttcatgaaaattaacacagacaatgtggctcatctttttcctgaattatagtggactataaatttatgatgtttatgattacatgatgctttccattttaattgatgatatgagagataaagcatttaatgtgtgttaaggtacttcaaaaatacatgaggtatgtattttggttctgatttcacataccaaaaaacaagacacaaagggatcaaaatcaaatgccttgctgaggaacaatagggatttaatagcacatgcagatcagatgtgtctatctcttgatttataactaagctttcaacaactaagcaggaatataatcattcaataaggcatttatacgttcttttgtagctgataaatggaaaatatgtgaaagtattgtccttacaagttctttaaaaggcagaaataaacatttatttaaatttactttgttacaatataatgcagttatttaaaattataaagaattaaatagaaaagataactctaattttatttaacctttcaagttcttgcatggtgtcaagtatttctgagcctatttcctctgtttacagctacagctgtctccagtgaacagaatcctgttattatcattgctgtggttgctgtagctgggaccatcattttggtgttcatggtctttggcttcatcattgggagaaggtagaacacaaagttgttctaatctctaacataaaatgtattgttttttaagaattatgtcagcctattacttagtgtaataaaattttaaatagtaaatgcaaacattctttgatataaaacattaaaggtcaataatgtgtcattccttcaagatcaaaatggaatatgagtttgatcactgcctttcatttaaagagaatgagtattgcagtttttattgggtgaatatttttgcttattttcagagttaagttttcataataaatatagaatatacctggggaaatgtttactcttttagctattaaatgtttgtggacaccatttaaaaagtttttcttttccagaaagaaatataagtaaacattcacctgtgactatttgtgactcatgaatatttttgtaaattgaaccttgtggattcaaatcatactgaattttgtgtattcaatctaaatgtattttttaaaatgttccttttacattttctcacacaaaaagtttgttttctttgcaattttaatcgtgaatcgctatattattactaaatggattcataactatgaacagtaaatttaactctagtaagttgttgagtaactaaggtacattgtactgaatattaaatatataaagtaaaatgactgagattgtcacaaatttgctttcttcaaggcactgtggttatagcaaagctgaccaagaaggcgatgaagagctttactttcattgtaagtgtttggcttttctttattatgatgtacccctattaacagaaaaatctggttattagcattggcattaacaaagtcctcatgcatcatgcttgaaattataccatgagctcaaaatgttgctttaaagcatttgaatcagatgtttagaattaaaatcatgtgatgtgaatttgaaaaaataaaatatgttcagaaatgtcatataattgcaggatattcagctgcttttacatcacaatgtttcattttgcaaactttgcccaagtgtttcttaccatcctaataataatacattaaaggttgcatgtgccccttctctagctaaggaatgtcatgtcaggttacaaagataggcccttttttaatccaatgagtgatgctaccacaaaaggctaaattaaggagcctctttctcttcagctactataaattacctatcattgatagatatttcataggacataaatagtataataataagattcatacttctgatgttttcctatggatttgagttagcttattcttaaaagttcattttagaaatcatatttagaagaaagcttagggacccaaataaaatagatgcctatctgcattaatcttattcttgttgcaatgaaacaagatggcatgtgaaaatgagagcactgagagtaactgttattactttatgtaggcaaaatcaaaacctaacaaccaaattacttcagttatgatagttgatgatgttcttacctttacctattttccccatttttaatccttaagaatattaaaaaccaattttattattattttgtagtacccataatctttggcaaatgttctcatgtgtagataaatttcccatgacataagatgtaagaattgtatcttttgttgtgttatttattagattcttatgtcaatatctgtgaagatactgtcctatacccatcctaaagtcataagaatatcaaagcctccatcaagaatttctaatacattttagattttctttgtgatactttttttttaataaaaaagctcaaatgacaatgtgtggtttaaatacacaaattgtaaatgctcttatcattcctaaattttctcaatgtgtttgtatttttgaaccaacagttacctttagttttcaaaacagaagtgcttttatgtaacacaaatccaaattgaataagaaattctcttgaatctcaacctctgatgataggaagggcatgtggggtagtacaatttactacaaattgaagttaaatgtatgcccggaagtggctttattataaagtttaatattcaaggcctcttactttcacaggccttttttaggccctgggagtgctgtagcaaatttatgtatataatcatgtattctttcccctaaaaaaagtatcccaaactgtatatggggtaagcctcaaaaaacttaatatacccctgaatatgactgaatatgtgtgtttctataccccacttgggattatttgatatgcccccaatgtcagaacttccttttgctaatctggcattaattttcctgcgacaagcctcagtgaagagagaaccataggtagtttatagctagaggaaatagagaaaaaagtggaggttacctttttttgtttctatttaataacatgtgagaatatttttaacacttccccagacaggaaggagcagatcaaaacttgaatgcctaaattttatttctagtgtagaatgtatatagaagagtaatataagactgtagttcctgaaatccctggtcctgcccatatgtgaacaatttaatggcacaattatttaatattaccataatcagtatgtcacttttcttttatttattgagcatatttgaaatatcccccagtgatcacatacaccagtttatttacttttaacttgcaggttaatgcagaaggtcagttgaaacatggcttatccaaaatttgttgtatagccttatgcttaattgtcatcagtcagttttaatatttttatgccattcacttttttcacatttcacatccagtttgtaattagaaaatatatagttgcatgccttacttgctaatatagacaagataaacttgctgtatataaagttttcatcattagagaaaactagcaatggtggttttaagatattgaaatttcatgagaaatcaaaataatattttaaaatacaaaagttcatactcaagttgggataaaccagaatattcagaaataatgtcagtattttccttattttaaaacattcatttttaaatgaataatgaaaaaagtgcacttaacatatcctatcctggtaaattcttaatattttgagtcaccctttttccaaggatatgttttcttgtcatttgattaaaaccaggtattttatttgattttatgattacttaatatagaaagtataatactgtggtaaccagctgtttacaagttgctgtctttttattcctctatttagtacatggacaattttcccaggtgctagaacaccagattgaatttttacagaaacttgaaagcaaccatttaactagcttttagagcactgaatttaatagaatgtccagtcatttgtatcaggcaccctcaacttttcatggccccaagtgctacatttaaagatataaacacaatggaggaatttagtgaagcaattcgaatttacattttgtttcctcctaccatttcttctaacaatgtcttcaaatccaagctgggcagtatttcatgtttttatgccaaaaaaagctctggtctgtcaaaatgttttatgacagcttgaataaagaaccatcagagaccgtttgagatgcagaaggttacctccaatctagctcccttatcaaaacaaaattttaaaaaaatgaaagaaagagagaataaaaagggagaagatggctcattctccatctgcctgccaatctaggaggttaacctattgttttcttcccttctctctttttctcttccccttttccctatactccttcttctctcttttctccttctatcccctctctcttttcttctcgtgttgttttttttttcatcttcagctttagtaacaaatgagcatctgtcagttttataaactgcaacaataattgtttaagacaatcaattttggataaacaatcaactacagcagaataaatcaagatttttaaatcccattttcctttatacattttgcttctttttgttatgtgtttacttttaaaatatagttttaatgtgatgacataagcacagttaggctgcagtgtaatatataaagaaatatattgttctccaaatagtaagatttgatgaaaagattgttcagtggctttgttaaaacaataaagtttttttgaggatatagtgtaatttttattgcattaatataaccaaatatatgcctatctatcttatctttgtcttttaccaaatagatttggaatacattattgtaattgaattttatttaaagttgacatagtattatctgttacctgcatgcttctgggtgcattttaagaagattttaacttttaagattattctatgttgtttgcattttgactaccttttgtgaggcatattggctacctcctcagcagttaagatcttccagagccttataattgaaagttcatataaaccattcctctttcaaatcgctgtcatacttggttaacagatcccaggaatattgtaaattttctaactttactctgcattttgtatatctggcctctattgcccttgaaggtgaagatgaaactgtctttagaagatatctctttgattctgtgatagaagtccctcacatcttgtattaattttatgtatatatcaacggtggttggtctttaaaaaaataaatcaaaagaataagtaagatgtctaaatgtttttaatattgctgtcagtgtagtaggctacctgtaaatgaaatgtcttcttttcccagtgtattaatttgattgattgactgactggtagatttacaaatgtgtttccaagtccattacaaaccttaatatggcttgaactatgccatgatagcagtgaatttaattaaacctccagtctgataggcatgtcagaaattttggtgaatgtcttttgttgatttactggaaaagcaattcagttagtaacctatgagctggatcctatgttacctatagaagcttgcagataatacctatacgccagcagactgaagtagtctgttaaaactgctgtgaatcaggtgatgtggaagcaagttcactgttccaaggagcactctgcataatgaaattcctgggctgactgcacaataagtgctttgcttcatcacagtcatgctttcttacatcattacagttaaatttccaggcaccaaaacctacattgaccctgaaacctatgaggacccaaatagagctgtccatcaattcgccaaggagctagatgcctcctgtattaaaattgagcgtgtgattggtgcaggtaaggctattgtagcttcctcgttcagctgttccatttagccaagatcgaaagtcatacatcataatgacaggcaaataattatccctcaagtatagaacttttgcatttacctgaactgttggaagcagtgaggctgtacttgtttatgaaatcttatgaaaaaatgtgaaaaactagcatgtggcacaaagaatccatatatttttggttttctgttggatttttaagatattgttctactacaagctactttataatagctctggcctgtcatttaagaaatgaatttgtatttttaaaaggtcagaaatttccagaattttgctgcacatttccttttacttgatttactgtcttcttacaaaactttcatttttatcttttctcttgtatttgtaggtattagccattgtactttaaattcatgtagaaaattaatgtgtatgaattaaagggaatattttctatatgtatgtatttttatactaattatacatttctgattctaattcctttaaatccagtagacatagtgcatataaattccagattttaaatatttaataaatattttcttctcaaaattaaaaggaatagcaatgtttagaatttgctgatgtgtcctcatgctttagtaggtagtctaggtaatatactaatataatatatataaaaaaatttttaaatatataatatataatagcataattcaaatctaaatgttgaccctgagtgttggttaattcaattgaaaaatagtagcctgtttaacagtttaggaaagcgtaacttctatgaaagagctctgaactgtatcttcaagttttaatttcatttatgccattattttcataaacaacttttgtgtctaggaaatagactcccctatatatgggaatgtattcaatgtaactcacagggctttaccaagtatttttgaaaatattttaaaatgctttcaaataatttactaaaagttaaagaaaaataattcaacgcatttactcttaaaagaaaattacaatatttagaaactaaaatatgcctgcttgttctgttacttcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccgaatgttgtccatttggaaggggttgttacaagaggtagatattggttatatctttattttatcaaaaagactgagtgtcagaaattagtattattatgtacacaataaaacaaattatgaaatatgttgcacagtctaaatgaatgtgttttcttggtatgtaactaatcaaaaaattcttcctttatgttatcacctcaagggaaaagaaagcagaaaaaaaatgaatgcaagattagagttgaagaataactctgatagatggaatgactgataaatgtttttatttctcttcaagagacataataattatgcaatatagtctttacattttacataaagtgtaattttctctgagttttactcacaaagcaggagtcagaagaacacagtgacttttatttatatggtttaattttatgaatcatgaccatcttccaagcagacatataatgactttttgagcttagcagcaacaataaaagaaatgctcatacttctcacactcactctttcaaaagaacaccatgtattttattgggggatgagaaaggaaatgaccctccagctcaggttacgactcctgaaactttttttttttaattttagggaaaccagtcatgatagtaatagagttcatggaaaatggagccctagatgcatttctcagggtaagtaccaaagtgatccacttattctaaatatactatgcttgctaccaatataattttatgaactttttttgcaatgtaaaatgagagccttgtaaaatagtaagaggttagaagattgtctttgaaaatcagattaataatcagagttcaagactagattaaactagaatattttgagcattgaagtaatacaatgtggtcaagaagttatttccattaatattattacctgaggtatggaggatgcccgaagccctgtaatttgaattcatgttataaaacagtatatacaattgtaaatgaaatatagagataatatggaaaagactaaaaggtgagataaccattctgtgttgacactatgatcacaactctgctctgtagaaccatttctattttattgttaggtgaacaccaagcataaaatgtatgactattaacattatttttcaaattaatggtatgtggtttatttgtaaatgacatataaatccagaatatataaacatagatatttttattctcagaggctttttaactaagaatattaacatgtgaacatttttccaaatggcaaagaaaaaataatctaaagaaaaagagaacatgcaaagttatttaatatgatctagaatcatatttaactcaggcgtataaacagtcataggatttagagaaacttttattgctgcatcatcatgataaaagtatcaactagaaaattaatcaactcagactagcatacttcatccagcatgtttatattcagctggagtaattttttggttaaaatgggttggaagtggccagtctggttgcaaacagttctcaatcccatttgctagtacatctgtcctagagaatccttgttacaagtaatgctcctatcagtagcaaaactaagaaaaaatgaaatggaaacaaagtggccactacaattactttctacattttagtttctcttcattttgcctcaaatatttcccccgttgctcttttttagcatttagaggaaaataaaccttattatatgtatattaatttctttatatacttttatattatttagactttttggcatgtggggaaaacacttagctattgggggtaattttttagatactctatttccaaacttaaaaattagcatatacttttggacttgtgcaaactcaaactgttattagttcattttaaaatatcaaattagtataaataactaaatgattaccaaaattatcttatttggctgtcagctaaataagcatgttatttttttccacaggtatccatattatataaaaaattaacaattcctattatacaatagcaaattgctagcacgcagatatttttcatggtgatttttgtcccttttaaagtatgcagttaactgggcttttatttttgtcttcctgcagaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactgtaagaaaaagtcatttactgcacttcttcatattcttaagatttttctaccacgaaagcaggacctaataatgtaaaactaaacaggagaaatgaagcaaattgagctaagcattttgaggttgctttttttgttttttgttttttgtttttctggaagaatcattgtttgtacaatatatatatagactaagaaggaaagtgttgataacatgactgccctatattgggagagtcatagaatatagttacgtacaaaaacatctagctactagcactcatatttgtagaaaactgtaatcacattttaaataaagatttaaaggaatattaactatgctaatccttataacttttgtaagattagaaaaaaagaaaatatgtgagaatgtatttaaattatccatattttatttcattttcatagtaactttgcctagtttgtctttgttgtggctgttgttgttgttgttgttgttgagatggagttttgttcttgttgtccaggctggagtgcaatggcacaatcttggctcactgcagcttccgcctcccgggttcaagcaatgctcctgcctcagccttccgagtagctaggataacaggcgcccaccaccacgcacggataattttttttgtatttttagtagagacgggtttacaccatgtttgccaggctgatcttgaactcctggcctcaggtgatccacccacttcggcctcccaaagtgctgggattacagatgtgagccacagcacccagcctgtcattgtttgttcaatatactcttgccctaacaccacacaaatctcaatcagttgagttgccttgtaaacttgaaatgatgaaacttgtaatggtattctaaaaatcagataaataactttaaatacgcatagagattcaagatgggtagacctgatgctgctgaactaccaaccaaaaatgcacatatgtatttatggtattgccataaataatatatcagttattatacatatttaaaatgttcatttctttttataacagggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgtaggtgttacattcatttaaacaaaaaggattgaatacattaatagccagtattactggaacatgtaggtaaaggctcattaagaacacttttaaataattataaaaatacagttttccacaattactaccacactaattaccataaattagtggttctactaattttattattttagctttcattttgaataatcactttctctttttataatataaattctatggacacaaaatagaagcttactaatgatatttcctccttaataaagataatgtttccacacttgcacagctggagtgggagcatcacatgagtaaaagaatcatttgtgaagaggagggaaggaagtttggttgtgctttgttttgtctttgaagcttatctttttcttttagtgttctaagaaaattctttaaattatctactgttgattggtttaagttttagtttcatgggacaatctagattttatgatcaatattagtaaatgtttcatagtgatattttagaatgtaatcacaataagaatatctttggaaattccttttaaaagtatatttattaaatgtacataccctgttgccatgaggacatgctaaaacataaaacatactgttttccgttgagaaaagaaactgatggtagtccatgtgagcgtgtatacatctcacaccaagagaccacttataaaacaatatagcaaaagtgcaaaaaaaaagttgcttttattaggttgagtttgttaaaatggccattttgtaggccaagagcacttatagttcaacctattgaaatatgagtgaaaattagataaatgtagagccagtatgaaatctaggaagatatccaggattgtactaaaaatctggtggataccttggttcagagctgatgagccaattctctaaggaagcacactggaaagttgagaagttaaggtttagaggtgtatgaagaccgatcaaatggactcacttttctataacagagatgtagtacacttgtggtaattagaaatgaagatgtaggtttggacaaattgatgaaggagttttcagaggagtctggaaatgatactaatgcaaattcttggagtgtggagtcaaaaaaataagtagtgtttaaggaaaatctacattgggtcttaaaacttacagtagtgatttttagacaactacaattagactgttttatatgttgttgataaggttatttttgatacttgccctacaaattttttcattaactgagaagtccacagtctgaaaagaggaaggttataaatcagttatatctattgatattttgaattggatgatgacataaaactttttcatttgctttttgttttgtttttgtttttcaaagataaaagtctaaatgatgagtctgtttggcagaggcaaagttgttaatatttgacaggtctcagtgtcaaagatttcatggactgtcaaaatttggacaaacaaatccttagggcagagaaagagaaatatttacattccctagacactccatggagtttcatttcttttgacaccttccttctgtattggattcaaacataaagggactgacaggactgacaaattcagagttcacttaacttccaaaaacaaataatggaaatggttaagaagaaaaaaattaatatctccaattttaaattttaaaatgtgttaagtattgttttttgtttttcttaaaaatgaacattatgaatatagccttactataccaaggattaatattttattagtcaaatgacataattatgtctattgtgcagtttagttttaacctaaaatatttggcacattctttaatttttttatttagaaggtctaaaataattaataaatttggtcacaggtttgtttagcagtgagagattacctagataggtcagtttgtacagtgaaattgatattcatattcttcttattagataatattcattattttataattatgtcagtagagtgctatttgaacaattatatgtttaattttcaatatgcaaatggagaaaaattagataatttaggataatgatttccattctgggataaaattttctagataaaagcttttttctaggaatctgtggtaggagttcatggagagacttagatctatgaacccctgtgaacccctgatacatgtggaaactgctgtgtatgtgtgaatatattattttttttctgggaaggttgccttcctcagattttcagatgtattcattgtcttttaattagcctagatggatttatcaagtgaaccaattaactctacattattaaaatttagttgctaggaatttgtcagggattttagaaagccctcaaattttaaatgcctcagattttaaaagattttttacaagacacaagaaaacaagatgtacagtgatggttacatttctaagcaagtccacacagttccaggctgaatgctggataaggtgaggtttttgtaacctgaagagacacaaaagggtggtgtagaagaagctaatgagtgagaaagttctggactatctgaacagtttgtgtaactctggacaaggcaatgaacaagaaaaacctagggaaaactaatatacctatacatgaccagactcatactcaaataggttatccattagttaacccttgaatgggcactcatttgtatttttatgtgtctattattttcttaagttttaactacaatggaaacagtcggattcagttagttgcaattaaaaccaagaggttgagctttccaaataaatttccaactttcgttcttctaaaaaatctgcaaacatttagctctttccattaatgacttttcaaagaaaaatcttcatgtatgtaaatgtagtcaaatataagaaatattgtggaaattgaaaatatccttttggttttcacagcagccatcttttaactgaattttatatcttgattcatccaaatcaactttttaccctcaaattatgaaattttgaagttttttactatatagattttttttcttctagcagtatttttcttacattagtattttaatgtattgtaatataagaaaaaatactactagcataaaaagaataaaatctatatagtaaattagtatcctaatagttaacataagaaaaaagtatttttaaaaaaataacgtaagaaagtatttttttcttatataaaactaggccagtaaattgttaattttcctagtaggtagatattaggatgttaaaaaatttaagcttttttaaagatatgagacataaagataattccttaaagccatataagaaaagtcatttaagggcttggaaaatataatatattcataagtaaatgtattctcagctaaattgtgagacctcattttccttttaaaagtcatcactgatttatgactttatattttttcatgttaatatagaagcaaaattatgatgttgttttatgtaaaactttgccaaaatctcataagtgaagtccaacatatttaattgcataaaatgtgggtcatgttattgtgaggttaatgaaatagaaaatgagtattgagcagaggacagaagccaatcatgtcatatgccattttgagttattacaggctcgttaatggggtcttactgtgttcctttttctcttaattacaatggtcatactgtaataatatggaaacacttctcagtaagtaacttttgtttttatttctaagtattgctttacagcatttgccaaagaagtggtccctgttgtgtcccagagatcttttttaaaattacatttacccaaatcacttctggttcctctgggaactatttagatatagaattggttatgaatgaattttattagaatactaaggcaaatacaaggagtttctagtaatttcacaagaatatgtttcagatgaattcagtgaaccaattacataatcctctaagaagtggagggccagctatcttacctctgtgcattgtttttccaagaatatctaactatatgaagaatgtacctattttttcattggaaaaataatgccattcttaacagcacaggctctggtctgtggcctacgtcaaattctgtcttttctactaacagctacctgatactgactggccctctcttttttttcctgtgcgccacacattctttatctctagaatcagtataataatgatacttaaacctaataaggtttttgtaagaatcaaataagataattcaagtttaaaaccatgccaatcatataataagcacttaataaatattaacaatgattattagttgcatatttaacaagaaaattgttttactgctaggctaataaatgaaaactgcagaacctcaaagttcagtttttgcctcaattagctcctattggctggttttgtttcaaagggtgtatcttggattatgccaaactgctctataaggtcgaagagttcccagcaagtaccttaagtgttcatgtccatagggatgtgactattaatgagattattaaagtcccaatatctcttattttaaatgttatatcttgttgttattcctttaaaaatgtataaaacattatatctttgaatatagctaggagtttcactttgaagtgagatcagtgttgtttctctacaataacaaaaggaatcattaaatttctgtaatgcagtaggacaactacagaggttcattaacttatttttctaataatcatttaatggtcctatgttcagtgctacaaaaacttaagaatatattgtgttgaaagctaaagaatcaataattttaagtgttattctgaaagcttgaagtgctattgaaaagtattatgtcaagagggcatgataagatttagatttacattttaaaacattatttggagggaaagaaaaaaggaaagatcactcgacttacattgttcctttcaggacacctgaagataagctataagcagggaaataggttaggaggtggtgggaaataatgaggactgaattaatgttatgagcattagaatgcagtcatgtcaaatcagaaatagactgtatgtgtttaaatagaagcagcctcaaagacaaaaagccgctcattttccaatgaaaaaaatacccccaattgcttattgtgtggtcattttgaatatataaaatttcagaagttattagtttatttattcccagcttgatctgctatttaaatcacttaacccaactttctaaaagtaaattacttttacttttattcacattttttaacatagcatttttgaatccaagtacagtgctattactggaatgttttgcaaaaccactgaaattcttagcatttaaaatgttttttaaaaaatataatttctcctgtacttatatatttgtgatccttgcagagttaccatttgtatgtatttgtttgatgtatagcttttaaaagggatattttagaggaatatttacagtgatatgcaacatttgtaattacgggatcataaaaggaaatttttaagttctgtcatatgacctccattgcatttagtaccaacactgattaaggtcacttaaggccaaggtgttttctccataattgttgttcaaaataaaatacttaaagaaacacctcagtgtgaaactttgtaaagacttaactatgagataatcactccatcacttcagggatatgtatatatagagagagatatataaatgtagatatagatatggaaaaatactttttctagtatttgagcatatattgtatttgggaagtagaaaatcatcagaaagtggtgactaattgtgtatataagaggatgtgaggcaggaggatcaggatgtgaggccctggagttcaaggctgcagtgagctgtgatcgtgccactgcactcctggatgacagagcctggatacagagcaagactccgttttttgttgttgttgtttgtttgtttgtttgtttgtttttaaaaagagagagagggagaatgaaagaacctgggacagttttcagctttctgactgggactggatgtgccgttagttgaaatagtaaaggattgggaagagaggtgataaattcaattttaaatatatacaggggaggtacctatggacaattcagatgaaaagtttaataaactgatagaaatacaacctagtgattaggagagagtttggtcttaaattttatacttatataaattttcaaaaattactataactaagtccatctatttactttttaaactttagagttagagatttttcttaaagaaaaaagtatacttttttcccttatacaaaagaattttttttcaaatattgttgatgccaagtactgtactcattacatcctatcctacaaccttttatattttaaggtgctatttttgaatgtcagcatgcatcttaaggatgtgtttccctaaaaatattaagaccatcaacatttcttaaagccagctttttgtttgcctacttttggccttattttctttgaaaattcaaagattttttttttcctcagagggtcattttttgttacatttctaccattatatcagtcagtgtcaaaggatttgttcttccccctcgaatgctgttttagtgttctccgatcccttcttatttctgctgtttgtcttcttgttctcttccctttgctgctcagatttggaacattttcaggtttttaagatctatttttgcctttcatataaataaaaaacccaagtctgaatgataatttttctgattgctacatacaaatgtttataggggcctatttttcactaacattcaaagcttcatataaacagttttttaggctattggatataatattagatatgcctattaggcagtggtatgctattagatatattaggctattagatataatattagatatgcctattagataggcagtggtatgctgataaaaaaataataataaaaaccagctctctgggaaagccctgatttgtaccctttccctatttcctgctgtaacccttcccccacgctgatttcaatctgccagtgtaaggtaagggaacttggagtagggaagggatgcagtcgccactcataaaccagtacaacctcgctcctgtcttacaactactgtcttataacactaacaataagcttcatattatttaaaagactcatgtgcttggtaatattttctgtcatagtacattcatattattttgctaccctgtttaaaagtgaatcattttggctcattctgggtaactcaaattccttttacaacttgcagaattattaaatgtatgggcacatatggatactcacaaagatatacaagtaagatagttccataacatgttcccttttgaaagcctctgggatgatgttaaaactatttccatctattgtaccctggatgaacttaattgctgttccctattgctgaattaactaggaaatgtcatcatatcctgcacttcacgcactccttaataacatgcttaatattcatggaaattttgggaaaaaagtaagtcttttgtgaagcattgtgcctcattcttctctggataaatcattttgcctaccgggaaatttggtttattataattgaacctaaatcagtaatatttgtaatgtccttttggctattaggttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggtaagaaatgcctaagggaatggaatctgggagaaattacaatagtaacataaaccatttatctcctccaccccaccacaatggcaaattgacttttgtgttgacgtataaactcatattaaatgtattgcatttactgaagtttatttttttcttttcagttaggcttaccttaattagtgtttgaaaagaatctattagttattgcattttttaaacttacaagtatcactagctgcttttataaaagaaactttataaactggatttttgtgataagatagcagcagttcatattttcagaccaatattattattattacatgggtttttattactgttgtccttgttttttgttatatgcatagtatctatttaactgttttgcttcaagtcatttaataaatgattcaatgatgttaaagtttataagagaaattcaggctaggtgcggtggctcacgcttgtaatcccagcactttgggaggccgaggtaggtggatctcgaggtcaggagttcgagaccagcctggccaacacagtgaaaccccatctctactaaaaatacaaaaattagctgggcgtggtggcgggcgcctgtaatctcagctacttgggaggctgaggcaggagaattgcttgaacccggtaggcagaggtggcagtgagctgagatcacgccactgcactccagcctgggcgacagagcgagactccgtctccaaaaaaaaaagaaaagaaaaaaaaattcaatacatgattaaagaggtgtactcattaaaaagagtccattcatcctttgcatttggcttgcttgattgtaatgcatgttaatagttattcagcctcagacgccaggtaagattgatgctctggtttacattggtagtaagttaggcacctgtggaggtgttctaactccccaggcattcacaagaatgccatcagcaaaggagatgcacaatatctctacagcaccctcgtggcctgaacaggttagaacacagccatatgtgcatcatttactcccaattacttttggaaaagcaaatgaacaattatttactgattccaaatattgttggctgtacttttaaaaacatatggaagacaaaactgggtggtcatcatatctaaataaaatgtaaatttaggagtttgtagttactggcctcctggatgctttaggtttttattagcatatcgatgtattttttattatgtacaccaattaaaacatctaattttgttctttataccttaattttatatgggccaaaacattctttctttggtatttcaggataatgttcgcttttctgtttcatttttatctaggccaataagccctcttctggatcaaaacactcctgatttcactaccttttgttcagttggagaatggctacaagctattaagatggaaagatataaagataatttcacggcagctggctacaattcccttgaatcagtagccaggatgactattgagtaagcttaaactcttaaaattgtatttaaggatttattaggtacaatctacactttatacattaggttatcttctttatattaaaagaatttgaatcccaaaatcaagataaaaaaaatacttctttaacaagttcttactgcgtaccaggcattatactaaatagacctttaaacatattacctttttaaccttcacaacaataattgtatgaagtctatagtttcatacctatgttgttgccaacaaggctaaagttcagaaaatttaaatatttcccctaagccaagttaactagtaagtaataactaatttggctccatagctggtgttctaaacaccatccagtgaggcttcctctgtagttaacttctgtattatttagattcctattcactggggaaactttctccattgcaaaggaggatttctttcaccatgtttgtgttgaacttaaataatttcaaaactttatactcaatgctgaaatgcattagaacgtccaatatgattatttctgaagagatcaaaagaagcttaattcagttaaccatagcttaaaagtaagagttcaacttactttttggaagatgtatgatcaattcttttttttttaacctgaaaaaaatgacctgataaagcaacttttgaaatttctatgaacttgaagttaaaagaactcacttttcctgtctggctccatcactaattatgggttcctggacaatctaaaaatctctgaacctcagttgacttggctgcagcatgactttcatgggtgacatagttcctctcagtcaatgtgcttgaaaatggaaaacaataatcaaggttccatttgtgggatcctatattgtactgtcatcgtttttccaatgagatgaagaccagcaatcaaatattattttctggtatatgccaggaaatgtcacgtacatgggtttaagtgtgtgcatgctattttgttcagttttcttccagtcactatgtgggcatttttacacttgggtccccaaagcaatctgtacccctgaaaacccatgtttctcagtcactgccatgaaaaactacggtgctatagttttgcaatattttagctgcttgtaaagacatcagctcattgtatctggctattaagaaaggcaaaacacagatccaattcttaattcaaatttaagctattaaatttagatgtacattttaaaagatagtttttataacatataatgaaatgattgaactcactgaaataagtagataaccaataatatgctcagaattaccacacgttaattgaatccagtataaaaacttacatggtcattgatgagttccaatttttctactagatcccacaaactgttttcattatcctttatcaagctttttccagttagaaatttctaaatccctattaggttcaagaatacaacatttcaaataacatttcctaacctttccttaagttaataatagttttaagactttaataatttcttatgtaaaatttcaaatcactttaaaagtgaattgagagtaaattgagaacctgagcagttaggtttttacaaaggagaatgttgatgtaggttttacaattctgatctgctgcaggggtgtgatcataatacccaagaacactaagataagatctatttggctaagataacgtatttaattaaacagttgatgacagtttagtgccacatttattctttgtaaggtacctaataaaaagtgcatttgtctttttcagggatgtgatgagtttagggatcacactggttggtcatcaaaagaaaatcatgagcagcattcagactatgagagcacaaatgctacatttacatggaactggcattcaagtgtgatatgcatttctcccttttaagggagattacagactgcaagagaacagtactggccttcagtatatgcatagaatgctgctagaagacaagtgatgtcctgggtccttccaacagtgaagagaagatttaagaagcacctatagacttgaactcctaagtgccaccagaatatataaaaagggaatttaggatccaccatcggtggccaggaaaatagcagtgacaataaacaaagtactacctgaaaaacatccaaacaccttgagctctctaacctcctttttgtcttatagactttttaaaatgtacataaagaatttaagaaagaatatatttgtcaaataaaatcatgatcttattgttaaaattaatgaaatattttccttaaatatgtgatttcagactattcctttttaaaatcatttgtgtttattcttcataaggactttgttttagaaagctgtttatagctttggacctttttagtgttaaatctgtaacattactacactgggtacctttgaaagaatctcaaatttcaaaagaaatagcatgattgaagatacatctctgttagaacattggtatcctttttgtgccattttattctgtttaatcagtgctgttttgatattgtttgctaattggcaggtagtcaagaaaatgcaagttgccaagagctctgatattttttaaaaagaatttttttgtaaagatcagacaacacactatcttttcaatgaaaaaagcaataatgatccatacatactataaggcacttttaacagattgtttatagagtgattttactagaaagaatttaataaactcgaagtttaggtttatgagtatataaacaaatgaggcacttcatctgaagaatgttggtgaaggcaagtctctgaaagcagaactatccagtgttatctaaaaattaatctgagcacatcaagattttttcattctcgtgacattaggaaatttaggataaatagttgacatatattttatatcctcttctgttgaatgcagtccaaacatgaaaggaaataattgttttatattataactctgaagcatgataaaggggcagttcacaattttcaccatttaaacacaaatttgctgcacagaatatcaccattgcagttcaaaacaaaacaaaacaaaaagtcttttgtttgtgaacactgatgcaagaaacttgttaaatgaaaggactctttaccctagaaggaagaggtgaaggatctggcttgtttttaaagctttatttattaaaccatattatttgattactgtgttagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgataatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgttttcccacatttaggaccaaagacggctatagaaaaactcaaatggattgcttcccaaacccctccccaccctttttttttggttttaaatcactgtacagtgttatttgatattttaatttattttttgattgactagaaaaatcattttaatttcactaaaatgttttttgtccctaaggaaaagtaatctgtaaaaataattttaattagcataatacagtcacctagacacttccatttgtaatctttgtaatagactgtaaatatatttttggaactataacacaatgtgcttgagggttatttttcagtgtctgcagtgtgtacaagtgtttatactaagtccagcactttacaattctaatcagtagcattggcctttgtgagaatgagtgaaagagtttgagtgagtgttcttaattccttttggattctagactcactaataatgaagttcttttcttgttcatagcttaaggtgcttattttttctattaaaattaaattaacaaaagccattctagaaatagaagacatagtatggtacatgcaaacggtgtctttcctgcttttttctagcactagatttatagttgagtagtctttcttgagtagaagggcagaataaaagtttttttgagtttttttcaaaaataactttttccttcagcaatatacctcatctgccttaaattttttacagctctttacagggaaaggggagaagggatgggaaagacacacagcacaataggaagtgtatgattacatcactatctcgtttgtaagtttcttttcctaatcaacattatgatttcgaaatacatgtatgtgaaacaaatattaagagaaaaagaattaacattgtaatgctgattgtaatactctcttccagaaagagatgagatggtataacgataagaatgtacaacttgcaccttgaaatctttttttttaaataaattagtgctcaggggaggaaaagtagagaaagtgaacgtcaaaaatagaattccaaaattataaaaatgcaaaaggaaatggcctccttgctttaatagagccaccttttttagaacactgtcctcacacttgacctgtgttttgcattcagtactgaaataaaagtaacttgttctacatttgaatctaacattttctcagcaattgatctggtccttgtttactagaactggtggtttatgcttgtcagagcactattagttgaatcatattgtatacttatgtaatctacattagctagtactgtttaggactatattttaattgctcttcttatccgtgtttttaagacaattaaaatggtgtgattcacctctcttttttatttaggtaatgctgatattctcccttttgtttcttgagtagcctagaactatgctactcactgatgtgcatgttcaaataaattactgatgtgtatttttttgctatatgtggagaaatcatggggaactcggggcgagatgtgcttttcgttggttgaatttgtccctccttgcctaagaaatactacaggggtcatccttttataaggacaaactgcttttgaacagtgtcttcaatgtatcaagcacaaataactctttcttcaaca

SEQ ID NO: 12373 - DNA, 336024 bp, Human
  misc_feature (1)...(336024): n = A,T,C or G
ggcttgtcaaaaagccttgggagaaagcatttccggaatactcaatcctagagaaaatctctgcagctgcaggattcaaggcttggcctggagagtataccttattcctttagggaaatgctgagaggttttgtctgacctggaaaaacaagaggagcatgtctgcaggagagaggacccaaaggccagcaggaagttggtgatttggctggaaggcaagtcttcagagagtgctgtgaagtgatatagagctgcatctgggctggaggaatatcccatttctctgcctttatcctttatccagtcacagtggtctctgaccacaccctagttcatctcctctccccagatacatcttcctaaatccaagactcagtcacaggtaagcattcaaggatgcacacgtgcgcacacatacatacacacacacgcacacaaacacacacacatacacacacgggccccaaacccagtttgtttaagagtgtagactctggagccagactgcctgggttggaactctggtgctaccacttactagctgtatgaccttggggtaagttactttacctttctgtgcgttgctttcctcgttgtaaaatgggattgatagtaatctatttcctagggtgttatgggaattgagtgaattaatgcttgtaaagtgcctaaaacactgctggccctcagagaacattcagtatgtattagctgttattattttccaccttgcatgcatagcgtgctgtgtccccacccctgccccacctcttcaacgccaacagtttaaattgtgaatctcatcaacccttcttcaagccttgcctaaactctacctcttgtgtgaagagtttttgatttcctgctccagtgccagctgacatcctaatggcctcttgttggcacctgcctcagcatattgcctgtttctttcctctttgcccttttgtttcccaagtccttgagtcagactgtgagctccccaaagcagtccgcagtcccatgacttcatctctgatccgtggcagcattttcctgtttccagcacgggaggggctctcagcacacccttcctgcttgagctgctcctgtgccttgcacctccctgcccttcttccttctctgctctcctctcccctccctgccactgcccatcctctctgtgtctcttttttcctcccctctctccatctcttcccttttgattctccttgcttctctgacctcccccacctctctcttaatgagaactttcacacatcatattgatttggagtttcaaaaagccggcattgatttttctgggagacttttcatgatcttatttttaaatgtaggaagaaggctgtttccaaagctgttgactttgttctattgagttagggagtcgatgttggaaacttttatggggactcagagagctcagggacctgagatgccatatctaatgagctgggatcagggttgccatcccttttgcaggcctgagtttggtggcagagagccttgggcagggcaggggatgcagaactggggtggatttctgggtaaggctaaagagcatgtacagagagtgagcaaagtcaaaacagaaatactataggctgtaagagagtgaagggtaggcttagggggaagaatagtggtgggaatttgctgtggggggccacagctcctgatactctgctactctggcatcagagacagcctcccaggactgtctcccctagcccctcatgcaacacatactgacccaacacccagcaccaatgtactgcctggtcctgtactgagggctttgcttacatgatctcatttaatcttaccaataacttcaggaggcaggtcacattatttacatctcactttatggataaggagtcattataggcataggttaaagttagtgaagaacagtgttttttttttaaactattcgtaaggatagaataatagaaagatttaagagggcagggggggagtgagaaagacaacatcttgcctcctaaagggcatgtgcagatgcatacatgtgcacacatattggccacattaaatcttctggagatgaggccagacatataaaaacaaacaaacagaatcaagccactagatgaggatataggatgaaagggaaataaagacagagaaataagatgatatgtggctgaaggtcctgacacccataaccagaagtgggtggattaacagaatgcagaatggaacaggcacctggagggagtctgccttggcctgggtcctggatggggtatttcaggccctctgtacgggttagttagttgtcaccaggtcagatccacacacacacccctgctcttgccaggttctgcagccattaactgggactgccgttcccctacatgaattcagagatctatgggagcagctagggaggagcaggcacagatgtcatctgagagattccagggcaagagcagagaggaggcgccaaggacaggatgggatgaatgcaacagctcctttgcactgcagcctggcagccccctggcaaatgcaggagaacagctcctcacctgactcaataaaggcagcactgggcagggtcaattcaccaggaagttgaaaggtgatcaaaccacactgagatgacaggaaacctttggcctgcttgctaactttctaatatcatcaaagataaatctaattttgtcgcaggacagtttgtcttgtttggtttgaaacattcttgctctcctttttatctagcgagcttctctggtgttgcatctcagcttagggttcactttctccagatgtcaccccatctcctcctctatgcatctgtaacacccatcatggcccaaacatttcttctgtgatgccacatattcttccataaacaaccttatatgcaaaactgcactccaaatagcagtgcttatggggttaaaaaaaaaggttagggcttgtccttcaacacctgcaggagtttgtatcaaaagccctaagaaaaacaaccatcctaatagaaacagcagctcagataaatctcttgcacccagcctcccagtaggtggagactttgtggccttgaactctggggctctgccttctccttggaaatgtaggtgctagagggcattcatttctatttgaaacccagttcatcaacattacaactctgacaatttttatttgacaattttacttcaataaagctgaggaacaattctgaaatttccttgaggatgttttcacacaggaggaatgtctttgtagcttctccatctgcattttcaccttcacagcttagcagaatggtggagtagaggtgcttgaagcctccaaaccacccacaatgtacactagaggaggcacttgtgcagactttcagcttgtgcttcacactcctcaaggcaccgccactgttgcgagtggcctgggatgtgaaggagaatgccttggaaaatctctagctccaggcctgtggcctttcagcaaggtgtgctctgggaggggtggatggacctgcagaaaatccatcttcacgaagaatggactcctgcatcctgcattcctttaattctcactctagagcccatgccgtggcagactcccccgcaaatacctgttccttcatttacatgccttcatttcaagaaaaatagtaaagaccaagaatgtatctggcagactttccttcagtggccaggacatccttgtttgtccctttttctccacatcccctgcctccatttctcctgccatgctgaccacattcagtcttctccagggccaaggctcacctgggccccctgacttgctcctggtgaagtacctgctttggttttccatctgtgtgtagagggtgctcctttgttttctgcgactttccctcaacatcctcccctctgccttctcagcttcttctccagccccctccatcattgggaggatggatttgtctattcccctaaaacacctagagcccacagtttgctccacagagggataggagtagaggcctgaccccaggagatgttggaaaccaccttaagccctgtaacagagctggcaccagagcctcctgccgtcccagccctggttctacctgtgaaggagagaatggaaggaggcacttgcctgatgccatccattctgtttttctttccacagtgtccaggcctttttggaggatccttagacagcaggattgacattggaggagcctggtatttctgccacactcacacagcctcctctgcatccaccccctctgaggaagcaggtgacttgcttgtggagcctcaaaaatggaagatccaagttttccctttctcccctcagaagccctccactcctgcaatccactgagttaccaagtcctatccattccactgtggaagagctcaaccttccctttctctctgctgcccctaccctaagccactgtagttgggctctctcttgtcttccgggatcctgccctggcccctcagtgcatcttccacatggttgctccagggattttcccaaaaagtaaagctggtcctgtcgacctatgggaggctcttctttagatgtcttcattactcccataaaaaagtctgaaaaccctgccttagcaccagggcatttagcaatctgcccccacccctcctctctagctccatctcctgcagccccactttaagtatctggccactcggtgctaaggggttcccagaactgagtctggtctttcatgctccaatgtcacctacacactctttcctcttcctggatttcccttctctttcctttcagttggcacaactccaggtctgctgaaacagttcagccttactaagccttccctgtctgtagtaggccttgcttcagtgtccccagtgctttttagcatctgactccagtgtcattggttgcactagacaggcagagtgctcttgcctggtcctcccatgagactgtgagctgtggcaggacagcctccaggttgctcctgtggctctggcacctagcatggtggagctattaggagaaactcaccgcagatgtgtggaatgaataagagagcattgtgggacctacccagtaacctgagaggtggcaacactactgccatctggcttcagaggagtaaaataggaccagctttcttgggttttctcctccatgatgttgtcctcatggagggtggggccaggggccttggggtctggcatcccaaaaccaggcaaacacttaggatttctggcctcataatgtggcttataaaagcttccaaggaaacaaaatcaaaatgttagaggatttttctttggggaaataattactctcatcttatatttagaatggtacagtgtcttctactttgtgatttgactgacagagaagtgtatttgaactatttttaacttggaatattaagaagaagaaatcaagtgattagattttggaagctattgtataattcttaaactttggtaaaggagcatgttcaaagggggaaaaaaaggccaaccagattggcacgtttcagttctttctgtgactttagacttttattccaaaggaatccattgtctttagaaaggcagccaaggatgtgcctgtgtatgtttgtgtaaaagccactccattctccataaatagcttcagattatggtcttcacttcaagaagacattttagaaagggcttctctcactccattgacagcaacagtgagcgtttgtacagggctaagcaagttacactttcccatttgctttttaaacaatcttataagggagttactacagatggcccccaacttacaatggttcaacttatgatttttcaactttataatggtgcaaaagtaatatgtatttgtgtagaaaccatatagattaaactatgatgttaggtgtattaaatgcattttcagcttataatgggttgatcaggagcaacccattgtaagtcgaggagcatctgtagtctgttgatgattttctttgttttgtagagggaaaaaaatggaaacaagagtgcttgaatgaccaacccaagaccatctagtcagtatatggttgtaggtggtatttgtgtctagaccctctctcccttaatcagttttttttgttgttgttgttactttgaggcccaaatgcaaaagtcatttgggttatcccacattgcactgctggagaccttaactggaaagattgtgtttttattaccaattgctgcatagcaaaacacctcaatggtagtttttgacagggcatgacaggaatgagttatttctgcttcattatatctggggcctcagctgcaaaatttgaatggctgggagatggaatcatccagagacttatcacatgcatggtacctggactgagatgaccagaaggcagaactcatctgagactgttgactggaactctcagatatgccctctgcatgtgacttgagcttcctcatagcatggtggtctcggtgcaattggatttcttatgtggtgcttcaggattctaaaggagactgttccagtgaagaaggaaaaagctttatggcttttatgactcagtctcagaaatcacatatgatcacttctgccatacccgattggttgaagaagtcacaagcccagccagattcaagaggaagagatagataccacttcctaatgggaagggtgtgtcaagaatttgaagcctttacttacactcacaagaaactgtttctcttctgactagattgcccaatgtacagtgctatctagaagaaagtaaatgagcaagataatctctagagatctagagagacttgctagcaatgggctctagatttctccatccacatgagaagagaggcctgacagattgttccatttagttctccctggcataccaggtcagagaagaggtgactcttgccatcctttgctgaggataaatactcaaggcatgtgtgtcttcatgtaagatgagttacctggcaccaggctaggctaggggcttaagtattatatggcttgaggattccctgactgctgctcgtaagtcataacattgtatcaccttggagggacaatatttcctctgccacaatccttcagaataaaggtactaagaacctttgtgagtgaggagaagccaaagaaacagattcctgggaattcaaggtactttatccatgagctcaacaggttcctctccttcaagccttaatcaagggatataagcacagggcaagcagggtatcagaccttacaggatcatctttgttgtaccaaaccattgctaacacactggggtctcctgaaacacagattcactatctgctttattcttggtagtcaaaggtagccccaaataaccttttatatctcatttcccacatggtgctcctcttaccagcactctgaccatgctagatttttgtcattagatcatcatgattaactgtacctgtactggtcagcgggggctaggttgtgttgcaataacaaaaactccccaactcttaatgccttaaaacagcacaaatttacctcttcctcatcttgtgtgttcatcaagggtaggcaggtatctgttccatgtcactggtagtcatttggcagaaggaaagggagcactagagggtcttggattggcattaaatggcctggttcagaagtgacacatattacttctatttacaactcactttccagagctaaaattatggtctaatcccacctcaaaatggccaggaagtacagttttaccatatactggaacacagctagaaaaaaatggcaaattgcattgagtaccacatgacaaccacatgctgtcattctttttttcttcttcacatttttatttctgcatccatgcctgcatgcatctgtgcacccacccacccacttatcaaatgtttagtgagtacccaccctgtgcccaggtatggcttttaggtgccaagcatatggagatagaaatgttctttggagaagttaataattttgctgaagttgttcaaaatctgtccaatttttccaggctatagctggactctccatgaagacagccagtattaatggattcttccttgacaacaagtccttgatggtggagcataataattattaatatttagttattattgagcccttacaataagccagataattttctaagtctaatttaacccacactacagctttgagtggtaggctatattatgccatttacaaatgagtaagtttaacttcacaggggttaagttgctcgttcaatatcatacagctacaaggtggcagaattgagatttaaatttggactttctgagtccaagtccttactcttcaatggctacattacacttatctttaatgctcacgcaatttttttctctaaatcgtagacctggaaacaacaaacagacaaagattatcctctgcagttgtactgtgagggcttagaagacagaaatcatccagtgatttctgatcattggattcctttttgatgaatgaataaaggagggagagaaagagagggaaagaagaaagggagaatagagaaaagcaaagaaggaaaaagaaggaggagtgaaggaggaggagagaggagctgattcttttcacatggaatgcaaatcttgccagtgaggtggtgtgttcctgcgtgagaaggcaggcaaatgcttgtatcctgaggaaaggtgttctgcaaatcgttggcatcactctcataacctgatcatcagctctgtccctcagtctaccagttctgtgcctcagcacgtctcattacgctgaagaggttcttcagtctaccacgtctgaaccaactacaattaaacacacagatgtattcctcctcactcggctgctaaaaaggaaatatttttgaaaaatatgacaagtcagtatcacagctcgaagaaactggaggaaggaagaaagggctacaaagaaggcattaaacagagcttttaaaggtcactctctgattttgtgtgttactttccaaagagatattttcagattaaaaaaaaaaactgtgaatatagcaattatggctagcctctggcctgtgcagttaaataatggtttacatcggggatcaacaacagtcagtgaggcctgaaagcactggctttttctgcagcctgaccctgcatgcccaggtccaatttgttttccacgattactctgtccttatcaaaagaacaatctgcaatcccatgctgttcttatctggtgccggagccttagactgtgtcctatatatcgatataaggcttggagtaacctagattcatgtaataatgcagcttctaaacgttttaataaagaggcctcccttagtgactttcagtctccagcctcacaggtcaaattgctttgtctgtgttcactccttcattggcgagtgtgtgtgtacccctgaatatgcatgtgtgtgtatgtctatgtgtgcatgatcatgcatatgctagtgactactgtgttggcaactttcatcctggagataatgtgtaagtgcttaattgcatttgctatttagcaattaaccacttgcaggtgcaactagttgtgagcacagttctgcatgtgtgactaattacaggtgtaaaatattcacctcttcagttctcatcatggctcagtggggctcaatgctaattctctcttgccatctgggttcagactcatccgctggccagaggatctcctcaggagaggggtcatgttggggaggcagaggtgctgttttagagcaagaagggaaatggaagtgaaggagagcaggacagagtgcgtgagagactgcagggagtcagaagcttagctatgagcatcttccccaccatgctgcctgtgcaaagcagaggactagctgtgttcttggacctccatatcaggacctggcatctccttggttggagccccctgtgaggggtgctggctttctgaaggatctgcagaaggcatctgtctctctccttagaccctttgcataggcagtgacccaaaacctcatagacaggtggttgatggaagtctggacaagtttttagaaagtgtttactctctcagcagtattgccaccatgctgtgtgatggctgcatctttggtccccgcaattcatctgcaaagtaggggtgacaccctcctccaccttcctagtggaactccagggtacctcaagggttaggtgaatgtggacttgcctagtgaagatcaaatgctctgtcctgcaagggatcagggtaactcttgggtggtcatagggagtttctcacttgtaatattttcacagtaaaagtcactaaaggggtaaagaggatgaagaagtaggaactagagtagaacccctgaccctgagtttcattcactgtgtctgtgcctctttgcattgccagtggaaagcagaggtctgagaacagctttttgatgatcctcttctgggtgaggatcatcctcttggtggccccacagctgtgggctccactgcagctcggccgtcttccctcaccactgatcccaccacccatgtgaacagtgaccctgagagtagccatctgagagcccctctccacagcttgaagtctggatgggatggggcttcagagaagggagaagtgggagaaggcagtgtccaaaggaagaataaaagccaggatgtggctgggacaacatcagaacaaacagaatatttaaaactcttcaagaagcctttctggaagatctgggataggggaatcagctactcttctaggccctagagagggaagggccctcacctgggccccagagagggaagggccctcacctgggccccagagagggaagggccctcacctgggccccagagagggaagggccctcatttgggacccaaggaggtcagagctcccagcctaggaacttgcactgagccatccttgccacattagagggatcacagcagatccaggtatgtgcctccagtgtgtgtgtggtcaggggagtaatggggggaaagccttgaagaggcctagcgaactgagtgcgggggctaggggcaagccagagaggagggtgtgaggatgtggcctgaggcaaagggagagatgaggtagcagaggtagagtagttatgtcacagtccacttcatggctggagttagagagcttggtggcatcaaaaaaagagctgtggatgagtgggagaagctgggccagtgtggaccagcaccctgatgtaaggttttccgttgagtactttttattgcacaatggaacttggcttaccagttcctgactcttggtttctgactctggaccactttcagtagactaccctacaagagttggcttgttccctgggacctctggtgtgttttgttttgttttttgagttggagtctggctctgttgcccaggctggagtccatggtgcgatctcagctcactgcaacctccacctcctggtttcaagcaattctcctgcctcagcctcccgagtagagtagctgggactacaggtgcgcaccaccacacccggctaatttttgtatttttagtagagacagggtttcaccatgttgcctaggctggttggaactcctgacctcgagtgatctgcccacctcagcctcccaaagtgctgggattacaggcgtgagccaccatgcccggccggtgggctttaatggagtgcagcagagcaattaaagatggttttctcttggaatcattgtgaactggtcctttatactttatttcaccagagattcaaaagcaagaaggacgtttctgtatctactctaccactggctacttgtgcctcagtttcctctctctaaaatgagatcataatagaacctatttcctagggctgttgtgaggactaaatgagatgagtaacatgcccagcacattcgatggacagagaaaaccctcactaaatattagctactcaagttactcctgttttgttcttttagttcactgaggctcctttcttccaaaaacatctgcctccacctagattgatttgagaggtggtgtcagtgttatctgttggctttagatagcagaagcccataattctgagatcagtacagtttaagcctgaatcactggcttattcataatagcaaatgactttggagcctgctgggaaaaccctggtcaggagtcacacatgcagaattccagccaagcagaaaacatgtttgccccagatagtgactgtcagacacagatttcactcccaataacttgggaatgaaacacaaataaggaagtctgcatttcacatgtcttcttagattacaaattcaggcttagcacgttaggtcaggatgtgatagctcagatgccagctcttcagctttattccacaagcaccgggagtgactcttttccagatgattacagaatgtgagtgctggaagaatccctcatgattattccatgaaaccaaatttttcacttgagaaaagtggtgacagggtattcagtgaatttatcaagggtgggccaagtaggggtgctttgtctctgagatggttccttttaagtcattcctgtcaaatgcagcatggcatagacaaggctttcttaattgccattcctcacaaatgagcatgtgcattgacatatgtcttgtctgtgtgcgtggcatggaccatcccagccaacatgcggctgattccagatgttagcttgaggggccaactcaggttcagcatcagccaaagcacttggaaatacctaagtgatgtcatgatcccatttacgcatctggaggatggaggcctggaacataaaactcttattttccagtccatattggaccttagtctagcctgtgttcttcagactttgcggccaaaaatgttctctaaaatgtcaggttactattataaacttttgatttaaagatattaacacacacacacacacacacacacacacacacatcccaaacaaaaacaagagacctattttccatcactggtgcatcattcattaaaggaaggtcagcttaacaccaacaaaaaattttgtaattgtaatctcagaatttaaacatttaaggattcaatatttatgaaaattattgcaaaaattcaatctttgtgaaaatctcaccacattgcatttagcccttttgtgttaatagagtcttctcacctctgtcagatctgagtatgaaaacaactggactaacctgaatttattaatagaatgaagggcatccctttcttaccttacacaacccatcaagatacttacacagagggaactttgaccatgaaatactgggcactcactattcctcaaatgttagcctatcatgcctaaataatagtaataacagtaacaacaacaacaataataataataattactaacatttattaagcatataatacgtacaggcattgtcttaagtatattgcgtgcgttaatttatctaatcatcacagctgtcatggactgaattacgtccccttaaaattcctgtgttgggccctaaagccctgtagggcctaaggctctaatgtcctctgatggcatttggttataaaacctttaaggagataattaaggttaaatgagatcataaaggtgggactttaatccagtgtctttataaaaagaagcaccagagtgctgtttctgtacatgcacacagaaaagaccatgtgaggccaggcacagtggctcacacctgtaatcccagcactttgggaggctgaggctggcggatcacgaggtcaggagatcgagaccatcctggctaacacggtgaaacctcgtctctactaaaaatgcaaaaaataataataataatcagctaggtgtggtggcacgcgcttgtagtcccagttactctggaggctgaggcaggagaaccgcttgaacccgggaagcgcagattgcagtgagccgagatcacgccattgtattccagcctgggtgacagtgcaagactctgtcttgaaaaacaaacaaacaaacaaacaaaccatgtgaggacatagcaagaaggtggcatctgcaaaccaaggacggaggcttcaccagaaaacagccctgctgataccttgatcttggacgcccagcctccagaactgtaagaaaatgaattatgtttaagctacccagactggtattttttttaatggcagcctaagcagactatacaacagccctatgggtatatacttttatcagctccattttgctaaagaggaccttgaatctcagagttgtgactagcatgaacaaggtcaaatagaaatcatggagcttggccttgtttaattctcagttggcatccattaagaagcaggccttatgttgagatgggaggaaggcccaagtccttgatctcctgtctgagccagtagctctgtccttctgagccactgtacaagactctgttgtggaataactgccaggccagaggggctgttattacaaaaaggaaagactagaaagtcctgaactcagggctgggcacaaaggagggagctcaagaaatgtgaatggaatctgctgaacaaattaatgagcagtattgtcattggcattcctttgtcttcaacttcatgtgtgcagtcacagtcctaagcagactatatattttttttcaaaaaagagcagttagcctaatcaaatgagtaaacataagcagaactaatgactgttgggttctataaattgtgtcttgaaatgctaacggccctaataagagcatccacagtaaatgaatgcaccattaggctgaaaacaggatcatcaataccagaatatgcccactcctcctccttccccatttattagagttggctgcccatgagagatacatggtacaagtattcaggtaaccctatcatgcggtttttacttgtattactcacagtgatttgtatgtatagtaatccttccccaaccacagattctctttttatgaaattctggtatccttgaatttatttctgtatacttggagaatttctgttctaggatattcaggtttttgagtcactgctgttgggtataatttagaaatagagaaactggtgggtggtaggagaaaagagtagaaggcagaacaggagatgtttcacaatgcagccttggcagaagacctgggagtgccttctcctgttcacgtctgctctgggaagggaattgagatgtgctgacctaagctcagaactctaggccagggactgaagagctctgctgtctatcatgctctatttttaagggagctaagaattggacccctacagagctcttttgagtaagttaaataaagattcctgcaagtgtttcaaacttcccgcttactgtgtctctggcaccacggtggaagtggtgaagcaggatcacaggtgacataaatcagaaaggctctgaatatttgattggaggacaagatagggaggaaagtgaatttactgcaccagagggggaacattacaaatgccttattgaaactgtggagagggagattctgaagatttttgtattcaaggctagcaaatgggaattaactaacatggaaatcattattactataacttatacaaaacgctgttgatattctacttatgtgtgtgtgatgtttttatattagaaaagactttgcttttattaaagttacacatttctattgacatttcaatacacacgcctgcacacgcacgcgcgcgtgccacacacacacacacacacacacatatatgtgaatgactcaaaataatccagaaactactattgttaaatttaggtcaacatcactttagagctgtatctataagctatcttcactgtaactagaaagatggatggcaagtcaaaactaattttagaaagatgtgatcacggtaatctttaacacattaatttaattgtgttaaatgtaaaggaagaaaaataaatgaatataaatggaaggaattgctacatttgataaatgcttcttcaccacaagatatactctttcctggaagattattttaagattaagaaataattttatagaaacaatgagatttaaatcactattttaaaagtcacacttcgattttaaatagtaccaattaaccccttgctatgaaagatgaggaagttggtatacttgactatttctaatatttcttcacctttccccacctcccaatttttactacttttaatttctttttttattttaaggtttataacttgttttggttttatttatgtatttaaaagaatgtaacaattcttggttgctttatcacaatttctccttaccaaattcattaatttatctcttagttgattgaattttgttatcaaaaaactttcccctctagaaggactctctcccttccctgagattctagtacattcaggagaacctcagcctatgaatatagctatagagaagtctgaagctaacctatgttttcttttgaggtgatttatttattctatttgctggctgaataattctttctttatctttgaaattcaacaatttcaccaggctatgcctttgcccctgctgattcttccttcattttaagaaatttttttattataagctctctgaatatcttttttgtttgtttgttagtttttgtttttggatagagcctctaacttagggatgctagtaatcctccatatactattgtgagccgtttctttgttcagaacttattttccatgtattttctccatgttaatagttcagttttaaactctatcaattatttagccatttcttttttatttactagttttatctgtcagtatctgcagagatctgtcagtatctgcagagaatttgtaccaggactcctggggatactggggatctaagtcccttagacaaaatggtataatctgtgctcattctcctgtatattttaaattatctctagattacttgtggtacctactacactgtaaataacttatactgtattatttttattgttgcatttaaaaaatgtttttgatccatggtatgttgaatctgcacatgtggaaaccatgaaaacagagggccaactgtattgttactttgatccacaatttgtttcctgaactcggcaatctcccttttatatattattccattatatttggcttttgagcttttgtattattgaattcttttggaagttaaatccttacggataactttcttctatttcttggggtacatttttttccacgtggagctctttttctgtctttttcatgctatgctgctatatttctttcttgttttttctaaggcaattgagaatgaatttgcatatttgccctgccgtttcttttcatttgtgctcacatttaagggcagctctgtacagacctcttgtttgctctaatgtgggctgggtaattcctccttgactctgcccactttgtctgaggttcatttgtctttatacccaagccacagtttaattgcctggatatgtctcctgtctccctttctgtaactgtggaggagggctggaaagtacagatgcatcggtgtacaggctttgatgcactatcactgtcttctctctctcttagactttgttaaatactcgcaaccagggctggtcttccttggtttgaggtagtggtggggtaaagccttggtattcaaattgttttcctgcctcagagtggagatctgcagtttatgtttccatacgggcatcagccctgaaaagaaaaatatttttaaaaataccctctcagcatgctcctttccagccctccagataaaggggtctagaggaatttctcagaactctagctcactagtgctgctgccactggccccatggacctcaccccttgccccagtgcaaacactctcccctggctgagcacccctactgagggcctgctctttgttccttgcctgccccacattttctttcaacttgaggcctttccaatattgatccctctgcctggattgcacctccctttcttccctcctcattccctaagtcagtctcacctgacccgtcgtgtccccagggagtcttgctgacccctccaatgagacagagtccctgttatttgcatgcacagctctctgctccccatggtaagtattttgctgcttctccaggttgtggtgtgtggttacacttttccaggacttccctttgatgggtaaatctagaagcaggcccatttctagggctgcttatttccataatccttctctacctgcgactccctcagcccccacttttttttagctgcattttagaaactttaagcttaggtcacctgtgaggaaaaattggctttccttttttagttttttaaaggtcacactctcaatgagcttaatgttgggaccaaaaagacaacacggggggccagggaagactgtgatttatggtgctgggacactagcccagcactcagggggtgatccagggagcaggcgggctgctcttggagaagatgacggcctggagtctgttttcagggccctgctctgtaggagtctctcatttcaagccataggctgtggggccttggctttgcctctgagagagccaaccacgcacagctctctgtgcgcaaaggacacatgctggtcccaggacgacattgccaagcctccggtcagtatggcaaaggcaagtttgtttcagttcttgtttcctgagaaaaagaggttgaagcaagacaaccatgccacaaatactgagtgagcatctgctacgtgtcaggccctgtcctaagcattttgagcacaagtacaaggtgatccctgcacagcggaagggtctttcctagtgctttggcttccaaggtaaatggcctcaaaatccctggggctcacagccttcaagtgcctgcctaaagggaacagagtgtgtagagtctgaaaggggaggagagggggagccttgttgtcttgtctcaccctctccacactgtgagttccctgagggcaaggcctgtgtcattcacctctctactcacagtgaggcaggaaatggaacaaaatctcacccacttccttattgctgtatttgcttccctgggtgcttgaattccatcccttctgacctaaaccacactgaccccactgtcacagcccctgaatactggatttctaaccctcatttccctccagtgtttgaggctgactgatggactccccactgccagctccaccagccctggcccatcctcatgtgtcacctgccttgtgagcttttctgaaagcttctcctgagagtgcacttgttcccaacaggcatctcaaagtccagaatgatgtcctgcctggttggaaggggtcctgttccccagtaatccccattaagaggttgctagtctgcagttcttgctctgtctgtttctaagccaaaacagcacaggcagttggctgccctgctgccaaagcaaggcctgggaagcaatccagcctcatcctgatgttagacgagcaagtcctggggaaacagatagatctcatcctggcctcagaggggacagctaaattgtcaaacagcacactaatgggggctgctgactgcacaggtatctctgggttataaatgcccagcaccagagagcctcctaagtcaccagaggacaactttatgatccagaaagtaaagaactggaacaagatcagcttgtgacagggatcaattgatcggggactggagagagcttggcccgggagttcagaactccataaaacttccaagctcagcactttcttgggggacctgcactggccccagtacaaggagcccagaaaactgactgagagctctggagggatgtacagtgttggcctgcagcatagatgagggctaggaaggagcttccctgaacttccccagttcattctgtcactactctcagcccagttgattatgagcctcctttttggaaaagatttcagtggctccccatcacccttaaatgtcagactagtctccttggcatggcaatcaggacttcgtgagatcttaggttgatgagcttgccagcttcattcacatcttacagggtttctacctctgtgttccagccacatttaaagtcttgggtttccccagttgtgatgtaaactgtcacctctgggctgtcatacaagctgttgatttctttagccttgaaggccattcttccccactttctattcatttggatttctttcactgaaccttcaggttttagcccagatgccatctcttccatgaagccctccggggttaggtaccccttccatgtgcacataatacgttctgtcatggcacttgtcacacagtgtatttgcatcttctgtttacttgtctatctccccagcaagatctttgtggggtggagtgggaaaggatgtttatcattttatttattgttttattcctaagccatcatgctgcgtctgacacatggagaatatttgttgaacaaataagcgaatgaatgaataaataaataatatgataaatatatgaaatatcatgatagtgggaaaaaagttggaccctcccagggcatcccctctccctgtctgcactgcttttgacccctgcccagcaggcatctgaagctcttgagatacagtcatcacccactgatgccacatccccatcttctgtcatcccgtgcctgggaatgttcttcttcctcacagtacttccagactcctcaagtcatagcctcttccacgaaggaccctggaatttcttgtctggcaaaatacccattgtgcctgccccaccctcaaggtctctcagtattccttgcatagctctgtcttcatttattatttttttagaactgaggtcttactatgttgcccaggctggcattgaactcctaggctcaagtgatcctcctgcctcagcctcccatgcagctgggacttcaggcacatgccacagtgcccagcctatatagctatatctaagcactttctttgttacattttcattgcatattttaatgtttcattatggttttctaaaactttttattgagataattatgtattctcacgaagttttaagaaatattaagaaaaacccatttacccttcatccagtttatgctaatggtaacacctcatgtaactatagtaccaaatcataatcaggaaattaactttgatacaattgattgactttagtcagatatcaccagttttacatacacttgtgtgtgtgtgtgtgtgtgtgtgtgtgtgtgtgtgtatttagatctgttcagttttatcacatgtagagttgtatgactaccgccatagtcaagacacagaacagtttcatcacaagcttccctggtgatacccttttatagccatggccagcacctttcctccttcttctccctgatcactgacaatcaatgtgttcttgatctctataattttgtcattacaaggtgctgtataaatggaatcatatagtatgttaccttcagggatgggcttttttttcactcaacataatctcaacctggatggatctcatttccatacaagttgttgtgaatattaatggtccattccttttattgctgagtagcattctatggtatggatgtactacagattgcttcaccattcatccattgagagacatttgtgttgtttccagttttgggcaattaagaatgaagctgctataacattcatgtacatgtttttttatgtgaacatatattttgttttcatttttctagagatgaccaatgagcatatgaaaggaagtttaacatcattagccattagaaaagtacaaattaagacaaatgcaaattaagaccacaatgatatatcactacacagcaaacagaatggctaaaataaaaaaaatgattacaacaaatgctggtgagaatggaaaaactggattacatccattgctagtgggaatataaaatggtacaaccactttaaaaaagaatatcactgtttcttacaaacctaaacatgtgcatatcatgtgacccagcaattgaagtcttgataattttaattgtattttaaaacaagtttttaaaaatgtatatgtaattcatattcatggtagaagtagaaatacaaataaacataaagaaactatctcctataatactgctatgtagacataactactactaatatattggtataatgtgcatgtattattttgataaaaaattatgccataatgctttatgacttttttttacaatatatcatttctctccttcatgtgaatggatgtccatgctatcatgttaacatttgccttatattaaatttagcaacttatttcactaaacttagacatctaggtaatttcaatctcctaataataatcaacaatatctactaattaggttccttatttacatatttttggtaacttaatgaataatattcttttatttatttatttatttgaaaacagggtatcactctgccacacaggtgggagtgcagtggtgcaatcatggctcactgcagcctcatcctcccaggcttgggcaatcctccaacttcagcctcccaagtagctgggactgcaggcacacaacaccacacccagccaattttttgtagagatggggttttgccatgttacccaggctactcttgagcacttgggttcaagtgatctgtccacctcagtttcccaaagtgctgggatttacagccatgcgccaccatgctgggccataatagataatattcttaagataaatccaacacgtagaagttttggattaaagtttttctcatttttaaggcttttaataaaaattcccaatggctgtttagcaatgctatactgatgagcccttcatatcccagctgcccatgagagtgactgcttcttcctagtatttccaacaatgatcattgtaattcttttgattatttgttagtctgatagctgaaaaacgttaaatcttagttatattaatttggatcttaaaaattgattgccagttggactaaaaaacttatttgtatttcttctatcttgaatgcctgttcatattctttacccatttttctatttagttgcatgaataaacctttgtcatgtatatttcatttcttttgagtgtcataatttgttttaggcctgtagttttttagcaaaatttaacatttttaatgtagtttgatctatcagtctttttccttatgtgcttttccctttggttccttctttggaagttcctcctcactctaaagttgtataaatggtcatctgtgttttatcatactacttttatggcacaatttttaatttaagtatttaatccagcagggattcatttagggattggatataaagtagggatttagcttgtttcccagtagctaacttgtgtctcagcctcattccttgggaaattgatccttcaccactgattgaaaaggtctcctttgttattgtctatgtttcatcacttctcaggtctgctgtctctcagaaatgtctaaagccaccttattcagcttgtgaatagcctgcattctctctgacattatcttaattttccaggatatgtctggggtctccttctggtgatttttcctggtgagctcatctgtctgtaggcagaaacctttatctttaattcagtaacattttattacactatgtctttcatttctcttctttatttgtggtacattctattttaggaatctttattgtctgcctgtggttcttcattctctctgttttccaaatctttcaccttctgcccaattgttttaatttctttcatatttgctttctacattactgacttgatgttctgaagcttcagtactactctttcctccctgcaaagtggctttgtttctgctataacgtttttagtttccttactattcttccgttttggataaaccttccttttcatctaaacctgcttattttcctctcttgtgactttctctccctctgacttagaggtcatgccttcttgtgcactcctgaaaaagcaaacagtttcctgaatttttcttctcaattctgcagtatctcatttttagaggtatgctcttcctctcacacagtagaatggtgttcccattcctgcagtagctggtattttccctattctattttaagcaaaatggactttgctgagacccagtgaggttttataggcggggttaatagcttattctaggactccatttctgctctctttcagggtgatttaattatcttctcagtttgcaccagctgtggaggagatcaatgtgtgtaggtcttagttcaatttctcatacctgaaatgctttctcttgatgtatctctgctctgctcaggtggcacggcagatctaaagcatctggttcttcagttcttctggtctgatgcaatatgtgaaaaatacagtttcctgcatgcaccacttctgggtcatgactgtctttaccccctctcacagagtgcttttcccataggaccacttctaggttctcagaaggcattgcaccatttctagtccttgggtagctatgctgtgtatagatgttttctgggcaaggaagagaatgtaagtcatgaagtgaaaactttcttgactcacaacatagcccagttcctcattggtagtagccctgggtctctaaggcagggcagaagctggactttattacctttttcttcatgcaatctctgttttaggcagtagagttaggatgagcatgtactaagtctggggaggttttctcaaaccatctctgatgcagataccacccattctgacactgggttatttgtcagtattaaagataggttgttgtgaagtttcaacatttttctgacactataataaatttgctaaaaaatgtgtgaatgctttggggataccatccccattttgagctagaaacttcttaatatattgcgttaaatcatttattcatttatctgtcttttcctccaccatttgtctgtgaggctttgaaagaattataattcaccactacatcaacagtgcctaacacagtgtctcattcataatatttgatagatttttaaaatttatactgggatgagattgccaagggagagaaagtagagagagaaaaagggatcaaggataggcactgggctttgagggacatgatggcgacaggaggaagaagataagccaggaagggaaacaaagaagtcacagtcagagaggcaggaagagagcagagccggaagcacaaggctgcacaggctgactgggctgggaagacaggtccatggcatcagtgtcagccaggtggctatgcagggtagtgagtcaagtaaacccgatacctggtcagtcactggtgatggttaatttcagaaccatgatggagacaaccccttccctagttggaaggctgagtgggttgagaaagtggaagcagttaggcatagatttaaaaacaaaagggaaagaaaaaaagagagcttgagagaaaatcagcatgccggaaggttttttgagttactgttgttggaatggggaagatttgatcagcttcatatcttaagggaaggtgattgtgactagaaacagcaatttgccagacagagaagggatatttgaaaaagccattctgagtctaatctgaagaggataaaatcagatatgaggagagaagggatggtctgaaaattccttgagaacaagggctgcttcttaccagaactggtgagggccccaagcaaggaaagtgcaggtgacttggatgcagaaatactgtggactgtggtaaaaatatattcaggtgagaaggaaagacggtgagctgctcactcctcacctcctgcatcttagtaaaggaggaaggatcatcttcagaggagaagaagggctgggcacagcccaggctttatgaagaaggaaaaagaaggatgagaggattgcctggcagctcccaggcccaggctaggagcagaagaagcttgtagacatgttatggggcagtactaccagagagcctataaagcgtcttgcctcaggtggccttgtgactctgtggtaacattgactggctttctgggaggctaaggaaagcttttaaaagtggccttgattaagccaggaaggaggatctcccttggaccaaggtctgctctttctcacttttcttgcagggtattgctccatacttctgtctccaaagatgttaagtacataggctgcaggcacacaatgcactctgtggagatgctccttgtcctgggtcctctggtccccaggctggtactcaccagacatggaaagtagttctctcacccctatgcatcctgcccacctcctcactggaaatttacttctccaggaactaacttgaatctttcaactagactggcttagcactgccagctggataagaaagctgcatgtgaaaaacctagctttgaaatggaaagatagcctgctgttgaaaaatgaggtctctcttaattagagaattaatcaattaataaatacagcatcttttgacagacttctgtgtgtcaggtgttgacaccatagaggtgatgaggcatcatctctgcccatgagaagggtacatatagctcaatacaggaaactgacagaaagacctttaagagggaaaaaaatcattccatgggggaaatagtccatttaaatgagaggcagagggatagattaagtgacagctgaagccctatcccaagcaagtcattttattataaaacaggacctgcaaattggcttttctttttcgtattcttcctcaccttttcaaacaaataattaatcatgcaaaaataacgcaacacattctagaactcaattcctagtactactctccagagtacttgaaccgtgtcctggggttggcattgttacaaaaactcttgatgagaataatgcctgatattgtgcaattgtgtgcagttggcccgtcttgcatggttctgtgtatgcacatcaattacacacatttgttataatttgcctttttaaaaatcacaccttctatttcaccccaagaagataaatggatcctgcctcagtcccagttccattgattttttgtggtcctatggtgaagctattatcaacactaatctcaaaccctgccaggagccaggaaggccttagaatacagaacaccaatttctgcaacttccaccttatttttcttttcatagacttttgttctgactcccctcctcatctcattttcaaatatgatttgattatcatcatgtgaggtctgttcagctggctcggagcagacaccttttccatgtatctggcctggaggaggagggtgtcagaggcctttcctgattgagtgctgatcctccttggggcagggtgttcttgcaactttgaagactcactccatggcctctgtctccagcagtgtgaagcatgaacagccaggcgggggagcctgcaccttccatcttgcagctctccaaattacttttctggggaggagaggaagaaaagaagaaatgggggattggaatcaagaggctacaaggcatctgggaggttgttaacagtgagctctgtgtttgaagatggggtggcagtggcgatgtgtccagggcttgcagggataaatgtcggctggtcccctgcctccatctcccagggctgttctatagcctcatggctgtcaaacactcccacctgctgctggacccatgaccacactcaggactttaaaagatcatatgccaatttaaagtattgacaaattttgagaaggtaaaacattcagttcattaaaatatttccaaagggcatatagcaaagccttccctcaccactaaccccaggcccaatggcctcccagagcaccactctcactggcttttgtggaggcttccagggacagcctaggtgtcgggcatgcactcagttcttccctttgctgctgctgctgctgcttccttcttgcctcctctatgttatccttctcttcctcctccttctttcctcataatgtatcttatagatgattccataccaagactcataaacctgcctcattataaagagttgcatagtatcctcatgtatggatgtaccataacttatttaactagtctcctattaatagttgttgtggttgttttccatctttttgtcatcaaaaagaatgctgtccaaaagaactgaaagcagagacttgaacatatcatttgtacagcaacattcacagcagcattattcacaataggcaaaaggtaggaacaatccaactcttcatcaagagatgaatcgataaacaaaatgtggtatatatattgaatggcatactatccagccataaaaatgaatgaaatgttgatgtatgctgtaatatggatggaccttgaaaacaatattcagtactgacatgttttgggtctatgtccccacccaaatctcctctcaaattgtaatctccatgggtccagagagggaggtgattgaattatgggggcatttattgatttgcatatattgaaccagccttgcatcccagggatgaagcccacttgatcatggtgcataagctttttgatgtgctgctggattcgttttgccagtattttattgaggatttttgcatcaatgttcatcaaggatattggtgatattggtctaaaattctctttgttggttgtgtctctgcccggctttggtatcagaatgatgctggcctcataaaatgagttagggaggatttcctctttttctattgattggaatagtttcagaaggaatggtaccagttcctccttgtacctctggtagaatttggctgtgaatccatctggtcctggactctttttggttggtaagctattgattattgccacaacttcagatcctgttattggtctattcagagattcaacttcttcctggtttagtcttgggagagtgtgtgtcaaggaatttatccatttcttctagattttctagtttatttgcatagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcactaattttttgaagggttttttgtgtctctatttccttcagttctgctctgattttagttatttcttgccttctactagcttttgaatgtgtttgctcttgcttttctagttcttttaattgtgatgttagggtgtcaatttttgatctctcctactttctcttgtaggcatttagtgctataaatttccctctacacactgctttgaatgtgtcccagagattctggtatgttgtgtctttgttctcgttggtttcaaagaacatctttatttctgccttcatttcgttacgtacccagtagtcattcaggagcaggttgttcagtttccatgtaggtgagcggttttgagtgagattcttaatcctgagttctagtttgattgcactgtggtctgagagatagtttgttataatttctgttcttttacctttgctgaggagaggtttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaaatctctttgtaggtcactcaggacttgctttatgaatctgggtgctcctgtattgggtgcatacatatttaggatagttagctcttcttgctgaattgatccctttaccattatgtaatggccttctttgtctcttttgatctttgttggtttaaagtctgttttatcagagactaggattgcaacccccgcctttttttgttttccatttgcttggtagatcttcctccatccttttattttgagcctatgtgtgtctctgcacgtgagatgggtttcctgatacagcacactgatgggtcttgactctttatccaatttgccagtctatgtcttttaattggagcatttagtccatttacatttaaagttaatagtgttatgtgtgaatttgatcctgtcattatgatgttagctggttattttgcttgttagttgatgtagtttcttcctagtctcgatggtcttttcattttggcatgattttgcagcagctggtactggttgttcctttccatgtttagcgcttccttcagaagctcttttagggcaggcctggtggtgacaaaatctctgagcatttgcttgtctgtaaagtattttatttctccttcacttatgaagcttagtttggctggatatgaaattctgggttggaaattcttttctttaagaatgttgaatattggcccccactctcttctggcttgtagggtttctgccgagagatctgctgttagtctgatggtcttccctttgagggtaacccgacctttctctctggctgcccttaacattttttccttcatttcaactttggtgaatctgacacttatgtgtcttggagttgctcttctccaggagtatctttgtggcgttctctgtatttcctgaatctgaacgttggcctgccttgctagatttgggaagttctcctggataatatcctgcagagtgttttccaacttggttccattctccccatcactttcaggtataccaatcagaggtagattttgtcttttcacatagtcccatatttcttggaggctttgctcgtttctttttattcttttttctctaaacttcccttctcgcttcatttcattcgtttcatcttccattactgataccctttcttccagttgattgcatcggctcctgaggcttctgcattcttcacgtagttctcgagccttggttttcagctccatcagctcctttaagcacttctctgtattggttattctagttatatattcttctaaatttttttcaaagctttcaacttctttgcctttggtttgaatttcctcccatagctcagagtaatttgatcgtctgaagccttcttctctcagctcatcaaagtcattctccgtccagctttgttccgttgctggtgaggagctgcgttcctttgcaggaggagaggcgctctgctttttagagtttccattttttctgttctgttttttccccatctttgtggttttatccacttttggtctttgatgatggtgatgtacagatgggtttttggtgtggatgtcctttctgtttgttagttttccttctaacagacaggaccctcagctgcaggtctgttggagtaccctgcagtgtgaagtgtcagtgtgcccctgctggggggtgcctcccagttaggctggtcaggggtcagggtcagggacccacttgaggaggcagtctgcccattctcagatctctagctgtgtgctgggagaaccactgctctcttcaaagctgtcagacagggacattttagtctgcagaggagactgctgtctttttgtttgtctgtgccctgcccccagaggtggagcctacagaggcaggcaggcctccttgagctgtggtgggctccacccagttagagcttcctggctgctttgtttacctaagcaagcctgggcaatggtgggcgcccctcccccagcctcgctgctgccttgcagtttgatctcagactgctgtgctagcaatcagcgagactccgtgggcgtaggaccctccgagccaggtgcgggatataatctcctggtgcgctgttttttaagcccgtcggaaaagcgcagtattcgggtgggagtgtcccgattttccaggtgccgtccatcacccctttctttgattaggaaagggaactccctgaccccttgtgcttcccgagtgaggcaatgccttgccctgcttcggctcgcgcacggtgcacgcacccactgacctgcgcccactgtctggcactccctagtgagatgaacccagtacctcagatggaaatgcagaaatcacctgtcttctgtgtcgctcaggctgggagctgtagaccggagctgttcctattcggccatcttggctcctccccacatctgatggttttataggcatctggtatttctcctgctcactcttctctctcctgccaacttttgaagaaggtccttgcttccccttcaccttccgccatgattgtaagtttcctgaggcctccccagccatgtggaactgtgagtcaattaaacctctttcctttataaattaaccagtcttaggtatttctgtacagcagtgtaagaacggactaatacaagtactaagtgaaagaagccagacacagaaggacaaatattgtatgattccacttatatggggaagaagaggcaaattcatagagacagaaagtagaacagaggttactacgggcagatggggagttattgtttaatgagtacagaatttcgtgttggggatgatgaaaatgttctggatatagatagtggtggtggtgatataatattgtgaatggatttaatgcaactaagttatattcttacaaatggttaaaatgataaatatttagttacagtattttgcaccataaaaatgacaataaaagattgaaatgttttgccaaagcctaagaaagagaatgatgcaaagtagcacatacctgtaatcctagctacttgggaggctgagagaggaagattgcttaaccccaaaagttcaagtgcagtctgggcaacatagtgagacactgtttctaaaaagagagagaatgagaggagaatgctgcagtgaacatccttgtacaatagagtgctctgtaggaatccaaatatatctatacggtacattcccagaaatggggttacaaagtgggaaagtgtatgcattttaaattttgatatatgatgccaagtttttttttttcaaaatattgtgctagataatgctcgaacccatgaagtatgagggttgaccattagctagtatcaaatattttgatctttgccaccccgacagctgaaacatggtacccttgtagatttaacttgcatttctcttctgggcttatgctatgtgaatggaggtgagacccaatggatcaggagtcactttggttccagatcaaggcagaaacaggtcaggagcagcctagaggcaaaaggaaggctggctgcctgggatatgaaagatctgatttagtctacctccttttcagtttcccactacctgcctcaactttatcatgtgattcataggaccatggaatagcaccttgaaagaggacctgagggtcccagctgcctaacgcagtagcaattctctagacactcccttacctcccttgcagagcctgggtacacagctaatgacaggaagttcactttttttctgattgttggaaagattgtttcatcaaatgcaccttctggtggtctccagcccctaatcttagactttctgaagaaccagacactcttctgttagtagttcttaggccaattacctgcaaaaataaagcccgaaataatggcaagtggattcatgaataaatgaatgatgtgcaaactccagtcactgttgttcgtattatcttgtggcttccataacaatacagaactctttggaagggatgtccttaattcagaggatagtgagtgggccttttctgggatgcagactcaccctaggtcatggcaggaagtgcatattcacctgcacacctccatctccttcacatattgtgctgcaaagccaaggctcccgatttataatttacatttgtcctgtataaagagcaccttctcttggcttcaatccagaatttcaatccccacgtgatcagtctgaatcttaactccccagcattttagtcattcttccagctttctgtcacttcctgatttgatatacatcttgttaaatacttttcctctacttcatggattaagctgttgatcaggtcaggacgaagggcagcaccaggcgatgacatcccatttctcagggatgacgggacacagttatttaacagaattattactaaggggatggccgaggccccagccagccttcacatccgtgacaaaatcatgaggggaggctcaaatgctctgctgaaatcaggacaactgagattgtgggaggaggcaggggacaaaacaggaaagctactattggcgcctgagctctaactaccaaggaagaactagatggttaactagatgggggcatgcagggcaaagcatcagcttggtacatggaacagaaagaagagaggaggctggttgcattcagacacgtagatagaattaaggaataatcataacaaacatatacatagtgcttactatgtgtcctatgcacacttacaatgtgaactcatttgattcccaagcattcctataaggcaaatatcattattatccccattttacagatgaggatgctgaagcacagagaaaggttaaatagtttccctgagtcatgctactggggtttaaacctaaacaggctggctacagagtgtgttcttaagcatttcactctatggccttgaaaagctcagcctccatgatattatcaaatgaatttcaaagaatgcactggcatgttcagccagcacactctttgaaagtggatttgaaacacgctagggattctagttcccagggcagtttctttaggaccagcagtcccttgtggaatcttctctcagcaaaatgggagaggtgaaaattgctgctatgaggagcagttaaataatctgtctcaaagggtgtctcgttgtgctctgaatgtgtaaatggcatttcctagttgagtggaaatggcatggggccatccgagagaagagctggatccagggaaggcttgaccaccacctagcaccttggcctttatttgctccatctttggaaagatgaggctgacccaaggacaacttcagtgtagttattttacttaagaaagagttcagtgtgtcttgagatggaggaacacaactcacatgtctgggtgttagaaagattgagtgcattcagtgcggccaggcccttcactgggcaggtgtggtcacaggggcatggacttatggatcccatcctactctgttgcagagtcccagggccatgggttgcctggaaggaaaggaacagcataaacccccatccctccttgtctgactgggaggaatatggatgcaggagcagatgtgagggtagtgattagaaaccctggctgcaatgaaagccaccaggaaaggtttgaggccctctgatgcctggcccatctccagagttggattcagttccctctgactcacctgacagcggctgaagtctacaggccccagagccatgaggaggacagggcctgggctttaatatttttactaacgttccctgggtgattctgataaccaccaaaatttaagaaccattggtctggggtctggctcagaaagtcatgtattaaagggcctgggtgtcttattatgcagctcagctactataatttgggggctttcctgtatctgtagatgatgtatcctgtatctttgagatgcagaaaacagaaaagtacagagaaagaaaggcaggccttggtgagcccaagcaggggcaaaaaataccaagcttctcccactgccaaagctgcaggcactgagcctgagggcccccaggccctggagagacagagggtttgcaactacctgagaagcttcctaacagaaggcattgctaagattttctaacatcctaatgcagaagcagtgtttagtgatggggagcaggtcacattttaggcagcttatcacccaatttgccttcttttaacctagttttaattaccttttacttcaaatttatggaatctgagtactacttagagcattatttaaatctgttctgttatgtaaaataaaaacgtttctgattatgcttttaaagaacttttttgtgtgaaaatagtagacgctattatttgctttttaaatcaagtaatgtacaaaagtacaaattttaaaatgacaaaaaacaattacttcaaattccaccatccagaggaaatcattaacatttggtgctgcacagctatccctctgatagaatgatagctaattaggtgaattcaaacacatttacaaaaatagaaaattactgtatatcttttttaaaattaaaagcaatataatttgatttgaatttaatagattaaaaaattaaaatgaaagtgcaaaaattgctaaagttcaaaaatgtttttcttcattacaagttattttaatttctgtaaagttttttgggtagagtaaagatgagatttattcacattttaaaaatttcacagtatcccttgatttcctacttcctctccttccctcatccccctactctggatttcttatgttactacttttacattgatgagatgtgtagctgttacattctgttctctgccataatacacaggcattttttttcttatccactcagctgccattgcctgttcttccactatggtttctttgtcctagaaaagtggttcttaaggtttaaagagtatattaagtgcttgggtattttgttagaataagaattctggtgcagtgagtctgaggtgggccctgagggtctgtatttttttctgtttttttttttttttttttacgcagagtttcactcctgttgcccaggctgcagtgcaatggcacgatcttggctcactgcaacctctgactcccaggttcaagcgattctcctgcctcatcctcgcaggtagctgggactacaggcaagcgccaccacgcctagctaatttttgtatttttagtagagatgggatttcaccatcttggccaggctggtctcgaactccggacctcgtgatccacctacctcggcctccaaaagtgctgggattacaggagtgagccaccgtgcccggccgagggtctgtatttctaacacctgcccccaacctccatgatgtcagtactgctgctgcaagagccacacttggataaacaagttctaacatttttggtttatgttactttttgtttgaccagattcccagattccattttcaggttattcgccacccacctcccaccctccatagctcactggtgctctgttccctgaagttttgagaatgcttgaatcttcttgcctatttgtgtacatggggttgcaggggcaacctgcctgggtttatatacatgggtcacataaattaaaattcctttgctcagaattcatggacattgcttcagtgtcttatggcattgaacgtggtcagctgaacatggcattgcagtggtcagttttagggcaggcctcatttttacttcttttaggtcatttgatttttttctacctggatgtcaagaagattccttctttatcctggagatttagtaatttcaccaggatgcatcttgattttatcttaggatgtattttgactttttcaaatggcagttccaagactttaattcaagaagcctttcttctgtgtgtttttgaatagttttctgttatatttgttggtgttctcctctccagagtatgaatgaagcgcgtgtcgtgggatgcccaggagtgtgccttctgctgagggtgctgggggtcgtagccactgaggctgctgctctgcctgcttcatactctgttctggaagtttctttcagccaggaggcagtgaagatgggagtgggggaaacagagacagaaagaacaccctctgagctatcccacaggtccccacacttcccttacaacatgtggctgtcttattactgcagggcctctcaggatgcaacatttgcctttagagaaacccaaatctgggccaaagtctgaggaggtgtgagtctgctttcattgttcttccaaattccactgcattttctactaggtggtttgtaatgccaccatttctttattttcgtgaagattgatttttctcttttttcctatctcctgttttgaagggtgtcaagagaatagggtatagaaaaactgtatcctgacaatgcagtccagattttttttactggataaagcaatactaacttgattttcatattctttccttttggctattccatgccagagagagtctgtcagagtcttctatatacgtaatgagggaccacttgatctggtggcagtgattcaaactgaaggtgccttgtcctgaaggaatcaataatctctgaataatacaatgtataaattcagtaccaccaagcaattactgggcaatcaggactgtcactgctccaggacagagtagtgctcagctgagcacatcagggcattctttgctcccaaggcatcaacattgcagcttggtgtttgtgcttggtgtgcatttggctgccatgtggcagtgggctggtgtgtgctcagtaagcacagccagtcctcaaggctgacttcctggaatagcacatggtggcagtcagtgaagcggccgctcactcatggctggcttgtacacacacacttagaacatcctccgtcagttgccttgttctggaatgttcatgaaggtgtgtagcttattaaaacaagaaaaatacccttcatttatacatttacctagagacatgacagaggacatagagagcttcagaaaaacttcattttcccctacttttcagtcttggccaaggccagattgtggttcaaatttgttggatttagttggcatatttctttcttgtttccccaattaacatggctaatagagggatacatgccaggaggtgcctggctctctgtccccactgccctgtctcctgcagctgtaggaggtcaagcctgtgaggatcccccaagccaactccctcagagggagaataaacatcagctcaagcttctcagcttattctctgcaaaggctattttattggcaaatggtgaactagcagaaactctgaatccactgatccagatccttgagtaaaagccacatacacccagcatttcatataatatatgtatttgcatgtacatattttattgaaaaccagggactttgctggaagtatttaaaggtaaccaaaatctgccttttgcagtacatttccaagctgagacatcataatagatgtggcacctgatgatttcagaacgaaagcctttcaacctccaaaatcatccccacctttacactacttacgaatgggccaaacgggatggggagtcatttccgtttatcagaaggaaagctgacagcacaggaatgcagtcacttgcctaccttgtctataccccaaatgtgaaaaaggacaacagtcccaccctctcaggaccttagtaacaggaatatcgggattgagtgagtagcagaggtttgcccctgcaccgtcattgtgtggtctacccctgcagtgccaactctgcagtgcccacatctctcatcaggacagctgtagagtcattgcctgcctgtcagggggagtgggaaatgagcagattgcagacactgggaggtagcggcctgacctgctatatcaccaccgcataccgaggaatccgtatgtcggaagacacatctgggagagttagcgggtgatttagacagacaatcttagggtgagagcagagagacagaaaaggaggcatcaaccactgggctgagaatcctggggccaagttgctttaggaaaggcaaccactttcagtggtttatagtccatattacaaccacccagcccgcccagcttggaacaacttagctctataagggggctaatcttatttccaaatatattcccaaagagaatgtccacaacctcccttggtaaccagaggctaaagttacaactgcaacagtgtttcctcttggctgtggatgttagcacattgtaaacacttgaatatatgactaactcaattacacatcaatcaagagagcttattcctgcttgaattcaggtactttaaaaaagtctgatggaaacagtgattctgaaggttgaagatgagattctatgctgtgatgaccctatgtctaatggtggtggtggaaacactacccacaatccaaatgttcattcctgcttgagtcgggagccatggggatgggattcttggggtgggaaaggtggagctgggttattgggaggaggaggtctgccctgtgagagtgccaggaaatccaaagggcccaggtggtcttccctcctacttctggggagctaggatgtgggcacctgatctcaaaccagctacctggatgctcctgactcgggctttgattgttaatggagggaattgaagattcagggagaattgagacatctgcaactgcatcaagtgtttggagggtgggcagggacagaagcgccatccagaatgtccagccaggtcactcagtccctgtggtgtggcccatgctctatggcccagcccgacttgattctgagaactgcttcaaagctttccaaaagggggccttccttttctgtttcttttattcacagttcatttctgttgcttataatcagaaatcctaactgatacaagagtggtgctgagttttgagttatccaggtatttatttagtaggggaaggctgcttctagcaggaagaccatacatactgagtggactgataaatgtttaattttaatgcagcaaattggctattgagtgtgtgctggtggctggcactgtgctaaacactgggaaaacatgtgtccttgtggggctgcagaccagtggaggacacatgcctgcccagcttccaggtcacccttccaaatggatcacattttgaagcctgccttgcctgatgagagcatgtgtcattcatgaagcaatttccctgcaggccttagtggagtcacacagagcaaggccctggcattccacagtgatggcccacctggagctggctttcatgcaggcataaatcaccctctcttttatgagttgttatacttatttcttccagtttttgctttctggttttactttcctttcttcttatttaatagacctcaagagggaaagaatttctggtcacagccaatcacagattaaccccctgtctttaggaacaaaaggaccctgggctgcaggtgtgtgtggaggagagtgggggtgtgttagaaactcccgtgtatggcaccccagcctcacaggacctcacctccacctctggtcctgactccccctgtgcgtggccattccagcaactgccctcttgccttttgctcatggagtctgactacatccttctgtgggccggactgccgctttcatctcccagtgacagtgcttttctcagtgctgtccagttgtccagtgcctggttttttttttttgagatggagttttgctccattgcccaggctggagtgcagtggcatgatctcggctcactgcaacctctacctcctgggttcaagcgattctcctgcctcagcctcccaagtagctggaattacagtcacatgccaccacacccagctaatttttagcatttttagtagagacggggtttcaccatgttggccaggctggtctcgaactcctgacctcaggtgatctgctcgcctctgcctcccaaagtgctgggattataggtgtgagccaccatgcccagcttgttttgccatccctaatgtcactgggcatctaggtctctgggagcctcaggatccctggctgcttaccaatgacccagtggcctttggcatacccctgagagcagacagagatctgctgactatgaaaaggtggcacagatccagaaaatgctgatcttttaacctggatgaacttgaaaatggcctgggggaggttttaaataaagatggagtgtgtctgtggctgggactgctttagctggatagtctgggaaggcctctttgaagaggtgacacctgagctaaggccagaaaaatgaggagccaaccacacatagagaagtgggaaaggcataccaggaagaggacccagacaggacaaaggccctgaggtgggaagatcttggcagtgtcaaggaccagataggaccatgggctggaagtagcacaggagaagagtggttgagatgaggtctgggaagtagccaggagctagtggcagcagcacagacgttgctctcaactttccttcctgacaagtggagaaagctagccctcctggttggtgcaattataaatgggtaaaggtggggatgagtttggagattgaagggccttcattctgaagtgatcagctgccacgtctactttaatgtcatagtttaagagaatactaaagaagcaaggtttgggtcaccttaaagtacttccagcaacagcctctgttttccaataaaatgcagatatgcgataatagcatatgaaatgataggggtgtgtggtttcacctaggatctgtgtcagtgggtttgatggtttcagattttctcctgattcaccatttgccaataatatactctttgcagagaaacaagctcaggctgaagtctattgcctctgtaagtgtgaaggaagctgttggagagattggaggaggggaacaagtgatccaacctaagtgaaacaataattctaataattacaaccaccaccactctgggcaatatgtgcacagagctggttgcagtgcagccagtgtggaagagcagactttgaggggctgagggcaagaaatgccagttgcctttcccatggccacccagtgcatcagtcataggcaggatcaggcctaaagacccaccctggccagggtctggctggccaggtgagcccaggctcccctacatggcagcggggtgccagttccttcctcttgcctgggaaaattaatagctttttttccttctttcaagatcaaaataaaaatttcactgattagcattgcttccatcccatccatgtgatgtctcttccttaaaagatcccatcaggctcctttctcgggactctggccaggtatgtttgcccgctgcagagattcccagagttctcctgcttatctgggctgtagctcaccccaaacagctcccttccctcatctccaggcatccctgaagcttgaagggaaggaggaggcagaactggcagacttcttccttaggcaggctggggacatattgttcaaatttaggccttatcctccaagaatgaaaatacgtgatgcttatgtgaataagtatttgtgattgaattaaatgtaagtacagggcacttctaattcacagctctgtgtgcaagtgcagggtctgtgtcaccaagcaccgccttcactgctgggctggcagtgaaggtggctcctgcatctcccaccttccctgctcatctgtcttgtttgcctctcccagctttgtcaaatgtaacgtgaaagaaagggaaattaaaagaaaacaaacaaaagagagattttcccagaggggaaatcagatttatcctaaagtaattaaatgtgtaggaaactgagaacaaaggattgcaaatagtgtgcgtgtgtgagtgagagagagaataaatcattatttcactggcagccggagccctccaatgaatcttaaactcaggtccctgtgaagtggagtaggcaggggaatcggaccatagctgtggctctggtgtcccagcacctgcttcccatagctcccacagctcttctgctaggcttggggactgggggactggggtatgccctcccagtcgtggttggtggagctactgttcactccttttctatgctgcctcctatgctcccctccctgtgggactggccttctctgtgttgagtacttgggagtcttggcaggctcctgttgcccaagcacctggtggcactgggcgtgtctttttcctttgtctcattacttagaggctgagtgtgttggggtcaaggactgtgtcttttcactggggcaggcccaagtgtccatgcagggcctgaactgctgtggttgctcagtctgtgtttgttgaattaatgaaggggcccttaaacattcagagacattgaggttgtcgcactatgacctttcactgcagctgctgttgtggctggggaggcaggcacatgcaccatgcctggactgtgagggggggcatgatgagagctccagggagggcagaggaggtaggagaagcagtcaggtaggagatggtgtttaacctgggccttgaaaggtggacaagtctttgacgtaaaggggaaaaaacatcttcttcagaaagttgatgtgaagcccccaaaatgcagggtgcttgtacttccaagcaggccccgtgatcatcccatcttccccatgttctgactagcttagacccattaaggcagaggtaatttgagatcatgtgctgacaagtggctaagaaggccttttggctactatgatgggggtgctgagcaagagctgacttcctgggggcttcctggggacaaagtctacacagcccatctgatgctcctcccacctccaggaatttgctgatgctgtcacttcattctgtaatggcctttctccaaaatgctgccctccctttcttcgaagaccagctcagatgtcaccttcctccctttctcagcccactgcaatcccaccccttcttaaagcacccaccgatctcctccatgaaatcttcccagctccctacagcttcccagcaatctttgttgtgaacatatttagtagatacctttgaacaaatttagcagatacctttgaacatatttagcagattcttgaaacctctgcttacaccagcaaccacaatccacccaccttttcctatgatagacccatctgtgagcctcgcaggacacaaacagtgtctcattcttcttggggacatgtagcctagcactgtgtctgctgagtgaatgccggcctcatttcctccacagaccaatttactaacatgttttcagtggctacgatgtgacagggattgcacatgggctttggtgatggtctcatttactcctcaatgctgaacaggaatgagcctcgccagctgatagggactgagagataggaattctaagctgaggctgtgccttggagaggcatgaggcagagaggacaggggagagagggagcatcagggaagtctgtctgtgagcaccacgtgttcagtggcgtttcctaccagggcctcagccatcacagccaccaaagggagctctgcgtgccccactccacaatacctggaggccccacaccccatacctcagaccccgagcctttagcaccagcacaggaggtggctgcccccacagcagtaggcttgttggctgagcaagattcttccctacctcttccaaaggcctgaaatcccatcacaaagcagtcttatcccccagggataagaatggagcatgtatctggggtcccttaggctggtcaagcagggtggggctttaaaacggcttccaccccaggactctgggggccaaaggggagtcatgtgtgtgcaaagcagacataagcctttaaaggaatagcattgcagttattcatctctgctgtccaaagacttgcctgtagatgaatatttcagaaaaatgacattttcttttctaatcacagaaataaaatatgcctatcgtagaaacatggaagatatgggagatataaagaaaaaatgaaaatcacccagaatgacaccatctgaataatttctaccagccctttgatatattttattttagcattgtgtgtgtatgggatcacattgtaagcaattttatatccttcatccattgaatattacattgtgatcgttttccctatcattaaatttattggaaaacatttttaatgccttcataatattcaatcttgtggctgatccataatttatttaaccatctcctcctttttgagcatttaagttatttataatttgtgaatattaaaaatatccacaaataataatgttgtgaacaacttcattcataaatccataggcacttttgtgcttatttctttagaataggttcctagaactggaatcaaagggtctgtacttggcaatgagtctggatacctactgccaaggtattggtctccagatgcaggctttgcctcaacagctgagaatgcccttgtcccagcaccttcatccgcattgagcattactgcttcttaaacctctgctaacttggtacaacaaacggtgttggttaatttatctgttcattgattttttttccagctttccaatggtgtgtcagtgttttacttattattttaagtgttccttatatgtcaagtttattaccatttccccaaacatgttacaatatttcttcccgttggttatttgccattaatttttttataatagctgtgttgagatataattcacataccatacagttcacccaattaaagtgtacaattcaattcagtggtttttagtgtattcatagagttgtgcaaccatcgccacaatcaattttagaacagtttcatcttcccaaaaagaagcccttgcccaatagcagccactccccatttcacttcaactcctcccccagccctaggcatccaccaatccatttgccatctctatggatttgcctattctggacatttcacataaatggaatcatgcgctatatggccttttataattggtttcttttgcctagcaaaatgttttcaaggttgtagcatgtctcaatacctcaatttgccattagactttcttatgattttaatagcagcagttttaaatttttatgtattgactgtttcaagctttccctttgtgatctacccctcctattctccgaggttaggtgtcctctagttaaatttacaactatattttctgctaatttttttaaaactactttgttaaaacattaaaataattaaatctcaaggtaatatatggatatagtcctgttgtaagtggctttagtttttacattaattcttcaatctacctggaatgtattttcgtaaatagtaatagggtgagagtctaatttaatttttttttcccaatagtcaattgtcgtagtgtatttctaccccatttgctgctactgcttccttcataatttattaagttcttaaatgtacttgggtctatttcaagtcttctctgttacagtgccttgtttatctatgattgtaccagtgttgtattttctaattctaacagttgtaaactaagctacatcctggttagacaagtcacctctcttattgtttttacagtctttcttaattcctttgcctattcattttaccagaagatcttagaattattttgtcacatctatctgtcttctttttaaccatgcattttccccaccagtaaacagctgccaataattttatttgttgtgttttttaaataatacattaatttgggaattgattgtattcagtcttccatctggtaacatatgtttcatattgtcaaatcttattttatatattttattatgtttttaattttttctatttctgtgccacaatttagggccttcccgatgtctttgattgcttttgattttttttattgctattgtgagtggatttctaaaactggttatttctggtattaaagaaatctctccccccaccccccaccggtttacttttctcaacactcttttctaattataagatattttctggttgtttcctttgcaatttctatgtctttaatcatactgtccaaagcaatgattattttttcttcctttttaatagttacatctctaatttctgtttcatttcttattgccctggtctgatctttgaaaagtgtaaagcattagtgaaggggaataagattatttctctctaattttaatgggactgccttttgttgtttcatcaataagaattgtgtaggtttaaagtagaatgctaggaagaaaataacacatattaacttgaaagaatagtaaagaagaatatatatgtttggaaataaggatattgttttccttgttgatcaactgacatgaaattttgattactattaatgaaaacatatgaaactatatttcaattttaggatcaaccttagtcatgttgaatgttgtgttttgtttgtttgtttgttttagacagagtctcgctctgtcgcccaggctggagtgcagtggcacgatctcggctcactgcaagctctgcctcctgggttcacgccattcttctgccccagcctcccgagtagctgggactacaggcgcccgccaccatgcccggctaattttttgtattgacgaggtttcaccatgttagccaggatggtctcgatctcctgaccttgtgatccccccgcctcggcctcccaaagtgctgggattacaggcgtgagccaccgcgcccggcctgttgtgtttgttttacagtgctcttgtttaatgcttacatctgtattaatatgtaaatttctctctctttttttagttacattgccacattttggtataagatttttactaacttcataaaatgaactagacagaattttatattttttaattcatgaggcagttaatatagcatggaattatgtttcttaaaagtttgaagaaacccacttgtaacactactcggtcttggaatctttctcagatgtaaactttggtagttttgaaaaattctgtccttataattgacctcttaagtttttatttgttcttgtgtcacaatttgataatttacattttctagaaaaagtattaaatttgctgggatttttcaattcataagcacagtaccatatagaaaggttttaaaacagaagacaacactgtctgttgttgtatccccttccttattacttgtgttatttattttctctcattctcattatttataacaataatgtagagaactttgcatttaaatgggttttattactcacctccagcttcctcattctcaaattcttcatttggattcattactcaatagggtggagtgtgttttcaagtattatgttttttctaaaatcatatgttataactttagagctcatgtgtgtcttgaagtgtgtttgttgctccacatttagacagtgtgttggtcaagtagaaaatgtctggccacaatcattttctgcaaaattcagtagatattgtccaacgtgttctgttcttgcctttgtgagatgacgggaggctagtccttcattggttatctggtttcttcttttactttttctcctgcctgaattcttgttgatttttaaaagtccttttggacaaatatgagagctttcaaacataatgtattaagatgtattaagttgtttctgtgtgtatgtttgtatgtgtatgttaacaagagtatgagattaatatgttcagtatgatgagaaacaggcactcttactgccttaaaatacatctcccatggagtacagcagtttttctcatcctctgcattactgaaattttggtctgaataattctttgttgtggggagctgtcctgtgcattgtagaagatttagcaggatccttggcctctattcattagatgccagtagcaccccctctcctcaagttgtgacagccaaaatatctccagaaattgttaaatatttcctggggttgggggttggtgccagaatcgccccctgttgagaatcagtgcaatagaaggtggcctgacttgtatttttttatttagaacttaggggcagaaatagatcatttccactattttatttcaagtttgctctgtttcaggcaaaaatccatttgtgtgcctcagtttatgtttttaaatttcactttcatgacctaataattgatggaaatccctgaaggttctaggactgtgtcaatttgtagtatatgcaggcttcaagtttttacttctagtttttatggtattttagtgggaatctgggagaaactgtgtcaggcattgctgtctagccactattttataccattcttctttttatgtgaattttctcaccctgtgcatgtttatactttaaactctttaaaaaataattcctgtttcttaggagaattgttttgaatatatagtttggtattttaggtgaatatatcactggttaagattataatttgggatgaacaatgaagtagtttattttgggccaaactgaaaaggggccccgctgcaactttaaatacatgtaatcagctcttccagacaccaccaacacttggttcaggccacacgtggtaatgatggctgagctgagctatcagcttacagtctctacctagtcaattctgaaaccaggcagtgatgaaaatcccctctaaatgcaaagaagtgtgagactcagttgaagcatggtgtgaaaacagtttggctgcataccctttgcccaacttcatctcaagagactcgggaaaaatatagaaacacctcctttccatattgtttattttcatgtcacaaactgttgggtggaatgaaaacagggctctagtgttgctctagttgtgaaaatacaacttttacttcttctgttttaatcccagagaggggaagttccaactaatctgctaaagccaccttctttaaaacctttcaaccacgtggtttagaaacacggatggacatcgccagaatttaaaagtgtgctagttcccagccagagcagagcacgtgtctgggggctcccttttcatctggtctccatccatcctacaccggggggttgtctagcacctttttccttcctgttgtagtgggcccactttggaaatggcagcttttcatttcgtaaattaatttctatttttattaaagtaatggattaaacaattccatgagtaccaaaaggaaaaaatcagtttcctgatcatctcccctaccccattcttttccctaacacttcctatctgtttcttagatatactcccattttttgaattatatgcttaatgtgctttattgatgtcaatttagacattgtcttttgacttccctttatcaatgctgaggatttggatctcttgcccctttctatatttttcttcttctcttattttgctaatatctattactatatgtattatatatccatgtggtaattatatatgatttttcatatctacatatgtataatacaaaatgtatatttgttcactttgttaacatatatttacaacttttttgttaaatgtagcgtgtttagattattatatctatacaaccttccttccttccctccctccctccctccccccttccttccttccttccctccttccttccctccttccttctttcttttttttttttttttcaagaaggttacaaagaatatttatttatttatttatttattattatactttaagttttagggtacatgtgcacactgtgcaggttagttacatacgtatacatgtgccatgctggtgtgctgcacccactaactcgtcatctagcattaggtatatctcccaatgctatccctcccccctccccccaccccacaacaatccccagagtgtgatgttccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacatttgcttaatcaagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttgtttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactgtgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtatatggtgtaaggaagggatccagtttcagctttctacatatggctagccagttttcccagcaccatttattaaatagggaatcctttccccattgcttgtttttctcaggtttgtgaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcgtaggattgacttggcaatgcgggctcttttttggttccatatgaactttaaagtagttttttccaattctgtgaagaaaggcattggtagcttgatggggatggcattgaatctgtaaattaccttgggcagtatggccattttcacggtattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctacatatacaatcatgtcatctgcaaacagggacaatttgacttcctcttttcctaattgaataccctttatttccttctcctgcctaattgccctggccaggacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtgcataagctttttgatgtgctgctggattcgttttgccagtattttattgaggatttttgcatcaatgttcatcaaggatattggtgatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttgcttggtaaggtattgattattgccacaacttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcactaattttttgaagggttttttgtgtctctatttccttcagttctgctctgattttagttatttcttgccttctactagcttttgaatgtgtttgctcttgcttttctagttcttttaattgtgatgttagggtgtcaatttttgatctctcctgctttctcttgtaggcatttagtgctataaatttccctctacacactgctttgaatgtgtcccagagattctggtatgttgtgtctttgttctcgttggtttcaaagaacatctttatttctgccttcatttcgttacgtacccagtagtcattcaggagcaggttgttcagtttccatgtaggtgagcggttttgagtgagattcttaatcctgagttctagtttgattgcactgtggtctgagagatagtttgttataatttctgttcttttacctttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctctttttgttgaattgatccctttaccattatgtaatggccttctttgtctcttttgatctttgttggtttaaagtctgttttatcagagactaggattgcaacccctgcctttttttgttttccctttgcttggtagatcttcctccatccttttattttgagcctatgtgtgtctctgcacgtgagatgggtttcttgaatacagcacactgatgggtcttgactcttgccaatttgccagtctgtgtcttttaattggagcatttagtccatttacatttaaagttaatagtgttatgtgtgaatttgatcctgtcattatgatgttagctggtcattttgctcgttagttgatgcagtttcttcctagtctggatggtctttacattttggcatgattttgcagcagctggtactggttgttcctttccatgtttagcgcttccttcagaagctcttttagggcaggcctggtggttacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacacttatgtgtcttggagttgctcttctcgaggagtatctttgtggcattctctgtatttcctgaatctgaacgttggcctgccttgcgagatttgggaaattctcctggataatatcctgcagagtgttttccaacttggttccattctccccatcactttcaggtataccaatcagaggtagattttgtcttttcacatagtcccatatttcttggaggctttgctcgtttctttttattcttttttctctaaacttcccttctcgcttcatttcattcatttcatcttccattactgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatttcctcccatagctcagagtaatttgatcgtctgaagccttcttctctcagctcgtcaaagtcattctccgtccagctttgttctgttgctggtgaggagctgcgttcctttgcaggaggagaggcgctctgctttttagagtttccattttttctgttctgttttttccctatctttgtggttttatctacttttggtctttgatgatggtgatgtacagatgggtttttggtgtggatgtcctttctgtttgttagttttccttctaacagacaggaccctcagctgcaggtctgttggaataccctgcagtgtgaggtgtcagtatgcccctgctggagggtgcctcccagttaggctggtcgggggtcaggggtcagggacccacttgaggaggcagtctgcccgttctcagatctccagctgcgtcctgggagaaccactgctctcttcgaagctgtcagacagggacatttaagtccgcagaggttactgctgtctttttgtttgtctgtgccctgcccccagaggtggagcctacagaggcaggcaggcctccttgagctgtggtgggctccacccagttcaagcttccctgctgctttgtttacctaagcaagcctgggcaatggtgggcgcccctcccccagcctcgctgccgccttgcagtttgatctcagactgctgtgctagcaatcagcgagactccttggagtaggaccctcggagccaggtgcggcatgtaatctcgtggtgcgccattttttaagcccgtcggaaaagcgcagtattcgggtgggtgtgaccctattctccaggtgccgtccatcacccctttctttgattaggaaagggaactccctgaccccttgcgcttcccgagtcaggcaatgcctcgccctgctttggctcgtgcacggtgcgcgcacccactgacctgcgcccactgtctggcactccctagtgagatgaaccccgtacctcagatggaaatgcagaaatcacctgtcttctgtgtcgtcaggctgagagctgtagactggagctgttcctattcggccctcttggctcctccctcaagaaggttacaaagaatcccttctctcttttcttccttctctctctctctttctccctttctctctttctctgtttcttgatggggtctcactctgtagccttgtctggagtgtagtggcctggtctcagctcactgcaacttctgcctcctgggctcaaataatcctcctgcctcagcatccagcgtagctgtgactggaggtatacaccaccatgcctggcgaatttttgtatattttgtagaggcagggtttctccacattgtccatgctggtcttgaactcctgggctcaagtgatctgcctgcctggatctcccaaattgccggggttataggcatgagccactgcatccagctgcaactatttttcaatgcttagccaagtagagttacattgttattttctttttcttgtacttttttccacaaagccaatcaaaattctataataataacaaatattattttccaaatgctcagatagttcagatgatctcccaactccttcctcaagtcctctcttcaaaagtatgcttgaaaggtaaatgttttgtatcctcacttctctgaaaatacaattatcctacccttatatttcgttgattggctgggtatgatgtctaagttaaaaatcatttttcctccaaaatttgaatacattgatttggcttcttctgcttgtcagtgctgctgttgggaaagccagtgacatttcaattttccttattttgtttttgggtttggtttgattttcttcgttggaagcattcaagttcttctcttttatccctgaaattctgaaatttcatgtttcttctttttctaatactcattgcctgggtactgcacagatatttcagtctggagtttgatgtctttttatctgataaaatttattctagtgctttttggataacttctatccattttaccagttatctttctcaaacttttgttagtaagatatgagacttctcagatggattcttttatttttttttttaaatctcttttttctatctctgattttttttttctttttttaggtcatttctcctacttcatcataaaactattttattgatttgtttttatattagcttttatttttatttcctaagacatttattttcatagcatcctgttttactttcatgagtgcaatattgttccatctctctgaggatatttattctagttttagacattttcttcaattatctgctttgcttctttttcttctgaatcctctgtttgtaggttttgttacctcagactgagggcttaaaaaattgtatctgagcacccaggccatctcttcatattttagtgtgaggcactgaaaggtgatcagcagctctatgtgagtggcgggggctgattgatgaatgggtgccattgttgggtggtgagatggcaagatgatcagtgcactgaagttagtatccagatatcttttctcagatgccttacaatttttaaggagaaaatttctctaatcactgaattttatttattcatttggtgggagcatgctccatcccctacttcccagaactgtgcttttgagttccagtgacaaagaagctcatgtagcccctccagagacatgaaaattgtggccatttctcaaagtcagtgtctactcctctcttcaaaaatgtgtacagacctcttgtatgctgagtattcctcccagtgctctttgtccaggggtagtttacaccttttctcttctttattgtcattgcaatgggattccaaaaagcagcaaagagaaacatgtttgagtcagagctttgagtgtaggtgacattggtggtaaaagtccatctccctgaagaatgactagcactaggagcagtgaccaccgtaataactgatggacttcaatgcaggattcagtttgtgttgggatagggcagcatgggggaattcctttcctgccagtgtgacagtcagggtagattctggaatcgtttatggtgggttcggcttaaagacagagagacagtctcagagaacccaggccatggtcatcctgaagaaagggtagcatgcaccttgtgtggaaggtcagctcctcttgggggtccatgctttgcctttacagctaatagagtctccagaatcaaccagtcaactcacacctgtaggaaacacataggcagctgctctctctgatatgtgtattcactcattctcaaacctcctgactctaaagtggggaaatgtttcagctttctggggcctgtggctgtgaaaaataaaatgtacacatgcatttggagggtctaggaaagttaccactgttcattgaggacctgctgtgcacaggcatagcactggggattccacagaggtaaattcttcttcgtaatggattttgatcgcctccgaggaagatgggagataactagagctgtccttaaggatatgcagggtagtatcttaaaaaatgagaaattgcagtttctgaatacattgtttgcaaataggttgagagacaaccaggaaatgaagactaatacgttagctcttttcgtattgcatggagaaggcaccatccaagtctaatgtatccctgccctggcctctgaaagctgaataatgtgtcacagattcagagaattttgttgccgtaagggaccccagaggttctagcaaaatgccgccttttgtagatcctgctgcagaggagctattgtgctgcacggtctccctcacaccattagtgtcaaacctccgtcaatatttaaacattcattattcagaatttcatttctctgcttctcttttttttttaaactctgagaaggaaagaaaaacacggttagcaactgtatcctgtatttcttcaggaaagaaatgagccacttcaaagctgagctgatttactggataaatatatatttaggcatttggggactttaaatgtgtatgatttaccagagaaacagggggcatccttcagaatccactatgcaaagatatattgacacaatttcaactgtatggttatgtctctgataaatcagcctgcctccctcagaccttcatggtccactggagataaaatatgcacctcccgttcagggagggcaaggggcaggcagacttcaaagtacagctgggtctgccttggaggatctcacagggaaaggtcctgtgcagcaccagaggcttgatctgggaatcacgtgtgagggctgcaggctcttgactgtgcatctgtaaacagtttctgactgctctgagaggcaggtgctgtctgcctgggggaggattagaggctgaaaacccatgcaggaaactggacaggtggattgtggtgaattgatagctaaatcttgcactttagtgcctagacaagattcggtctcaagtcacagccgcagggactctggacaagtcctgccatgtggctgtgcctggggtgccctgccaaggcagctgtcatggcttccagaagcaggcactttctaaggtccccagctggaggcctatgaatgctcaagcaggtgggggccccagcctgtagctgacttgtaagtgcaacactttattgcctgggagccttttgaaaccttcctgggtgtagaccctacaggatagcctctgcctgtaggacctgaataggatgcacagccagaggaaggaggacgatggacaaggaggctgtcatctggagctgaagaaggatacagagaaaccttgagtatgaaaggcggagaagaaagctgagtgctcacatgctacccaggctggagtaatcttcttgtagtgcactccttcctactgccagctcatagtcatttctcaggccagcttcctccgttgctacattccaatctcatgcttctaactcagtggggttttggagtcacatggccttagcctggggttctgctgcccacacgaagtggggatgggttgtgccaaacaactcccctacttccttctcctgtcctgcatccatcgctccttggggaggctgcaccaaaacctgccatcacccctgcttaggggtcttgtttccgttgtccacaggacttcaccttcagcctttttccactgaaagaaactggcttctacccacagagttgagattttgttgcctacttccacagagggagaaggtagacttgcttgggggaaaaaagaacattctcttattccaagccagtatttccaataattacatgcaatggtaaatggaattgggaaaagtgaattacctttaattaaggagtcttttatacttaaagtacatcctagggagcacatccctgggtaattagaggaggaggctgaaatctagcgtgttctgttttggggcttggaatcccaccaggaccctcctgctcatcagcacagtccctctcatactcattttcatgggtctggcatctgtttctgggaaatgctggacagctggagacctactgtccactggccttgaggtactactccagcatctcctgccactgcacatatacttgcatgatgcattagtcatataccattccatagcatatgagcttgtggcagggtcaggtgactggcccatgtggagggctgtctgtaacatgccagcactgctataccaccaaaaagacaagtttggtccatagggtagttggctcatgggatttgccgaagcatctggtctagccaggtccccaggtttgaagaaaagaggggcataagtgtatggaaatcctctttggagctaacattcatttatctatctctccattcatttttccttccatccactcgtctctccatccattcactatttccacatacatccacttagtactctccagtggctgccaggctttagtctaaatactgaggacagagaggtaagaagccgcttctgaccccaggagcctatggttgggtgggaagacagaggaggccgttggcataggtagcacagcaaggccgttgagacgctatctctggaggactagagcctcaggcccatatcataactactgggggagggtgatgccagagaggactgaggccagtgcaaccaagcagctgggggttgcttgaattggacagggagaaaatcaatcagggaagtggtggaattggcatatacccatccaaaccggtcaggatggaggaggcaggcctgcatggcctgtgaggtcagctgacccctcactgttttcccattctgtgttgtctttgccatgtgggtgctctgcagtgtataggctactgtgccctgagactgagagagatgggtacctgcaggcttgcacagttcaagtgttgctgtcttctacattaacttcacccttcagacctgtggagggtcctcctaactcagccaccatgaaagtgtgactgatgggtgtcctggccttcatcttcttctgaaccgttgtataagcatgggataggttccttaacctctgtgatcagtcaggtcctatgtctatttaggatatttctagaatatctagcagctaggtcagctaggtccacaggcagctaggtcaggaaacccaaatatggaagctgcatcttgatctgtggacggtagcactggactgatgtgactgggtttcagggctgcagaggtttacaaaagtgagcagtggggcttgatgagcagtcctgatgtggctattaggacagctttctgctctcctgattgattgattcgggcagccaagtgtcaggccaagtgggcaggaccagagcaatggggtggtaaatagactaccgagaagatagatggattgttgttctttaatcaggcattctctcaagacatggggaacatcttgacctgggatatcgccaccctcatcccaggcccagtaatgagagaattagcacatgctgaagagctagagtaactgctcaggcttggaagcaaaatagagggttttctgtgcagcaaatcactttgaaactaaatctccttactccagatgcactctgaaaatgaaaagtctgttctttgtttcaaatctccaagagacaggaagaatactgggatcagactgtggcctctggggaggatttgatagaatgctccctggtcttggccttgaaaactggaggaggttcaaatcctcagggagacgtcccttgaggacaaatgctttgtacaggaaagcactcgttagatatgtactggagaaaatgactggttttgcatgaatttggcttttaaaggtcactagcattagctcccaacataaaaccgttggaagggatttagaaatcacatagaccaagtccatttgacagaaggggaaactggggtccagagagtttaggtgacttgcctatgaccagggacaccattgatttaccatctatctccccaccgcccatcagtgatgctttctgtataatgatagaaaaggagtaaatgaaccagctaaaagtttgcactgtatctcagattcactttggataaaagtcttattactgaacaagccaagaggtacaagattgaaatgtggattttacatttcctggaggtttcatgatttctgcattgagtgggtacaattaatctatgttctttgagtggtgaattttattaaaccaggttttctctgcctcctcagacactgactggttaaatgacttataaaataaacttgcaggaattctgcagttagtgttagaattggtgtgccccatattaggctctacccttttcttatcacagtcattgtttacctaccagatctcccaacctaagagccgcaggaacatgtgggcttatcacagagctcgggtgtgtccccttcctgcaagtatgcttctcccactatcctcaccagagtaaggtgtgaggggcaagttagccatttgtagctccagtgaacagtccaagctccactggggtagcctccctaagtcctgcttatataacatgtgtgagtttacttttcacccgtggtggggtaggaatgacagaaaattctttgacacatatccaaagaagagatggtgcccatttctcctccctttgaatctgggctgggctgtgattattttgactaatggactgtggcaaaagtaacactttacccgttccgagtcttgcctttaacagcatgtgctgcttcctctttggtcagttcgtgccctgagtaaacatgtaagtcctgctcctctgcaagaggggagtacatagagaatccctgaaacttcagggagagagagataggcccagtctggcagctgaccctgtcaaggtgccaggctgctgagttggaccattttggctccttgaggccccctatgtccggaattggtgggttcttggtctcactgacttcaagaatgaagccgcggaccctcgcggtgagtgttacagctcttaaggtggcgcgtctggagtctgtcccttctgatattcagatgtgttcggagtttcttccttctggtgggttcgtggtctcgctggctcaggagtgaagctgcagaccttcgcggtgagtgttacagctcataaaagcagcgtggacccaaagagtgagcagtagcaagatttattgcaaagagcgaaagaacaaagcttccacagtgtggaaggggaccccagcgggttgccaatgctggctccagcagcctgcttttattctcttatctggccccacccacatcctgctgattggtagagccgagtggcctgttttgtcacggcgctgattggtgcgtttacaatccctgagctagatacaaaggttctctatgtccccatcagattagttagatacagagtttcgacacacaggttctccaaggccccaccagagcagctagatacagagtgtcgattggtgcattcacaaaccttgagctaaacacagggtgctgattggtgtgtttacaaagcttgagctagatacagagtgccgattggtgtatttacaatccctgagctagacataaaggttctccacgtcctcaccagagcagctagatagagagtgtcgattggtgcactcacaaaccttgagctaaacacagggtgctgattggtgtatttacaatccctgagctagatataaagactctccacgtccccaccagactcaggagcccagctggcttcacctagtggatcccgcactggggctgcaggtggagctgcctgccagtcctgcaccgtgcgctcgcattcctcatcccttgggtggtcgatgggactgggcgccgtggagtagggggtggtgctcccgtcggggaggctcgggctgcacaggagcccacggagtgggtgggaggctcaggcatggtgggctgcaggtcccgagccctgccccgcgggaaggcagctaaggcccggcgagaaatcgagcacagcgccagtgggccggcactgctggtggactcagtacaccctccgcagccactggcccggctgctaagtccccccttgctcggggccagcagggctggctggctgcttcgagtgcggggcccaccaagcccatgcccacccggaactcaagctggcccgcaagcgccgcacgcagccccggttcccgctcgtgcctctccctgcaagctgagggagtgggctccagccttggccagcccagaaaggggctcccacagtgcagtgggggggctgaagggctcctcaaatgccaccaaagtgggagcccaggcaggggaggtgccgagagcaagcgagggctctgaggactgccagcatgctgtcacctctcacccccagccaccaactgaatacattgagggactgtagtccctgccacatggagcaggagaattcctctgccaattaccaacctctgtctgaattcctgacctgcaaaatctttgtagataacaaaaatttgagtttggagtcaagtttcttgggtttaaatccacactctgccacttacttgctgtgtgttctcaggcaaatgctgttcatctctgaaacttgattccaccatccatatctggggtaataatactttcctttcaggagattcgagatacatacactataatgtggtataaagggcctggcatgtagtaagtgtgcaataagcccaagctgatctttggaattttctcagccacccagaattctatcaggcaggggtgtcttaggaatagctccccacatgcagtgtgacatcctcagagcagcctggcttgtcctcttggggacctgcagcattgggagggatgggccatgcagagacacagagccctggggctggggggcatttggtaaaacaggcccagccctgacctgcaggagtgtgggactgaccctggatttgtagatgagacacacctgtgtccacatgcgtgtttgtgtgcccttgcacagacatgtgcacacatcaaagggaaggagaaggagctgctgttgaggatgttcagcccaataaacatggctgtgaggggtcctgaagccaggggttgtgagaactcagggaatcatgtcatagccctggcaggtcactgctctgcccggcctcaaagatactgcaagagaaagctctttctaaactgtaaagcattctatgtgtgcaaggtattattcttaatagcgtgacaaggaggaggaggagatagaggaagtggatgaggagaaatccgcctgaatcctcctgataacaattttacatctataattccttccccttcctaccacatcggaattttatgggggattagtgagcgtccagctgcagaaggcctggagccccttaggataaggctcagctaggactttatttaatgaatccccttagaggggattttcttttgtggtggaaagttccctgctggtaaaggatatattccaccacctggggcctcttccctgggctcctgtaaaccagaagagcagggatgcatccgctctgcagtgtgtagtggtgggcgtgctagccaacatactgagaactttcagcctgctattctattttctctcttcttgtttttgcctcagagagaatagctcccagtgctttcaaccccccagccttcccccaaaccataatgtggtactccctggagttcacttgtctggctcagtaccactgggatgctgggaggcacagtgtctggggggccttctgtgacccgtggaaatgtgagctgtgatgctggtgttcatggccttcctgtaaagatacctcctcacatggagttcctcaaatgcaggtattccaactacacttgtgcaaagaaccccatggtctcactctctcctgacagccctgagcaggttcacccctatgaaaatgaaaaggaaggtccagactgctgagtactatgggcaagaaggtagagacttgaagcctaagatttgagaccccaaataggatagggttgctagctaaaatataggatgccaagttagatttgaattttagataaacaatgaatgcttttttagtataagtacgtccctgttttagtcattttgggctgctgtaacagaataccacagactgtgtaatttataataaacaaaaatttgttgactcatggttctgaaggctgggaagtttaagattgagggcccacatctggggagggccttcttgctgcgtcatcccatggtggaaagcagatgggcaaagagagggcacctgcacacatgagagagagagagacagagagcacacaaaagaggggattgaactcctgctttcatttatttattttctgagacagggtctcactctgtcacctagggtggagtacagtggcatgaccatggctcactgcagccccgatctcctgggcagtcctcccacctcagccacctgagtagctgagactacaggcctgcaccactatgccagctaattttttaaatatctttttgtagagatgaagttttgccatattgcccaggctggactcgaactcttggactcaaatgatccaactgcctcagcttctcaaagtgttggtgctatggtatgagccaccatacccggcctcatctttttatagggaacccacttctgtgataatatccttaatctgttcatgagggcagagcccttatagcctaatcacctctcatttggccccacttctcaacactgttacattgggaattacatttctaaaatatgcttttcaggagacacatgcaaaccatagcagtctcaaatggatttttcacaaagaacagtattttagtgtaagtatgacccacaaaatatttaggacatacatatatgagtatatgaaaaaaaaattcactgttttgtgtgaaattccagctcaactgagtgtcctatatttttatttgctaaatccagcaaccaccctgctgaggagggctgcccctcctgcagtgctggtggtctgggtcttgcttattgagctgagtttgttgagtttgcaaggcagccttcactgggctgattgtttcctcttgaaaaattcacttgcactgaggttggtgactctaggtaggtaaggtgctgccttattatctggtctgtccaaacagcaagctcattatccaactgatcacaggaaaattctcgtgactcatactctaagacctcttcctaaaacatgtatgtatttatttattttttattttttattttttttgagacagagtctccgtctgtcgcccaggctggagtgcagtggcgcaatctcggctcactgcaacctccacctcccaggttcaagtgattcttgtgcctcagtctcccgagtagctgggactacaggcatacgccaccatacctcgctaattttttgtatttttagtagagacaagtttcgccacattgctatggctagtcttgaactcctgagctcaagcaatccacctgcctcagattcccaaagagctgagatgacaggtgtgagccattgtgcctggctcttaaagtatttaaacagctccctatatcaaactgcaaatgccagagtattgaatttaaggaagtccactcctaggattttattttcttgtggatatcttacacacatatcaaataataaataataataataatagtaataataataataataatgtgtgatatctgagcccctaaatacagtttggtacttttctctgtaatcttctatctgttagaaagccaggttcaggcttaatcaacgctggaattggggtctccatcattcccaaatctcaatttcagagtgagaagccctctatgagaaaggtctgtgggcccgatgccttcctgggatggaagcctggagtgaagtctctccccagcttcagctcttctctcttcctccctatacctttccataccatcttctctgctttgactatcaaggagcaggcctcactgacctccctgtcaggtaatcacctgtctctgtgtctggtttgtgactgcctgaggattccttgcacctggtgctccctccacataaggtccggctccatcctgatacagacgttcctaagatatattcctttagcggaagactcttgcatccatagaaatgcagctgcctcttccacggatgacaccttcacaaattctttcccacgttagtgcttgggaaggaagaagcaggacagaagctgacctgcctattccctgaagcctggaggtaagaggtcaatgaaggagaggcactgagatcaggccatgttggcctctcagtgatcttcacacagccctgccatggagcctcctgaagactccactctttgcaggtctgaatgtcagggctgggctaatgagagaacaaataggacaggcactgattagcaggcagagtttgtataatcaattccagaaccatacatttatcagaaaatggattctaattaaaactaaatttggctcacttacaaatcactaacttaaggggaataaaaagatttgcctctgtttattgcagcttgccaggatgtgaaggggcagacatttctgtatatgtcacaagcatagtgggagaatcctgatgctttgtggggagtctggtggctgcattgttactgtagcagataaaggaaatggaagtcatcagaaggcaagaccatctcctgagggtttgcaagtgtcgccaagccatgctttcctggcagggagtggctctgcctacatctgccctgagggaccagtccctgtgggtaaaggccagtatccagccctcagcaagcagagcaatttcagctcttctttgcagcacattgtgtgctgctgactagtgtgctgcaaagaagagaggttaagaacaccagcttcatggtcagccagaaccagttcataatcccaattctgcttacttatttttgactgtttaatacggagcccactgcttcacctctttaggtcttagtttcctggccttaaatggaggcaaaattatgcttgtttcatagggttgttggaaagattaaacaagataccataggcaaaggtctcagcacaatgtctattcttgagcaaatgcttaataaatgacactgattgttcttagaaaatatattaactaggtctttaatatcctaacatatttggttgtttttaaagcggtgtcttaaaagctaaaataagctgcctactcatttcgagtacatgtgagtattcctagctgatgcattatagtatagaaatgttttttccaattttttttcttccatagttttaccttttgtattttctttgtttgaggcttttaatgttttcaggcatctcagaatcaaggctgagtatgaacaagataggttccggagatgcctgagaagtgccgagtaatttaatgctgctgtagcatagtggtggtcaaaatgtgcccacagacccctgggagatcctgtcagggtgatctacaagttcagaactattttcacaataacacttagagatgccattgcctgtttcggtgcattgacatttgtgtggatggtgtgaaagcattgatgggtaaagctttgttctgtctggctatgaaaccagtattgcaatgacaccaaaatgcactagtagtcattgttatcctttacaccagtcactgaaaaaaaagaaaaagaaaaagaaaaagaaagcaaattttgctgaagaatgtctttgataaactagtaaggttagtgtttgattaagtctttatccttgaatccttttgacattctgtgtgataaaatgataagttcaaataaaatacttttgctgcatactgtggtatcatagttgttgcaaggacaagcactcgtgtgattgagttgcaagctgaactagccaattcttttcatggaatattatttttcctgaaataacaataaacatacacaagctgtgggtattcagacttggatatttggaggatattttcttgaaaatgaaaggagtgagtttatcactccaaagcagacaactgaaagtgtttgttgcaaatgattaaatttgagttttcaagtgaaaattggagctttgggaaacttgacagcttcccactatttaagagttgatattaatgaatatgggttttcccatattcattatttcccaatgtatgatgtgaccaaatcaagccagaggtaaaagttccattggaagttcaaaatagataaatgtattttaatgcaatattaatgcaaaactttcattgactaggtttaagattccacactgcaacttaactttttgagttttggtgtagtagcaaagaatattcccaattatctgaaagagctattacagtttgtttccgtttttcaactacatatgtatttaagatgaattttcttcatgtaatttaacgaaaataacatattacatcaggctcagtctggaagcaaaagtgaggctatagctgtcttctactgaaccaggcatgaagagatttgcaatgctgtaaaacccagttttctcgctgttttatgaaaatagttatttttcataaaaatatgttctctgtgttaatatgtaatgagtttattattggagtctgataattttcaagagtgaaaagagccatgagaccaaaaaagtttgagaactgctgctctagcaagtgctttgttctttctaaactatagctcttgctacgttgtattgtcattgtcgcatgtgagcttctattactagctggtcacacaagctccttgaggatctcttcttctttttgtttgtatccatatcaaccagcacagggcagtatatgtttggtaaatatttaatgaatgggataatgcatgtttgatcgtcttaacatctataaaaattcctcttggcctacaggattacctgaaataatatcaggtttcaacagagactctactgtacaagagacctggttcccatttacatctaccccttggtgtctgtgtgtttgggcaagttatacaatttctagtctaaaatattaatccttcaattgagaaatacaaattccccagtcccaggcgagactaattaagtcagaaattctgggggtggggccgagcaatctgtgtcttaacaagctctccaggtgattctgatgtcccctaaagtttgagaacttctgtgcatcttttattctcctctaacatgggaaatataacccttactctgtgaagttacttgcagattacatgagataacacacataaaatgcttagtgacaatgcctgaacactcgataagcagtacctattcttattgtaaaaggcaaggaaacacagactattttttattttactgaactctttccttgcccacagccacagccccttgttcacattctgtggccctgagcttgatgtaatgagtctgactgagttggagagagtagagggacccaggaagctgaggaggatagtgtgtggccaaggccccgaggcttatgttttcttctctccttgatgaaagcctgttgaccattagcccggcaggttcacttctcctacatagtgagggacagcgcacaacagtccaatgaactcaaaaaaggccctgatggagggagagagaggaaaagaagtgacagcttacagagaggtcaagagaggagaaatgctgggcaaattagagcaagtaacctttgcagatggcagctggggaaacagaaggtgagaaactgtcattccaaattgcaactttcacaaggagaatgaatcagtaccttggcagacaggtgcctgagtttcccagtgtcatactctccagcctggcttctcagaggacccattcccgtgaccctgttaaaggtccattggcatctgcaggtcttcttgttaattggaaaagcatcgaactgcacagccagcaaaagcccattgaggattcagggcctctgcaggactgactgacctattaactgcttccctgcctgcagctctcagctttatgtactcagaggtccccgaggctgtgtgctttctctgtagtgcattgattctctcattcatctactccgtttattcattcattcactcattcatttctctgtttatttgtttcttcccttaacaaacatttacttacacccttgtgacagtttctttttactgtaggccagtgcttctagaacagaagcagttttccatccttcccttttgagatatttggccatgtctggagacattttggttgtcaaaactggagagtatattgacaaatggtggagatgatgctgttacacaccttaaatgcacaggacagcccctccccctacaacaaatagttatgtgaccccaaatgtcaatagtgtcaaggttgagaaaccctgccatagatgaaagatggacatttgtgggttacaaagggattgaataggcaatggagagagcagatattgaccacactggcaagatgggcagtgaagagctagagacagtggagtgatggctcaaaaaggaagcacagggaaactgaagggtgctctaagagtcagtggagggcaagggtggaggtgctgggaaggaggagggaagggaatcctcccttagtcccttttctgtctgagtctctttcaagtcttaaaaaaaatactctttttttttttttctttttctttctttcttttttctttttttttttttttttttttttgagatagggtctcactcttccaggctggagtgcagtggcaccatcaccaacatcatggcttactgcagcctcgacctcctgggcttgggtgattctcccacctcagcctccccagtagctgggactatgggtgtgtgccaccatgcctgcctgttttttgtaattttactagacatggggtttcagcatattgcccaggctggtcttgaacttctggcctcaagcagtctgcctgcctaggcctcccaaagtgctgggattacaggcatgagtcattgcatccttccaaaaatactcccctcttgccaaggtcccataaattagatttgaagcagatgtcatgaagcattagggagcagagtagccaagtcatcaccacacctgcccctcgtgcacgcacatgctggcatctagccacatctggcatgcagtgggcaccatgttcctgggtctacctccatactagggctgagtggactttgctaaagggccactgtgtcttctgcttcttccagctttgtgcctcatcctatgagtgtctgtttcaggagatgttagaacaactcaaatgcccaaccaatagtcagttaattcctgcttgcttcatctgtgggctttgttgctaagcacacattgctggtgtgtgtgaggatctgtagagctgggagttctagcccctgtggatgcttccttacagcctcagaagtgggctatctattaccctatagaaggtgcctttggccatcacagtccactggcttttttgggatctaagtggagccgcctattctgcaaacactgccttctgtttccttcttccccgccactgggctgcatccatcattgagcaggtgagttagagagatgccttgccattgagattttttgctgtctttaaaagcacctccttgcctgaatatttgaatcaaattacatctttaagccacttaatgtgttctgatgatctattgtctaacaaacgcattggctaaaaacaacgttaatcatgtcattatttctcacggttctgagagtttgctgggctcagctaggcacttcttgctcaccttcttttgtgcaattgcagtcagatgatggctgaggctggggtcgtcacaaaggcttcttcactcacagatctgatggttgatggtggcatcaactgagaactcagctggggctatctttcagaatacctgcacctgtcctctccctgtgacctgggctccctcacagcatggtggctggatttcaaaatggagcatcccaagagacaggaattgaatgccaccagtttcttaaggccttggcctagaaactggcataccatagcttccattatattaggttggttaaccatttacagaacccagatttaagagaggaggcatagaccccacttctggaaaggaggagtatcaggtactttggggaccaggttttgatacctctttataatatgtgatcagagaagtcctgagcaccaattttgagttggtttctatgtgaggacacaggtgacgaaaccaggcctcctgtccatgaggaacgcacagcttgtggactaacttctggacctgtgaagtctgtgctctgagtgtttttcctgttggaaacatgagatagggcaaaagctggctggtccctgatgttgctctcctttatgcttccagtggtaccccgggaccctgaggagccccaccctgggcatggtgcctgcctcctcttacctttttgtcttcacagccaaggcattttatttgaagtttaaggtcatgtgcagtttgttttctgttgctggcatccaaattgatataaatcattgactaaaggcaagttagaggaaatgatatagagatacattcaagacagcatgtatacatgactaatatggatggccgattgaggggatcttctaggattagattacacatgattttgctttatttgatgactttagatcctaaccttttgagttagacgtgactctcttgaaaatgtaatgaccacctacagccactgttattctgtaaaagtcaccttgatccccatgccccaaatggtaaggacataatgtacagcatagttctttaaattaaaataaacttatatgtttaaaaaatatattgcatttgtcatatttttgccatcatattgcaacactgacaagtgttgtgggcattgtcttcctggtgctcatcctcttcgtgtgggaaggtgagtggcttttgattaccagggcctggtttctgctttttgctgctttgggcatgataaggtttggatgttttgtcccctccaaatctcatgttgaaatgtgacttccaatgttggaggtgggcctaataggaggtgttttcgtcatggggctggatcccttttgaatggcttggtgctgtccccatggtaataagtgagtcctcactctgagttcaggtgagctctggttgtttaaaagaatgtggcacctcccccatgctctcttgcttcctctctcgccatatgacacgcctcctcccctttcaccttctgccaggatttggtaagcttcctgaggcctcaccagaagcagattgcagtaccatgcttcctgtacagcctgcagaatcatgagccaactaaacaccctttgtgtgtgtgtgtgtgtgtgtgtgtgtgtgtgtgtttaagaacggaggtttaatagacaaaagaaagagaaaggagaatagctccttctcctgcagagagagaggggcacccaagtgggtcttccctaaacctccttttttaaaatataaattacccagcattaggtatttccttatggcaacacaagcaaaccaacacaggaccttgcctcatttcgtgagtatttgcctcagatccactggtagtagctaatagaataattcaaatgtccagccacccatgatatctaagagtccttctatcccttactttctggggctctgttatcttacctttgagaactgctataaggaagggaaataagaaatccaacaagctagattggcagggtcatttcattctagcccacctttgctctgggcctgggtgctgaccaccttccaaagtttattttttctttgaaaacttaaagcaagacaaaggcaccaaggtgattatttcctaataataaatcccccaaactgcttcctatcactctattaataacttattccttgaaggtttcctctctgaaatttaggaatggctcaagcaagctgtcatccttctaaatggtttctgatcatagcttcaagattgattagtaactgctctcctatttctccccacctggaggcatctttgagagcaacatgctgaaaagatgacaacagcaggacctaaggaattcataaatggctttgactgcgtgggttttgatgaggtaatatggaaaatgattgcattaagtattgctatttatttacttgactttgtacaggacaatcaattttttcacgttccatgcctcctgtcaggaagttaaacggcagagaaggcagactggaggcattacctcatttctctaagagatgctgtcactcctcaaatcaccttagaatgttgttaataacagcatctttcattcctatccactgagggagtagagattctcccttcacaaagaaaggacactgaggaaggcgagatatgaccaggaaaagatgagctaattttttcatgaactatataaaaatctacttctgtaggtcaattattggcaattttatataggtaacccaataatgtaacacatgactttgtcagtataatgttaatctgtcctaggaaagcaagatttggctctatttgagcatttagagaaaaaattccagacccttgtagagaaagctggtcaatgtttagccttggtcagagcagatatcaaactggagttatataaagagatatgggtcagaggctgaactggacccattgaatgaacttgatggaacagtgaatgcatttctggtgtgtgtcgattgaatattttggggaattctggaaaattgatcagaatgattgatggctcctttaagatggtctcttgagtttgaatatcaagctctggaaatcaggctcctgggttagaagaaaaggctggttagagaaagagaaaaaggaaacaatgtttgctttttatttaagaggtgaagtgtggaagagggaagctgcttagtcatgaggtttgaatttgagtttaggctctgacagcactgtggccaagtcatggtgtctccaaggatcagctttctttctcataaagaaaccttataaaaatataaatggccaagcgcagtggctcacacctgtaatcccagcactttgggaggccgaggcgggcggatcacgaggtcaggagctcacgaccatcctggctaacacggtgagaccccatctgttctaaaaatacaaaaaattagccgggcgtgttggctggcacctgtagtcccagctactcgggaggctgaggcaggagaatggcgtgaacccgggaggcggagcttgcagtgagccaagatcatgcccctgcactccagcctgggggacacagcgagactccgtttcaaaaaaaaaaaaaaaaaaaaaaaaaaaaaaatatatatatatatatatatgtgtgtgtgtgtgtgtgtgtgtatatatgtgtgtatatatatatatgtgtgtatatatatgtgtatatatatgtgtgtgtatatatatgtgtgtgtatatatatgtgtgtgtgtgtgtatatatatatatatatatatatatataaagttggtgtgttggttaatataatgtgtcaccttgggagtccatggtatccagatatttgttcaaacattatgttagatgtttagattttagatgtttctaggaaggtattttttagataagattaacatttaaaaaaagtctcaacacgtagaaatgataaatactcaaggtgatggatacccccaaatatcctgacttgatcatcacacactctatgcatctaacaaaatatcatatggagcccataaatatgtaacatactatatattattctttttaaaaaggaaggagaagaaaacagtttggcagttactcaataagttaaatatatagtcaccataagaaaaattggaaactttatgagaccttttgggaactggtttaaggtgagatttttaatgtggaggtttaattagaatggtaaggatcaggatgtaacagtgtaagactggcaacacagcaagatgaagattttgagatgaggtctttgaggggagtcttagcatatcaatagttgtttgatgctctctgtatatgcatcttttgttttcttgggcaattgtttcctgacatagcagtcatgttgatgaaaatatagtggcaagtgaagagatgctatatgaagatggtcaaatagtaaagttaagctgggcatggtggctcacgcctgtaatccctgcactttggggggctgaggtagcaagaccacttgaggtcagaagtttgagaacagcccaagcaacatagtgagaccagtccctgcaaaaaagaattttttcaaaaatatctgggtgtggtggcacgtgcctatagtcctagctacttgggaggctaaggcgggaggatagtttgagcccacgagttcaaggccgcagtaagctatgattgcttcactgcactctagcttgggtgacagaatgagatcctgtctctaaatatatatacatgtgcatatgtgtgtctgcatatatatatatatatacacacacacacacacacacacacacacacatagcattatttatatgacaaatttatatcatataattaccaaaatattgacattaaaattagattttaaagcagattatcccccataatgtagatgggcctcatccaatcagttgaaagcctcaaattaagttacaaaaaagactccaaaaaacaaagtttacctcctccaaggaagaggaattctgccagcagacttcctttggacttgaactgtaactcttccctgggtcttcagcctgccagcctactgtgcagattttggacttgccagtccccacacttgcatgagccaattctttatatatatatattcctttatccaactgtatttttcaggagatatatatatcaaagttcagagaactctgagtaaatgcttagaaaggggcgctgtatgctgaacgtctcacttcactctgcccttgtaggcctcagatagcatcactcaggggtgaaggaggcaactgtccagagcacagagcacagccagctaacccccccattattgttgtatcaatagccgtgcttatctgtggggcacctcagacttcttgcagcaccagctagcacggatgttagctcataggatcttcacagatttattataaaagatttatattgtggacatatttattgctattttttccagacacaacacagtttccacaaatattacgtattcattccttataaactcaaatttattatagacttagcttttttgcctctgcatgggttttatccctttcctttctatgtgttatcctcaccttaaaagtgcttcctccaaaggcctgcatttgtccttacacttccttcccttataccacctatgctttcatttttgttcaaatttttaaaaatttagtatgaaattaacagatgcctactgtcaaaaatttgaaaagtgagacataatgaagaagtaggcaaaatagtacccataattctattaatattttggtctatttactttaacttgtagcctctttatccagtttactatcattttgtacccaacaatctattctaaacattttgatattaaaaaaatcaagaaccttatttttaatgtctgcccatttggcggtctacctttgggtataatatcatttgctaaacggttcctataatgttggacatttggtttgtatctgtttttcaaaaaatgattatgcataacacttcaaagaacatattgtccttaaatctcagtctgccttttgggttaaatatttaggaaagacactcgatcataacaccggctcacatctctcaggccctcccgtgggccagcccctgtctgtgctgagagctgtgcctgtgcttgcccaggtgttcctagcagttgtcttaacagaactcataccatgatccccattttttcagatgagaacaccaaggtacaggaagataaggtggttggcccttgtccacaatggccatcagctaaaaagcagcagagctctttgaacctgggcagtctgctcctgacacacgtcaccactcactaggttgagggcctgggcatcttccaaggcttcccatacagatcaccaagttgctttctaaaaggtagtcctggtaagtccctgtcctgagcgaacctgtcttgtcatccttgttcacacccggggttgttgtgggaggatgaacagggtcacacgtgtcaagtcgcaacacaagcctggcacttggtaggtgcccacaaaagacagctgctgtcatttctagggtgaaggctgtcaccacacaggtctgagtatgggctcatcttcatggcctttaggaaggctctttcctactctctgtatctgtgcaccttcctgtcctgtgaccagaggacagggaagcaggaaacacaacagtgtttacctgggctctcttccacctgggggcttccctcacaccaccctctgttctggcccagaactcttccctgacttcctccatcttagcactgatggcccacctatcagaccacttactcacaggagaagaaagactgtccatttctgagtccaggctgtcagttaccaagttattgtactgtcagttagcctgcacaccagtgtggaacatcgggcttctttcagcagatccagagctttctgcctgcaaagcccccatagggctggtggctaccactgtgcatgaagaaggtaaggctcccttctgtggagctggtgctctgggaacctgctcaccctccgtggcctcctctgcctgccaggccgcatcatctctccgtcaggctgcgtcatctctccatgtgcttgacacacccttcccctgttcgggcagagcagccgtgctgggctctcttgggatacacccttctcagcaggtgtttgaactctctagagcctctaaaagggcctgtcacaggcaaagctgatgtgatgctctctgttttacccttgaagcaacagattccctagaagggccagcactggcatggagactcactcaggtggtgctgactgtgccctagggcacttctgagcaaaggcaggcccacaaccaggcaaatgttagatagcaacatcaaatccagaactcagagaaagaagttaaattcatctctctattctactgcagtctcattagatttccaatagatttcatgcttccaaatgtattttccacacaaagatgcttggggtttcttggagccctcgcagacgagacaggtgggagggaggagtggctgtgtggtaggaggctgggctctgggagtagggacacttgtaagcagagcctgaggtgtaggggaggcatccaggcggtgagccccaagggctgccatgctgggagaagattcttacccaagtgcgtgttattcagggcacctgctcctccccagctcagctcatcacccacctacgtagaatgaaaggacatctgttatgcagagtggcagtatggagagtcccctctgggcctgctcagtgaacacccccctaataaatttgttgctggattcagacctcaagcacatcacagccacattcttcctgctgcctctgctcccagaatctggtgaggaaggggctggggaaggagcctgggcaagccaaggcttcatggttgcaaagatgagctccagatgccatgttcagcccaggatatctttagagagtgtctttcccagcaggagtccccggataatgaaggcttataggagaaagagaagaagtcacaggcctgatgaaagggatggagaggagactccatgggaggagacctgtgattcctcagtgtccaccactgaggccagctggctcattccatattctgctctctggacagcagcacttgcctctcttctcttctttttcctttcccactttctttcctctcattattctcttcttcttccccagtggaagggccagggtctctgctgggttcttcccatctgtgatgctcactgatgtccacttgtcctgccttcttccctctctatagagtcaggcagtctgggttctggctcccttgccccgctcctcagaggggtcctgtcccttttatctccagtgctttggctactctcacttttttgcaggttctctgagtatggtggccatattttccaatctcgatgtcagattccttgacttgtgtgcacatatgtcataggtatgtgtatacatacaaggtacatatactgcatacatatgtgtacatatatctgtatgatacatgaaagcgtgtcctatgttgcatttactgaaagtctcagaaaacctagccagcgggattgagcctccacctgctcaggccattgtgggagcctttgtcttttaggttggcttcattttagctcccttagtttaagcgagtttatttttctctctcaactggaaaatcacatttgatcagctgtagacagcagtcagatactgaaacattgggattttgcccagaaggcaacccctgtaaagctggcgtgggttctctgaggcaagatgggaccaacagggagacacatacagactgaggggccatgagtcaggtggactgcggacagatacagatggggagacaggaatgagactggaataaagccaaactgtgctgagcactggagccatgagcttctgggtttgggatggtgcattctgtctgcctcactgtctccctcattcctctgctctagtcacagttgatgaatgtggcagagggtgaatcagagcactaatatttgacccatctgctatgggacatgctgtgaatgggaatggcggcccgcctggcaggtggtgagctctgcccacctctcctctcctgtcccttccctgctacgaatgggcccctgtacatcctggggaggaggagggccaggccacaataggggctgtatatctagcttgtctttaccaccattccagatctcaaggttactgctctcctgctgctgtataaaaggtctccacattgtcactgggtctctgtccacataaacctcttgggtacacacctcagtccacaatcctgagggtgctcccattcaaccttctcatcctatcttcatgggcaagttcaaagtctttaaaaacacttcacttgctaacatccccagcatgtgaagctttacctgttccttcaacattgactgttccctgcagtacagctggggcccagtcagagcatcctctgctccacagagctcttctgcctccggctacatggggattctgcagaaagggattcatgttcatacagatgagcggcttgtaggtgggtttcttccctgcagggctcctccaacattttcttattacggtgtactttttaagtcaccaatggagggtttagtatgaaccctttcctaaccttaatttgccataggaagattttattctcagaacactcaatgacacctcacagaatacaatttggagaaggggttttggagaaaacaactggtttttaaactactcactcaagcttgtgaaaatcaagtgtgacagatattatcaaataaatcatatcagcaaatatttctcatgtgtcttctatgtacagcatatcaagttgatccccgatgtgcagcagattcttctgtacagattctattctgtggtaaaactggggaacttatgttccccttctcaacaagtttacttctgaagtagaaaaaattttactacagaaggagccctttctgggtgaaacacaattatttactgcttcacagctactaagctggcatttggaattcaggtgtcactgagagtgcctgagtaccatgttatctggaatattatgacatgggtcacttttctcctggagggttggtccctggcggctcaccccattacaggaaggtcttccaatttgccattacttgaggagtgaactcccacctgcttgaaacaactcaagaaggggtgagagaaagaggggagggagagggggagggaaaggcaggagaatgattacatggagagtggaatgtgaggcaaccagtgggagctttgggaagcaattgttgctgggtctcccaccttgactgttggagttcgttgactgtgatgggtacagggtttttacctgtttcaggtgtggtggatatttgcttaataatgggatttgatgcaggtggtgattatttggacacaacaaagtatacatttcattccaaatagcatcccagggtcttaaactcctggggaacttgaacaggccctgagacacccagaggttggagatatgggttctgactccagttctgccaccactaatgcgtgacctttggcgtgtccccatggcccgtttgggcctcagcgtgccgatgtaagagatgagaatccatctgggccactgatgctcagatacagtgcctgcaggagcccagccagcactgtagattagcaaagagaaccagagtcaaggccagggaagggatgagtgcacaagtgtgttcatcttctatttctgaaagaacagacaatattgaaatatatttaacgtactgtaaaattcactctgtaaattgctttttagtattatccacaaagctgcgcaatcattaccgtgatcttattacaaaacatttcttcaaccccgaaagaaagccatgcttgttaacaatcacacaacatttccagctcccctcagccctggtgaccattgatccactttctgtccttatggatttgcctactctggacattttatataaatggaatcacacagtatgtaatcttttgtgactggccttgttcacttagcatatgtgtttaagattgtctatgtcgtagcatgtgtcagtactttattcctttctgtgactgaataatatttgattgtatggatataccacattttgtttatccattcatcagtagatgggcttttgggttatttctattttttggctattacaaataatgctactacaagtatttatgtataactttttgtaaggacatatgtttttaattttgtttggtatatacctaggattggaatttctgggtcacatgtgaactcaatgtttaagtatttgaagcattatcagacagttttttttatgatagcattctttttaaaacttttttatttttaatttttgtgggtacatagtaggtgtattatttatgggatacatgagatgtttgatagaggcatacagtgcataataaacataccatggagaatggggtatccattccctcaagcatttcatttatcctttgtgttataaacaatccagttacactgttttagttatttttaaatatacaattaaattgttattgactattgtcaccctgtcttgctatcaaacagtaggtcttattcattctttctatttttttttttgtacccattcaccatccctacctcctcccaacaccctcactacccctcccagcctctggtaaccatccttctactctctatgtccatgagttcaattgttttgtttttagatccccaaataaatgagaatatgtgatatttgtctttctgtttctggcttatctcacttaacataatgatctccagttccatccaagttgttgcaaatgattggatctcatttaaaaaaaaatttccgtaggttattggagtacaggtggtgtttggttacatgagaaagttcttcagtggtgatttgtgagattttggtgcacccatcacctgagcagtatacacggcatcctatttgtagccttttatctcttgtcccctcccacctttacccacaagtccccaaagtccgttgtatcattcttatgcttttgtgtcctcatagcttagctcccacttaggaatgaccaccccccccccgacccaagtccccaaagtccattgcatcattcttatgcttttgcatcctcatggcttagctcccacttatgagtgagaacatacaatgtttggttttccattcctgagttacttcgcgtagaataatagtctccagtctcatctaggtcactacgaatgctgttaattcattccttttttatggctgagtagtattccatcatatatatttagcacagtttcttttttttttaattatactttaagttttagggtacatgtgcacaacatgcaggttagttacatatgtatacatgttccatgtgggtgtgctgcacccattaacttgtcatttaacattaggtatatctcctaatgctatccctccccactccccccacaccacaacaggccctggtgtgtgatgttccccttcctgtgtccatgtgttctcattgttcaattcccacctatgagtgagaacatgcggtgtttggttttttgtccttgcgatagtttgctgcgaatgatggtttccagcttcatccatgtccctacaaaggacatgaactcatcattttttatggctgcatagtattccatggtgtgtatgtgccatattttcttaacccagtctatcattgttggacatttgggttggttccaagtctttgctattgtgaatagtgctgcaataaacatacatgtatttagcacagtttctttgtccactcgttgatgggcatttgggctggttccatatctttgcaattgtgaattgtgctgctttaaacatgcatgtgtgagaatctttttcatataatgacttcttttccttggggtagatatccagtagtgggattgctggatcaaatggtagttctacttttagttatttaaggaatctccacactatttttcatagtggctgtactagtttacattcccaccagcagtgtagaagtgttccctgatcaccacatccacgccaacatctaccattttttaattttttgattatggccattattgcaggagtaaagtggtgttgcactgtggttttgatttgcatttccctgatcattagtgatgctgagcattttttcatatgtttattggccatttgtatatttcttttgagaattgtctattcatgtccttagcccactttttgatggggtttttttttcttgctgatttgtttgagtttgttgtagattctggatgttagtcctttgtcagatgtatagattgtgaagactttttcccactctgtgggctgtctgtttactctgctgactgtttcttttgctgtgcaaagttctttagtttaattaagtcccagctatttatctttgttttcattgcatttgcttttgggttcttggtcatgaaatctttgcctaagccaatgtctagaagggtttttccaatgttatcttccaggatttttatagtttcaggtcttggatttaagtccttaatccatcttgagttgatttttgtgtaaagtgacagatgaggatccagcttcattctcctatatgtggttagccaaatatcccaggatgatttgttgaaaagggtgtcctttcctcactttatgtttttgtttgctttgttgaagatcagttggctctaagtattttggtttatttctgggttctcttttgtgttccattggtctatgtgcctatttttataacagtaccatgctgttttggtgactgtaaccttatagtatagtttgaaatcaggtcgtatgatgcctccagatttgttctttttgcttagtcttgctttgggtatgtgggctcttttttggatccatatgaattttagaattgttttttctaattctgtgaagaatgttggaggtattttgatgaggattgtgttaaatttgtagattgcctttggcaatatggtcattttgacaatattgattcttcccatccatgagcatgggatgtgtttccatttgtttgtgtcatctgtgatttctttcagcagtgttctgttgttttccttgtagaggtctttcacctccttggttatgtatactcctaagtattttatttgattttttgcagctattgtaaaagggattgaattcttgatttgattctccgcttggttgctgttggtgtagagaagagctaacgatttgtgtacactaatcttgtatccagaaactttgctgaattcttttatcagttctagaagctttctagagaagtcttcagggtttttgaggtaaataattgtatcatcagcaaacagtgacagtttgactttttctttaccaatttggatgctttttatttctttctcttgtctgattgctctggctagaacttctagtactgtgttgaagaggagtggtgagagtgggcatccttgtcttgttccagttctcagagggaatgctttcaatttttccccattcactattatgttggctgtgggtttgtcatacatagatggcttttattacattgaggtgtgtcccttgtatgctgattttgctgagagttttaatcataaagagatgctggattttttcgaatgcattttctgcatctattgagatgattatgtggtttttgtttttaattctgtttatgtggtgtattacatttattgacttgtgtatgttaaaccatccctatgtccctggtatgaaacccacttaatcacagtggattatctttttgatatgttgttggattcagttagctagtattttgttaagaattttagcatgtatgttcatcacggatattaatctgtagttttcttatttggttatgtcctttcttggctttggtattagggtgatgccagtttcatagaatgaattagggagggttccaccttttctatcttgtggaaggaatagtgtcaaaaggattggtaccaatccttctttgaatggctggtagaattctgctgtgaatctgtctggtcctgggcttttttgttgttggtaatttttaaattaccatttcaatattgctgcttgttattggcctgtttagggtatctaattcttcctgatttaagctaggagggttgtgtttttccaggaatttatccatttcttctaggttttcgaatttacatgcataaatgtgttcatagtagcctcaaatgatcttttgtatttctgtgatgtcagttgtaacatctcttgtttcatttctcattgaggttatttggattatctctctccttttcatggttaatcttgctaatggtctatcaattttatttatcttttcaaaaaactactttttgtttcatttatcttttgtattttttttaaactgttgtttcaatttcatttaattctgctctgatcttggttatttcctttcctctgctgggtttgggtttagtttgttcttatttctctagttctttgaggcgtaaccttagaatgtcagtttatgctcttttagtctttctgatgtaggtatttagggctatgaactttcctcttagcactgcctttgctgtatcccagaggttttgataggttgtgtcaccattgtccttcagtttgaaacattttttaatttctatcttgattttgtttttgacccaatgctcattcaggacaggttatttaatttccatgtatttgcatggttttgagggttccttttggagttgattttgttttattccactgtggtctgagagagtgcctgatataatttcaattttcttaaatttattgaggctcattttgtggcctgtcatatggtctatcttggagaaagttccgtgcactgttgaatagaatgtgtattctgcagttgttggatggaatcttctgtatatatttattaagtccatttgctccaagtgaatagtttaaatccattgtttctttgttgactttctgtcttgatgacctgtctagtgctgtcagtggactattgaagtcccacaatattattgtgttgctctctgtctcatattttaggtctattagtaattgttttataaatttggaagctccagtgttaggtgcatatatatttaggattgtgatatttttctgttggacaaggccttttaccattatataatatccgtctttgtctttttaaagtttgttttgtctgatataagaatagctaaccctgcttgcttttggtgtcaatttgcatgaaatgcctttttccaccctttaagttttagttatatgagtctgtctgtgttaggtgagtctcttgaaggcagcagatagttggttgttgagttcttatccattctgcagttctgtatcttttaagtggagcatttagaccatttacattcaatgttagtattgagatgtgaggtaccattccatttatcatgctatttgttgcctgtgtaccttgttgtttttgctttttaaattgtacttttgttttataggttctgtgagatttatggtttaaagaggttctgttttgatatgtttccagcatttgtttcaagatttagagctccttttagcagttcttgtagtggtggcttggtagtggcaaattctctcagcatttgtttgtctgaaaaagactatatatttccttagcatatgatgcttagttttactggatacaaaattcttgggtgataattgttttgcttgaggaggctaaagatagggtcccagtcccttctagcttgtagggtttctgctgagaaatctgctgttaatctgacaggttttcctttatagcttacctggtgcttttgtctcacagctcttgagattctttcctttgtcttaactttagataacctgatggcaatgtgcctaggcaatgatctttttgcaatgaatttcccaggtgttctttgagctgcttgtagttggatgtctaggtctctagcaaggctgggaatgttttcctcaattatttccccaaatatgttttccaaatgtttagattcctcttcttcctcaggaacaccaattattctcaggttttgttgtttaacaaaatcccaaacttcttggaggctttgttcatgttttcttattcctttttctttgtctttgttggattgggttaattcaaagaccttgtcttcaagctctgaatttcttctacttgttcagttctactgctgagagtttccagagcattttgcatttctataagtgtgtccaatgtttcctgaagttttgattgttttttctttatgctgtgtatttcctcaaatatttctcccttcacttcttgtatcattttttggatttccttgcactgggcctcgcctttctctggtgcctcttggattagcataataactaacctcctgaattctttttcaggtaaatcagggatttcttctcggtttggatccattgagctagtgtgattttttctggaggtgttaaaggaccttattttgtcatattaccagagttggttttctggtttcttctcatttgagtaggctctgtcagagggaaagggctgaaggctgttattcagattcttttgtcccacagtgtgttcccttgatgtagtactctcccccttttcctgtggatgtggcttcctgagagccaggctgcagtgattgttacctctcttctgggtctagacacccagcaagtctaccaggctctgggctgttactgggggttgtctgcacagagtcctgtgatgtgaactgtccatgagtctctcagccgtggataccagcacctgttctggtggaggtggcaggggggtgaaatggactctgtgagggttcttagctttggtggtttaatgttctatttttgtgctggttggcctactgccaggaggtggtgctttcaagagagcatcagctgtggtagtatggagaggcaccagcgtggggaagggggtgcctagaactcccaagagtacatgccctttgtcttcagctaccagagtgggtagggaagggcaatgaggtgggggcagggctaggcatgtctgagctcagaccctccttgggcgtgtcttgctgtggctgctgtgggggatgggggtgagattttcaggttaatggagttgtgtacctaggaggattatggctgcctctgctgagtcatgcaggttgtcagggaagtgggggagagctggcagtcacaggcctcacctagctcccatgcaatctgaagggcctgtctcactcccaccatccccctctaacagcacggagtcagtttccaggcagtgggcaaggagggctaagaacttgccccaggctacctgcctcccagctgaaaagggctttagttcttcccctgcctgtggagtctgcatgccagattcgcaccctcccctgagttctggccaggaggcttctgaacaagttcatattgttacaaagttcagctggagacttccttctccctgtggcattttcccagtgcctctggctgccctcctgagggatccctgtggtgccaggcaggaatttcctgcttggggaacccagtgggctcccagagcctttctcgcagcttcctctacccctgtatttcgctcggctctctaaattgactcagctccaggtaaggtcggaatcttctcccataagctagaccttcagtttccccagtagtaggggtgtgttcagggtcagaggatcccactgcaagtgggagatccctttcccacttcggcagtttgggcactcacagtatttggggtgtctcccagttcctgcaggagcaggtcacttccttcagagggtctgtgtgtcctctcgggattcctggtttattcctgcagtcattctggagctaaaattcatgatgcaagcctccatccgctgctctgtctgtccaagacagagctgcgatctagccctgcctcccatctgccatgatgatcgggaaccaatccaaactgtttttcaaagtggctataccattttacattccagcaatgtatgaagatttaattctctacatcctcactaatacttgttaatatctgtctttttttattatagccttccctgtaggtatgaagtgatattgtggtttcaatttgcatttccttagttattaatgatgttgagcatcttttcatgtgtttactggggctgttgggattatctgttctatttctttacccatttttaaattggtttgtttttttattgttgttgtaagtgttctttatatattctggatactattgtcttgtcagatatatgatttacatatattttctaccattttatgagttgtattttcacgttattgatagtggtttttgaggcacagaagtttttaatttttttttttttgtttttgagactgagtcttgctctgtcacccaggttggagtgcagtggcgcaatctctgctcactgcaagctccacttcccaggttcgcgccattctcctgcctcagcctcctgagtagctgggactacaggtgcctgccaccacacctgactaattttttgtatttttagtagagacggggtttcaccgcgttagccaggatggtctcaatctcctgacctcgtgatctgcccgccccggcctcccaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacaaatatttatgcttatgatttttaaattttttttatagttttagcttttttcatttagctcttttatccattttgagttaatttttgtattgcgctctcttaagtaatcaattcaattaaaaacaaaacaaaacctctgagttgggtcaaatcaaataggcacatgggtcaccagttttgcaagttctgagcaggggatttcatagtgctctctgctactcttctgtcaggcttacagtcttttttgagttattggggagtaacccaggccccaaggaagacagtttggaacaagacttaccgtagtagtaggtactgatgggagctgtcctagggcaggcaaatatgctggctcccctgatgagaaaggccatatgaagatgaatgtgcttgcaagccggcttcacagctgggtgaggccttaccaggtgggattgaaactgatcccaggttctgggggtttcaggcctggcatgctcacctatacatatccttccagagcccaagtgctgccctggtttctggagatctggatccccttgctagtttactataaccagctttgtgatcacaggccactcactgaaccactttgagctttcagtacttgctctgaagcttgacatcaataaccttgtgttcaaattttgatgatcacttgagtcccaccaatacatgattaaaaaaaaaagctagaatggtttgattatggcagcatcaagtagtgtttccccaaatgtttgccattgaaatgagagaaaatgtacttgtttggtcaaataactgacactcactaaatcaaatacaaacagatgtctttactgcaggacttttcagagcctttctgggaacacatagcctgaatctatagaagggggatgtgctatgcagcttccacagtgtttaactgtggaagagttattgtaaaaattgaattctttccatttcaaacactgcaaatgaaaccaccatcatggaatggagctggactttcatctgtgtgtgatgttgtgtgggtcacaatccacgttatccaacctgatacacagagttatgcctcctagagcttcacgctctgttgctgcctaaaaaagtccataaagttggcctaggttatggagagggactctggtcctgtaaggctttccagtcttcactccaggtgggtctgacattcagggctgcctgcattcctctgttgggcagcaatgaaactctatgaaaccctagagtttacttgacctgctttagaccattggggcttgatcatgtcagaggtagaaagccagggtgcctctagacttacgcaccagcattacttggagtactgaccactataaactggccagaactgtgaaactgagcgctggtgtttgggaatgagtcccaggttcaaggaagtaagaaagggacttgcaaggccactgtgcaaaatgacctttcttttttcatcagttcagggcatttgcttattattatgaggagtttgggatggggtaggtaataatcataatgaaggaaaaaataatacacagtaacaatttaattaatttatacttcattaataattttataatgtatcctttttgcattctatttaacttctaggttttagacattttaagacaaatgtttcattgttttgcattcctaaagttaagtgttgagagttatgtgatggatggtagggtcagaatgagtatcgggcataggagagaaagctctgtaactgcaacaagtagatgcaaagggagatcagatcataagctcttattctgcacatagtaaaaaatgatgtgcatggtcaagtgttcattatactacagcgtcactctggccagggagggtcagatgggtggtctctctggtctgtgttcctcctcctcaacctggaagcttttatggaatgagcaaactatcctcaaatactgtccccctcaaggactaaggagatccatccagccagtcttcctttgctgatctgatttcactctgctatggcacaaggcttttaaactttcaacaatgtagaaggctttgctggtagaaccactaaggagacccaggttccacacactgatttcctttgtgctgggatgcaaaggtgaaaccatacaatctctactcctgggaatatcagggggagactggacccaggtaattttaagtttaggctgagagcagtaagatctcagaaaaagacaggtacagatttgggagctcaaaggaggcaaagatcatttccagctaatgtgagaggtagaaagtctctgtaagacaaaaacaaacgtaggagttgaatatgctgcactggggaaaggatttaggtggcttcttctgagagctcctgaaggcaagctgcagttatgtgatgagataaagtgctggactaggatgtgtgaagtcttacattgtgggccctggggatagaaaatttaaagcaatttgacattctttctgctccagcaccatttcctttgaagttctgggggacctccccttagtgctttattttgatgatgagtgaaaaaactcatggctctaaatgtcatctgtacactaatgactccaaaatttacatctccatcccagacctgagctccagacatacactcacctgctgacttgacatctccccctgggtggctaatagacatttccatctgagtgcatcccacactgaactcttgatttcctttttcactttgattgctcccaactttttaccatctcaataaatatcaccaccacagatccagttgctgaatgaagaaaagttaggccattcttgattcctctgctcaacatctttgccagccctgcccccagtcccccagcacattatttcacctctatctccagaataagttccagctgccatgtctgttcttgccttctacagaccactccacacagcaggcagatgaatggcttaaaaaatgcaagtagggccaggtgtgatggctcacacttgtaatcccagctctttgggagacccagtcaggtgggtcacctgaggcccaaggtcaggagttcaagaccagcctggccaacatggtgaaaccccatctctactaaaaatacaaaaaattagctgagtgtggtggcgtgagcactagtaatcccagctattcaggaggctgagacaggagaaacgcttgaacctaggagggggaggctgcagtgagccaagatcacgccactgcactccagcctgggtgacagagtgagactccatctcaaaaacaaacaaacactcaagtaaaacagccactttcctctttaagcccccgcagtgacttatttcacttataatgaaatcaaattttttaccagccctctggaacctgactccgttctgctctccaatggtagctccttccagtctgcccagtctctgagctgcagccacagcagacttcccgccgatccccaccaccagcctcactcctgcctgggggcctttgcacatgtcactgcctcagggcctttgcacatgtcacttcctctgcctcaaaagctatttcctgattctttttgtggctggctctgaccttgctgtctggcacgccctctcttctccatctttgttaccacattttatcctgttttacttgctataaagtgaatccatatatgaaaccttcttgtgcagttgtttatttattgtttgtctcatctttcttcttttctatcactggaatggaagctccatgagagtgttgctcttttttcttcttgatctgttttgcttgatttgagttggcccctacattttccagttgatcagagggggtacccatttattctaagtctcatcatgagttcatagatttaaacatacttcatgcgtttcaaccaagtaaatatttgtttaatgaatgggacattgaataaatgcaagttaagaactttctataggctctcaggttttttttttcttttcagactttatagtaccagattttatatgaaaaatcattgtatgatttttttctagggttaattctactatttgagtattttcttagtactctggggttttattgaataaacaacataggccctgcttttatggatacttttatccatctgctactgaacacaacagttttaattagatcttgaattattttattatcaaaacctgctgttgcatcctctgcacctgtcacctagtaagagttcacaaaagtatttttaacatatttataatggaaaatttcaagcacatgcaaaagtagagagagttgtatagcaaactcacttttacccatcattcagcttcaacaattgtcaaaccaagaccaatctggctttaactaattccttatgttgaagcaaattcaagacatcctatcattttatcagtaaatatttcagagcatatctctaagagataagaattcttcagagtaaataaccgtaataccattatcacatctaagcaaatttataataatctctgaatatcatcaaatatgcagagagtgttcaaaatttcctgaatgtctctgtctttctctctttttttttaagtttatttgaatcaggctaagaagttccttaaactgcagtgggtttattatctctttttagtctcttttaatctatagttttccccctttctttttttttcttgaaatctgtttgtttaagaaaccatgttgtttgtcctatggagcgttccatagtctgagtttgctcgttgcattccagtggtggtgtttagcgtgttcctctgtcctctgcaatttctgtaaatgggaagtaaaaaagtttgataagattcaggcttatttatttggaaagaatacttcaacttcatattcatccatggaggcacatcttgtctgattcttctctctgtgatgttgatgttagggatgttgattctcattgtccagatccagtctttcattagggtttgcaaaatgttactattccaattctatcattctttctgcatatattaactgaaatattttataagaagaaaattgcccttatttagttatggtttgtataagaaaggcatataaatgcttgattctctgtcttgatcagttttcaaaataatgagttgttctctacattctccaattgatcagtggagtgtttaaatatcatcatgagctcatagatttaaacatacttgatgcatttcaatcaatggatatttgttgaatgaatgagaaattgaataaatgcaagtttagaattgtctctaggctttcaggtttttttttcctccactccagactttgtagtcccagattttataaggaaaaatgttgtatgattttgttctagggttaattctactgcttgatatgtccttagtaccctaggacttttactgaatgaacaacataagccttgcttttatggatacatttatccatctgctactaaacacaccattttcagttagatcttaaatatgttatcgaaacctgctgatgtgtttcccacctgggaaggtgttggtcactgatccacaggcaattgcacttacctagtcttagccccagcttctatactgtggctttgggccatcccctcccctctgggcctcagtttccccatatgaacatgtaggggtggcactatgtcattatgaaggctgtttccaatccttacattttggggagctctccttcttccatactgcatgtgacctctaagtaaaggccatgtaagcagcatcagagggggcaagcagagtatcagggtggtggggtggaaatgaggagtgagacccacaggccagggtgagagcctaccatgcacaatccaacaagcagctcaaaaggacccctcgctgtaatacacctatcattgcctgtgtggtttttctttaataactttctggagtttggtgggagcaggaggtgccaaccaggttaggaaagatttctgggattctctggtagtatccaaaggaggaaagactaggtgctggatacaagaagcagtttcaaagtatgagcctttaagcaggttgattggatatctgaactatccccaaccagccctgggcttccttttcagtcatctctaccacctgtcaatgttgcgctttctggaggctgaaacaaccttgccagctgccctgcccatctgagaattcagacatctagagtgccagagtctgctggcatctcccttttgtcaactgcagggttagattgcctgggaatcgatagccagaatccatgagccatctgatgagtagacctgctgctgagctgttgtctgcatatcaccctccaattacagggcccccatttccccgtctgtttcatcatgcaacccaagcacccaggtagaaggccttttgacctgttgctcccatggacctgctgaggtatcttaagatgatgaaatgtctctttcttctgcctcccacactagctgccaacagctaggagctgatgggctttgtgcttcttcaggaataagggcttggctgatgatagggtgtggtggcttatatggcatcatccacagctcttctcagtccctaggtggtagaaagaaagaagcagctggcaggaggctactatcctgcctccactccatcagactcacagttcttcttaatcactgccattgctaattcttactgagtgtggacagtggacaggccactctatgaaggaggagagatgctctttacctgcaaggggcttgcctgatggagagtcccagaaaatgtcttggcacctgtaggtaacgttagccctttctcctatttgaggcagttggggatggatgagtagatggtcagtcacatcagtggttggaaaccatcccaagagatggcttcctggtgtttatttggaagtgctgaaacaattggatatccataagcaggaaaaacaagattacctcacaccatatacaaatattaactccaaatggatcatagacctaaaaggaaaaacaaaaactataaaatttctaggaaaatgttttgaccttagggcaaagatttcttagatatgactccaaaagcacaatccataggtgaaacattggtaaattggattcgagaaaaatatttgtatatcatttatctgaaaagggatatatatatatatataacccttaaatgcattagtaaaaagtcaaacaactcaatttaaaaatgagcaaaaatatgcatggggatttcagcaaagaagatacacaaatgatttttatacacatgaaaatatgcccaacatcattagtcagtaaggaaatgcaaattaaaaacacaatgatatactactttacactcactagaatggatataattttaaattcaaaaatggaagtcttatacaatactgctgggaatgtaaaattgtacagctgctttggaaaacagtttggcagtttcttaagttaattataagtttaccatatgacccagcaattccactcctcagatttttactcaagagaatgaaaacatatgtccatgaagtgacttgcatgcagatattcacagcagcattattcataatagccaaaaggtggaaaccatccaaatgtttatcaactggtgaatggataaacaaaatgtggtatatccatacaatggaatattgttcatcagtaaaaaggaatgaaatactgacacacattacactatggatgaatgccaaaacattgtgctaagttattgaagccagatttttgaaaatgttgaatgagtcctagaaatgtccagaaatgacaaatccacagaaacagaaagtagataagtggttgcctagaattagggggtaggagcagttatggggcctgagggacatttacggggtggtagacatgctctaaaatttaattgtggtgagaactctacaaatttaccaagaatcattgaactcataaatttactcaaattcattgaataatttacaatgaattttatgatatgttaattatacctccataaaactgcttaagataaaaaagaaagaaagagaagtagattccagaatgtattttgccaaaggaaccatggacagggagagaaggggagagtgggctttggaccccgtgggacaagtctcagcctccagggaaggctgcaggccactggtgtgaggacctgccattcccttctgcaggagtggcagtcttgggcagcatcagcttacaatatcctgctcccaggtttgttctctctttctcacccacatatctgggaccattcctgctctctgaacccctcagccaccatgcctttgacttgcagtcacagacttgcccctctccctgctctgatgtcagctgtccctctcacccactctgtttttctgaagcctaggtcctctgatgagcatgccctgctttctagtgtacatcactgggccatggatggctgggcttagagttgttgggagatggtctcaaacctaggtaggaggaagacgtggtagaagcagcttactgaacagagaagggtggggtagcaggagctgaaggaacaacatgtgggacatgggtggaggggaaacataaagaccctgagatgcatacatggcacatcctggtgctacaggagggactagagccgacccatgaaggcccattccagggccacaacccaatgactggaagtaggaagctcaggagctgcagaggcatttgtggttgactttgctggattttgagaatcaagacacactttgctcccctcacatctcccataccagaaggttgatctttgccattggtttagttatttacttccatgtataaacagccctaattttggagcccttattatgtggaagactctatagaaagcatgtgatagcattgatttgtttaatcttcacaaaatcttttgaagtaggtgctattattaccactccattttgcagatgatggaactgcagcccagagagtaaagtcagttattcaaagtttgagattcaatcacagttatctcagttcctgcattcccccaggttcctgctcaagggtagatttgatggggtaagaggccaggctcttaaaggcccagtgtgagaagacttcaggccttcagacaagtgtatccactgtgcctggcagggggaggagtatggaaaggagtaagagaagaagctgatatctcctccctcagaagagagggatgggtcttcccaaggaggtgttctgagaccccaaggggcctgaggctgcctgtctgctggagggagaggaaccatgctgggcagggcaccccaagcccaaaccccagccccagatgccaagaaagaccagctgcatacccagatcctacattagtaatgtgcagacaggtagaagcctgggccagcaggtctgtccaccctcttgcgccctctgccctgaacactgcaaaactaccaccttctctggccacagcgaaatgggtgggatcttttgaaagaatgatctgtaagacctatgtgctgatggacaaatggacagagaaaggcattgccagcacaatctgtgaaagagagaggaagagggagtatgggagctggcacatgctgtgcccagagaaacctagtcatgcatctttcttagggatcatagcaaagagcggcctgggcctaaaaaattccagtgacaaaggaatctcaaaattccaaagaaattttaacatctctcatatgccttgatattcaacctgcactttttgtgcacgtactatgtgcctagcttcctggacagagaactttgcgtagaacttggcaggctcatgccctttgctgagtcctctttccttttctctggtttctataactgtagtaacctcattgggaggtcattgggataagagttcttgtgagcagacagcacaatgctccaatatccagcacccagcattacagtgttaagcccaaatagttctgggttaggagtgtatcagaaatcatggacatacgtaaaaacaagcaaaaaaaaaacaaaacaaacaaacaagcaaaaacccccaaaaaccaaagaaacactaaacagttacccatgatcgcatcttctcagaggattaatgcctctcttgggcttagacagtaataacccagaaggctagaatgagttgatcatggggcgttgagtctacagagtgatggtgacatatttctgggcctatgcctacatccaaatggataaccatgcctgcattcagtgggtgccatatgaggagacttctgccttcattcaaacaaaatatatgcccgtttatccaattgaggcccatacccttcctcaaaaaggggctcatgcctcaatttaaatggagcccatgcctccatccaactggttcatgtagagacttctgcctgctgttgctgccacagatcccctgaccccatcagtgcaaacactctgaaaggctctgctctaaaacctggtttgggagtaggcctccataagcacgtcacctccttgagcccaaccatcatcacatagtggagtcctgccgtcctgagctccctcgtggcagctctccttctctttctcttcagcttgattgttattccaaaggcctcgttatggaaattacaaaataatggttctgcaatttgtgagtgtgtggttgtatgtatgctaattatcattcctgggtaccctgtctcagaggcactgcagaggaatccagagacgtggctctctcttcactgtagctttgctgttctccccttccctgcctcccttcaccccagctatctccattctctaatgcatgggggcaactggagtgttgagtagacatggccatcccaagtccattttctgtgtccagcggggtacctggaacttaggagtgcccctggctggacgaagaggtgtgacagtgcatctctgtagcaagtgcactgttttaacagagatcctgtttgtttgaggtggctttagtcaataatgagggatgggctaatgttccacacttcttgggattgtcactgtagcaacgctgcctccctggcctgcgcacttctccctagctgttacttgtaagattgggaaagggagaaaggggagagaggaatctcctggggaagcgaggtattcctgcaaagcctggtccaggtgtgatgcactctgcagggcaaaatcatgggctcagaatgaggcttcacagaggaggtagagtgtgcccaagggcaagatttcagaagggaaaaagtagggccagagagaagggggaggggtgcaggaggagaaattctgccccaaaccaaaactcttatggttaaggacaaggttaatcagattcttttgaaagggaattgtttctggggtaagtgaaaccttcttaatgataaagggtgaattgctccagtcagattacccctggggacacttgggggtggggcaaaggtagcatcgtcagaggtccaagattgaatagtctgaggagagagtggtcctggaggagaggggggacagcaggtgtgagaggggttcagagactggggtggtggcagtgggacaatttgacatctttaggatttgagtgctgttgagaatgggtggaagtcatggcaggaagcttcaaaacacaccttccctgtactttgatcaggcttgggtgagctacttaacctctctgtagcttgggtcctgcatctgtgaaatggtataataatagcacctacctcatagtctagtgggagaatccaacatgacaatatggctaagcccttagcgcagtgcccacccagagcaagtccttgcccatgatgattattcactgttattattgtgcactgctattgtgttgttttgagagttgagtgatataattcctgtacagcctctagcacagtgcttggaacttaaccactgaatattcaccactgcctgttgcttttacattcagcctcttccagttcagacaggcatcctctattgcaaatctccatcctatctccatctagagacacgaggagaatcaggtgaaggaggggaggggaggtggaagaaggaggaggttagctcagggttctaccttaccttctcctctatcatcaccagagcatgtggagtctttgaggaatttcatagtcttggtacctttgaatatgttcctcacaagttctcagaatgtgtggcttaagtctttggggataattattttaagctactttagaaaaaaaacctgtgtattaaccatatgtatggagggtggagggtgtttatgtaaaaatattccagggttttcgagtagaatcagatttgctaaaggggcttacaaaactctcacgaggatggagagacaaaggttagcataggccactgaggacttttaggttggccactaattattagggagccagtagccagaagaccctggcagggatggtcactgcttctagtgctgaggcaagtagtacatagaaaaaacctggaggttactgcaaaatgtcatgtctgccaaaacccatgggctgctcgccactgctgcccaaggagcttctgctctcttcacctcctgtgtctggtaggagtgcttcttattggtggactgtaacccagacccctagaggctggtgttctgggaaatatggcttacatgtttccagcccctctgagcctgagaggagtataatggggctgatttgccagcggacaatccactcatgtggatgtgaccccttcaatacctaaatggcaatgatcatggatgcagagtcagggccaacatcaggagagcaagagggcacagaatgctcaccaatttgctgtgggcagaaaacacagagctgcatagcttctgcagggaaagaggagaagaagaggaggagggctgtgtatgcttccctgtgaggcagatggaacggcagcaggagtggggagatccaagcagaaggcccaggctgggaggcatgaaatgcaggctcttcccagcatgagtgattggcagggtaggcaggactcagaggcttacaggaaatgtggcttgtccccagaggaccctaaaactgggtcaggactgatagaagagactggggaagccatgttccgtgggagaactgcaggggcaccacggacagacatgagagacaaagaaccattgcagatatacagtcttataattaactcagttcaacaagtacttgaaatagccacatgggctgggcaggaccttggacacagaagtgtgcaaagataaactggttacaggctgtgctctcagaagagtttcttgagagaccaaatgatgatgacgatgataacgatgatgaagaactaactcttctgagtacttgccatgcaaatcactgtacatgcattatcacattcctaatttacagatgaggatcctgagacttagaggttagtgacttgcctgtggtcaccacataagtcttgagaggatctatacctgggcttccagactccacatcctgtagggacagtgctaaggggattctggaaggagacatgccaactggaaaatgaggaatactttcatggatagggtggaatgtgagctaagctgtagagaataggacacatttcaggtttagagatgggagagaaggacaccccagatagtgagattcatgtgagcaaaatattggaacagcataagtcacatagtagggaaaagtaaaaaagagctcttgaaagtctcacttgtctagtcccaagcttccgcttatttaatacaagtccacgagtattgtctaggtactggcaggctgattcatagagtactgggggcagggagcagttttgcaggggaggcaagcaggtgagcagacagtcatacccagcatgggacgttctgtagttgaggcatgtggaagtcaagagctggcacaaagcaggaagtgcttccgtgcgaggggcctgagcaattctgcacgtggatgggaactcctcaggcagccaggcagaggaagccagaaagccatgtccagctgtgttcaccgggagccagtcttccatttgcctggaattctagatggtatttgggaggctgggacagggagagactggaaaagtgagcagggcctgatgaccccattggagcagctgtagaaagtcatgtcagggcattgggctccattgtgaaggctggtgagccctcagggttttagacaggaaagggcactgtcagatctgtgttgtgggatctctggcaggtgtacagaggagaaagcagcaggggggaaattagggagctagtgacaagaggaaggcctggctgaggcaggtacagaaagagggagatttaacaatagctcagaacgtagagatgacaggacctggtgacagttggatgtgggaagggagggagggttagggaagcaacaggctttgagacatttgccttaggctgtccacaggaaaagtccaatagacaggttgaaaatacagaagagaggatgaaggcattagggcaaggctcagatcccagcagaaatggcatgaaatgagactgagggtgagagtaaggggagtgtatggaggggggattaatttctgtcaccaggagcaccttctcccaggctgaggaggtgcaggtaggagaaggtggtgatactcccacctgctgttctcctatttttctaactggagcttttagttatgtgcgtagtatgtagaagttagtgctacatatgttaattgaggcctgcatattaaaaataatagaggccaaatgagtccattgaatcctctgtccctctcactccatccccaagctgcccagaaacacagactagttcttgagcccctggtttacatgaggctccagtctcaccctggggccccctcccttcccaggagcaggtgatgatgacagttcagtaggtgtgtttgtggtggcaggatggtgaaatcgctactgaggcagtgggtagaatctttgttggagttggctctccctctgcctgccttttcaagaatagattttttttcttttctttagctcagggatatgccaagaaaaatgaaataaaagtaaaggaaagaaagaccaaagtgtgtttaattggaatagctttttgccatgtgaaaaagcgacagtttattgcaaaatatttatcttcattatggttggtatcattattgatggagatgccctgcacgctaatgggaaaatctctccaggaggcccaaatcctgatgagctgagtctccaccttacttctgacatgctgggtgagcacatcctttaatttctgggtgcctcagctcacccacccgtacagcctagaaaagacagtgctcatggttagattagcctcgtggagctggaagaagtctttgaggtcagggcatgagaagctccttgtggcaaggactgcaccttgctggctgttgtgtcatataggtcccttgcttaacggaggtgtgcgctgactggctgcgtgatggatgaatgacagagagcgagcctgtgttaaaggaatggcagatcgatgcatctaatctaaccattcatttcacagagaaggcaattgcagtccagagaaggtgagtcacactcatttgctgcagagctggctgaggttcagctccctcattcccaggggcctctccatggttatacccagcagctccacggtccttctattgtgagatattgtagaacatgaatgagaatgtacacttgcagttgtttttgctattcataataaaagaagcttacaaaagtcaaagtatcacttatcatgatggatgtttgataggcccagataagcagacgtaggagctgtaatgaacactaaaatcaagccttgtgtgtgttcaccaataaacagcaaaggtgagggaattactcttatttaccctccttatccccatttcacagatgagttctcgctgtggctcagagaggctacaacagaacttgcccgcaacctcacaggtagcaagggtttaggaactgattctggaacctgggtattcagagtcagtattcagggtgaatttcattgacccattgctgtcttctgcaacattctgggccactggctttaataataatgacccttatctgtgcagccacgagcagacctggcctagggctcacctgtgttctccaatggctgagttagttgattaacacaaagaggcaatgagagcaaccctgactttgaggaattcctaaagggaagctaagcgtgtcttcccaagtgtattacctggtctcagaagtttatagccacaccacataaactggtgcagtgagacatttggctgttctcttggaagagacatcaagagtcatttagaactcctgcatgcaggtttctggtcggtgtcaacacatggaaagcttctggagggctgaagcctttaatgagtggttgcttccttctcccaactggaatcacccaccttggagcccaggtttactgctctgagattgtaaagatgccaaggaatggagacagcctggttttttattgtgcctgcctcagatggaatctgcctctctggacaaagatagcatcacaaatgtttgatgcgggtgtctcttcttgtcctgaggacccgggcctctcagcattgcccagtgttcctcagcacacacaaagctcacagccatgaggcagctgggccttgccctccttgcctctgtctttcccaggtgactggcatcccctgccacatgtccatctcagcatattattaacacctccttctgtctcagactgcttctcttcccccagggagtgctgtgggtttgaaatgatggtctttaatcatttcttaagtgaccagccctgaaatcatttcttagtgccatacacacaaattaaatcataaatccacagtgggctctggaaagaactgaagtgcagcccctgattaagagctgaggggaggcctccccaggagaaaggcgtcagtgtgtgcctagaggaaaggccagggccctggagagaagaaagaagcttcctactaactccctttccacagaagggcctctttgcatttctgttgttctactccacacaaaagagatatgagaggatgcagacagatatgtggggggtggtaggagggcatccatgttagggttaggaagtccgggcagccccttccaggaccgagctgccttaagaatccagaatcagccaggcccaacaggatccttaatgacctctgacggtgggatggaggaggaccagaagagtgaggaattggtaggcacacctcaagagaaactcagaagtgggggtaggggagggtgttcctgaaacatgtccatgctccctacttatttcaagactcagttcgacatcgtgccccacttcaagacttcccagcttatttggaacactcagtctctctcctcacaaacacaaagtcttctgcttgattaggttggtgatgggtatatgacaatgacactagcaagctgctaaacatccttgactctttccaccaccatgcctttatgcatgacattttctcaccctggggtgcctaccttcattttgcctacctagtaaactatgaatgcttcaaagcctgcatcagttgtcatctccaccaggaccctcactctccaaactaatatagagaggagactgcctgttctctccccacccctctatatgcttctcttttcacactcacctgctgttttataattctcatttttaacatttggttcttccactgagttttgtattctttgagaatggggactccagcttactcttctctgtaaagtcagagtggccagctcagggcttgaattcaaggagtgatgttgctgaagctgtatagtcaagtggttggagcttcacagtgaaagagctgttctctattttttgcctccagcatgctttgcttatgtaagtcactcaacttctgaattgagaatctgagtttcttctgcaaaatgagaaaaataaaaccagtacctttactattgcaaaagcctacaaagaagataaatctgagagtgggttgttgggggaatgtgtcaaaaccctttagctcctgaaaaattccattagaaagtcaaggtgttggtattgcaattattatttgattcccaaatggtgagagtgcttccagaaatgtgctttgcttgatgaaccgatacatttttagcccccactgatgaatttgggaatcgaatacctgtcatcttgaaataattgacacatcttggtgaagcacttagattcctctgatgaaagtctggattcttactgaaaatgagaaggaagctgtgttacatgggagcaatattgttttatggacctttatcttagttattaacaaatgagtgttacatgtggaaatggtaaagggggaattcaataatgaagtttcataggattataatgattattagcctaatgatgatgaaatccaggtttcaatgcatgtggtttccttggcattcactgttctgtgccctttatgctgatgggcagcagcctggctgcatctgtccctaacatcccatcctgaagttatatgggaagtgggcataagtgtagtcggctcctctagcaaatctggattaggatatccatgcacaataatataattattattgtagtaattgttattgcaattagttgcccatatgtcatgcaaatagcaaaaaacttatattctagggagccgacacccactagaggtaggaagagttcgcatcagtgaatgctcactgcctgccctgctgctgagctgcccaagggtcctgtggaaaaagcagccaatctcaccagcatttacactctattcatttttctctgtgcaccagaagccactgtaaggatgaatttgcctttcagagcaggtctctgtagaatacccagcagccacatccatgcatcacgtttttacatctggtcaggaattcaggcaggcaggaactcagagggactgagagccagcatatgacatagaccatacttatttttttttctcttcctttagaggcaggaaaagtaggacaagatgccctaagtgagtagaaaagatattcatcttgtccctttcctaagcctctcgtctgaactcatgttgacttgaacatgtgactttttgagcctgagtacatatgcccatcgttacagaatgtccccacccccatagataacttaccatagtaaatagctggaaagggcatcagctgtgaagccagacagacctggtggtgaattatacctccatgacagagtagctgggaaatattgggcaaattgttttatctctgagcctcagtatcactgtcagtgaaatggaaatgctactatcttctcatatagtttcatcgaaaagaaatgttacgattacatttgtctgtaaggaacataaaaatgaaagataattgtgggttttaaaaatacagggttttttttctcatgtaaaataagtccgggttggatggcactccatggtgtgatgttggaaacccaggtgcattctacttcgttgctttgacattcttagcacacagttttcacctcatagttgaagatggctgcttgagttccaaccatcatgtctacttttcagccagcaaaaatgaggaaggatggaagaagagctaactttctcccagaagtcacataggatactacttctccttgtatccctagatcttagtgattcaagccaatactcatgcattatcaaagcttgatgggaatgtcccatatggtaggggaaaatgttgactttgaaaaatagaaaacattagcaaggtgatgacacattgtctatactcaacatattatcattttataatggaaaatattaactgctattaatacttttaattgagcagttatttcatgccagatattgtatcaaacatttatattttctatctcattcaatcatcaaaacaactctatgagacagggactaatttttacacacgaggaaactgaggcttaaaaaggttgtaggacttgctttccatggctctaagtagtagagtctgtaactgaagctggtactcctttctccaggaagttatgttggcatagttgatgtttaacataagtagttatacacaatagtttttgtttattccaggtaaatttacttggtataaaaatactccagccagtaagctatcaagtctctggagtcagcagcctgcattcaattcccaggtgtaccaccagcagtgggactttgaacaagctactggacttatttgagccttagttttttaatgtgcaaaattggaataattgtagcacttgtttcttggggctgttgtgagaataaaatgggattattctgagtaacatacctggcctgtgccacatgcttaaattcttattgttgctcttattaataaaacaattgttattaataccaacacaactttacaaccaattttaacacgtggtgggtagcttggcacatagaccttgccttggaagggtgaagtgagacacatcaggtgccgagggtaggagggcctggccatgcttctcataccagtctctcatttattaagaggcctttgctggcctgaccgtaaagcctgaaaggtgagagtgggcacaggagagcaggacccttcctgggcatgagagggagcaatgtcgtgttcacctgtccagctaggctcctgtcattccttcagctctgggttcgtgtcctgctgtttgctttggggaagtcctttctcaagttgctcagcagtgcctgctgctcctttgccccattcctccctctgagccttccctgagttcctcacctgctgctccttctctaggttcttcctgacgtgctgagccttcagttcaatggcttccctaagtgtgcattgagatctaagtgctaagtgtatccttaacacctctaatctctgctgcaagcttctcccctaattgtgtttcactgacaaacctgaaggcagttggtgatactgatgttcatccaggaaactgaaaataaggaggacatagtgcactctggaaattacctctcagcacctaggaataaatgatctcaggagagaatgtgactatccaacccttcgctgcctctgttgcagtgggaggcctcacccagatgatctgatttgcaacatccactggtccattcacatgatctccagggatccagtgcctatggctggctctgctcaggtgctcaaaaggagggtgtcctccctattccagaacctgcaagccccacttctctttccaaagtctgcatcagagttggtgaggtcctgagcaaaagtcgcaggtcagacaaaatgaattctgccaaatctctctgccttcagccttttggataaatctcatgcatatattctgccttgtcatagtaactcttacttggagaatcttttggaatgactataaccttatttcaatattggttattactcatggttgtttcactttttaagaattgactctagacttgcaaagtgctacatccactatcactgcaatttaggagctgagctctgactgaacaaacccccctggcaacattgtggcagagccagttagacctgactgattcctccatgaccttggacaggccactttcctctaaataatctgcttagggaggtccatgcccatgtctgcagtgccacactgggcagacaggcaaggacagggcagtgtagggggaagggtttctgccccttatctgtcaagacagctctgataatttaggctgagaatttcagcctcaaagcttttgctctgccattaaaagaagtaaaaattatttcttttgcttacttgtcccacttgaatgctgtgtaatatcattatagatttatgtgtttatgacttcgtgacctggggagaagctggaaattccactgagcccatttctactcctgggtttctgtaaaggtcacagcaaaattattttatcaagtacaccacagaaagggaaaatcttaatcttaaattatacatatgcagcacttgaccttctcttgagatgcagcacctcttagctacacttacttaaacagaatgcagctcttccctgatgcacacagagagaataattagatgcccttgcatcccagttggagaggaggctgtgcagtgggaccaactacaaagctgagaaggagaaagagttgaggcagttgggatgggggtgggggtgagctccacagagctgcagcaggctcatgcttatgatggggccatctgggcaggtggagcagacattggcaccatgacttgttctggttcacctgcacctctggccaagtcattgccttctctgggcctcatttttgccatcataggtctgtgatgtggcaattcaatcacaggtagtttgtgcctggaacattgtgttaaagtctcagcactctgctgtgggttgagtgggaatgagtgccgggattgattagcaatgtctgccacggcaggcatggagaggtagtgacagtatctgtgctgggtattggtggccccattctaaaaggtatttctaaggtcttttccagccctgtctgtctgtaatttgtgggctcaccaaactctggggtgaggaagcctggaaaggaaggaacaatagcaagcttccctaagagaagagttgtatttgcctcgtcagagtttggagagtaatgagatttgtgtgatacatctaaacacagttgcttgtgtgtgtgtgtttcctatttgctctgtgaaaagtagagagagcaagtgaaagcagtgcctgtcctcggtgtgaccactcagcagacctggctgacctatgtgtgccctcgtagccagcctgtgcgtctggggctctggaaaaagtgagaaactctgggtggcttcttgtcattgtccagcctttagatagaaacacagtgagaagtcatcttcatttatcttaagaacttggttataaattttttttaaacggaatccattaaggtctgtgtcagggaggaaagtgcttaaaaaataaggtttttctcaaaagaaaaacacttcggtttgaaaacgtgggaagcagcctgactgccagcatatgtcctgctcatcccctgcctggagctaccagattgatggtgtttttagaacactggcagccgggcactgagaagggtggagactgggccttgggaggggacagttggggattcccctgtccttgttgatgctgcagagacctaggcctagcacccaagaaggataaatgacctggggctctcagagtgaccaaagtgatgggaccctcccttctgttgggtgccaggggccccgtgaagcatctccctgttggttgagaatgaagtgcaaaggggatacctccctttaaggagtccatcttggctgctggtagggtgcttctgctctcttctaaagcacaggttcctccccgctgccctctagcatgggcttaccacttcctttacctccctgctctgccctctgagaactgatactgtttccctgtctcctgcttagctgtgacatcacatcttctcaaggagggcacagccctgactctggagtccaacaactttccctccctccctccctcccttccttccttccttctttccttctggcagagtctctctgtcaccctggctggagtgcagtggcacaatctcggctcactgcaacctccacttcccaggttcaagcgattctcctgcctcagcctcctgagtagctgggactacaggcatgcgccactactcctgactaattttttgtatttttagtagaaatgaagttttgacatgttgaccaggctgatctcgaactcctgggctcaagtgatcttcccgccttagcctcccaaagtcctgggattacaggcgggagccaccaaacctggcctggagtccaacatcttaagaattccacccccatttagctgcttgctgcctctgcattgggggctcctccagacccccttacacttctgattcctgcgtatctggaattcctcactccgtgtcaatggccttcttcttacccaatataaaggcagtgactagctgatatctatctcagagcacacagaaagtgctccccagatgtgtgttgagagaatgagagaatgtctataaaaggaaaagagctcatccttcaaaagagatttttagggtacactaacatgagtgaggaggtggagttggggacacagagacatgatggttcacagaaaggctggacttgactggggtccttctgtgccaactcccaggccactccccgcactccactgccctctctgccttgtcctgctgccagtggggcctcacttctcgccttcttgccacaccactcacactactcctacctactatttgaaaaaatcttccactatttgaaaaatcttttttagccagacacggtggcccacacctgtaatcccggcatttttggaggccaatatgggcagatcacttgaggtcaggagttcaagaccagcgtggccgacatgatgaaaccctgtctctactaaaaaatacaaaaataattagccaggcctggtggcacgtgcctgtagtcccaggtattcgggaagctgtggtgggagaatcacttgaaccctcaaggcagaggttgcagcaagctgagattacaccactgcactccaacctgggtaacagagtgagaccctgactcaaaaaaaaaaaaaaatcgttttccattcaaaaaagtataagttcactgcataaaaattggaaaatatagatcataaaagatttttaaaatgtgcataatctcatcactataagaaagtgaaatctttaagaacaatatttgttcccactatttgccaatatttttagatgtcactaaccacaggttttcaccatctttcttgatggggtcatgaatttccatttatggatgcactataatttattgatctgaccccttattttagggcttttaagctgtaattaattttttcttgctataaacaatattgccatgagtgccctcatagttaaatctttgagctatgtgtgattatttcatttgtataaattccatcaaaagaggagcttgagcaccattaggccatttgcctctctgggtcctacttctccatcaagccctgggaaagagggcaggccagcacacagcgacatcagccttgctggtgtctggctgctgtgaacctgctctgtcccactcccctccatgctgatcatttcaaggttgtaagagccttggagagtgaaggaccaggccctgccccttcccagtctctgcccactggtcccttacttccctgttagctgcattattgcctccttccccagagtccccccatgtccagtgtgtaggctccagaatgtcgggtgtctgtgggggcagatcgacatgtttatgctgtttctcctggggctgggccgtggacaggaggggcctgtcggctgcctcctccacaactcctcccatgtccttcccttgccattctattctgaggcaggcagggccaaggaataagttcagctgagcccctgcttcctgggtgacctaagaaaggcaagcaccttctccagcctcagtttccccctgtgtaaggaagtacagttgttcccagctaaaccttctccctcctgctttccctcttctctgctctctctgtcttcctcagtgctgcagcatcgtacctttcctgacccctctgttggcttaaagctaaggaaccagcccatggggctctcagcagctactggctgtccagttggcctgctatagaggagatgcaggtaatgctgcagcttcaggggcaggaatctctggtcagaggtctgttccctgtaccattccaaagtccagaaggctcttctggccactctgcagattcctgagtctgaagattggtttctctcccacatagacacaaatgttgttcctctagctttgtctgcaggccagcggtcaagggacagacttggggtgcagatgcagctgctgcaggaagagccaaatcagtcctagtctctgagtgagactctcaccttctctgctctggacacttcatactgccactcccaatattccccccaaagttatagggacagggagcccactgccaaagtattggatttctaaaagaggactccagaaagaggaaaatgtctagccctagaggatgaagtgtagagggcaggctttctggggtcagcaggacagcagggacacaagcggacaacaggttgcagtctttgactccttgcacccaaccccgtgcctggcatctagtaggggctcagtgcttatctgttgaatgaatgagcaatccccaatcaattgccagacacttctcttctagatagctcttgaatctatctacttctctctgttcccactaccctaatccattatcaccttttgtgggctgctgaatcttcctgtaaatgtccccactcctccagtccattcatttcccagcaaccagtgtgatcctttagaaacaaaatctgattctgtttcttcccaatttcaagcctatcaagtggcttccgtggacttcagggtaaagccatgggccgagtgggtgacatgagctcaggctgcccctccaagcgctcagcctcctcacttgcctatggatcccacccaccccacacaggaactgtgcctgagcctgagcactcagggcccctgaaggcactgtgctcaggtccttgactgagtcattttcattctccagggccttttcacaggctgctctctccacctggaagcttctctaccttctctcactaacttaccttacctctgcctgttatagggggcttatatcttctttatgccttcacttagatgtcgctttcccaaggctctcccagagtgggttaggtccctactgtggcccttctatgccacctcaatcccatccattggaatttccagctcaaagtctgtcttcctccaccaggatgtcaattccacgtggggaacatctttgtgtttttcctccattgatatatcacaatgcctagcacacctccaagtatattataggtggtcaataaatactttcaagtgaattgttgatgaaaacattcagcctggctccttgtggaaaacatcttgaggatatttattgaggagatactatattccaggaattttacatgtattacactgatcttcacaatagctatgggaaggaagtcaccttagcacccctttttacaaatggggggctgagggtcaaagtttaaataacttgcttaagatcacacagctagaacgtggaagtttttcagactccatgtttgcattcttccagatggcctagagcagtggtcctcagactagagctataccagaatcgcctggttggcttgataaaattcagattactgagtcacatctccagattttctggttcagtaggcctggaggaggatctgagattctgtgtttctatacgttcccaggtggcactgatgctatttgtcttagttcaagttgctgtaacaaatactgggtggcttaaacaacaaacatttatttctcacagttctgaatactaggaagtccaagatcaatgtgccagaagatccagggtctggtgagggcccacttcctggtttgcagatgaccatctgctcattgtacacttacagggcagaaagaaagctctctcgtatttcttcttattaggccattaatcccatttatgagggctccaccctcgtgacttaattactccacagagtcctcacctccaagtagtatcatattcggggccaggcacaatggctcatgcctgtagtgccagcactttgggaggccaaggggggcggatcacgaggtcgggagatcgagaccatcctggctaacacggtgaaaccccgtctctacttaaaaaacaaaagttagccaggtgtggtgacacatgcctgtagtcccagctactttggaggctgaggcaggagtatcgcttgaaccctggaggtggaggttgcagtgagctgagatcatgccactgcactccagcctgggccacagagcaagactctgtctacaaaaaaaaaaaaaaaaaaagaaaaaaaattacattcggaattaggcttcaacgtatgatttttttttctttgttttttttttttttttttttgaggggcaacttttagtccatagcactgctgatttggagaccaatttgagaacctggcctagatcactacaaaacacctgggcttgctttatggctatcctcactccctaatcactgaccttggaccaggattttaggatccaggcctggactctcttctgagagaaaccgatgcctagcacagcctcctacaaccagacaggaccctggctctgaaggtcttggctacgctctgggaacaggctgccatcaggacctcagtgtctgtccctctcccttgagacactgctcttctgtttgtcacccttcagtcctgaccagtgatctccccattttatcaaggaaaagcacccccaccctggcccacctctttaacaacttccatgcggatgcattctaggcttgctactgctactgctgtctgaacaacttaatagcacagtaagttacagtctcttctgtgtcatggtgcctgcagcattcatcaacttcagcaagtgtcatcatgagtgatacaagtgtatgacacagctaagtgtctcctctgcacaggccattacagctggcagcaggcccagggaggcaagaactggagactcatttggctccaagtgcccaggatgatgtagaagtaaatgcgctccagccctcctcccaccatggcccacatagatgcttcgtattcttggcaccttctacaactactctcaaagtttccccaggtaagctagggatggtcttggtgcaatcttttccctttgcctcatcctcccatcctccctctgtgccaacttttacacatcctttgaggccctgtgcacgaaccacctcctctaggcagccttccaacggcaacccactctccccttcctctaaagacctctgtcacagagcatctccacctctgctgtagaaattttattggtaaacacttcaccctgacctgctatgctcagctcagctccttggaattggaggttgtcattcatatttttgtgtcctctgcaagatttttaaatgtactggatgagaatttctttgattactaaagtcatgtatatgtaatacaaaacattgataaagtacagaaacataataataatgtcaccattcccagattttattttccattttgctgagtatgatatgtttgagtgtgtgtgtgtgtgtgtgtataaaatgaagttcatagtctcatactctatagttttagaccacacttttataatatttttccaagtcacaattttaactgctgtgcaatattccattatatgaatgttgcatgatttatttagtcaataccttatcatcagacttttaagttcctccctctccctttctctcttctttctttcttccctattataaataacactgtgatgaacatcaatgaacataaatcttttcccacacctgcttgctttttttttctagaataagtttttagaaataagatcgttgaatcaaagctttcaatattttgaagctcttaatacacatcaaataactctcccaggaaatgataagaatccacactttgaccgagcatgttggcttactccagtaatcccaacactttgggaagccgaggcggatggatcatttgtggtcaggtgctcagaacaagcctggccaacacggtaaaaccccgtctgtactaaaaatacaaaaattagttaggtggtagtggcgctttcctgtaatccctgctactcgggaggctgaggcaggagaattgcttgaccctgggaggcggaggttgcggtgagcagagatcacgccactgcactccagtctgggcaacagagtgagaccctgcctcaaaaaaaaaaaaaaaaaaaaaaaaaagggaatccacactttgtgtgggagtgctcattatctcacattctctaatattaatatcatatttgttgttgttattattatcatcacagcttttatcttttgtgtcttatcacagcagtccttcagtgaacactcactcaattagccgtagaatgtgtatgcctatgtgtaagtttgtgctaagcgctggggaaagggaaatacaaagatggcaacacctattatccatcttcagagagctttcaaactagtacattggatggatggatggatggatggacggatggatggatggatggatggatggaagaatggacagatggatgggtgcttgggaaatatttccttgccatcagttttctcaacacattgccatgaatataaggggaaatgggagctcccataaggctttgagtcccagtggaatgtcctggggctgttcaggaaaacccattctgggaaagcaaagactgcttttgagaatagacagaggaatcccagtgcagaaacctcatgccacttccttctagggagtttcaccaggcctgaaatttcagagctgggaacctatttgttcagccaccagtaatgtgaaagtaatggagacatttggccacagaagtgactttaaatagtggcccaatgtggggccacaggacctatggaaggagctatgcagagctgtttgcatgacccacaggaatttcttgcccaccaacaccacacctatcacacaattcttagcagctgctgagagaggcttttctgcctctcttacagaatgagaacaaagcgtaagataaaggaaggggaggttgtaggagcaatgaactctgggctgcgaacctccttcttcctggccagaagcatgtaccttgcctctctcccagttgccccatgaggcaggctgacttccctgagccagctgctgagctgcacctgccttgagaaaaaggcacccagttcttaagcaggggatgaatattcattggcatgaacctttgcaaactcatttggggaaaaaaatagatcagaagaagtaatcagattattaaaaagaaagagcaaggacagaaggtggcagtggagggaagaatcacatttaaaatgcaaggagagacttcctccctgcggtgtagctctgaccccctagaccatgcgctgagaatagttaagctctcccacatttatgctgcataaaaatgttgtttttgaggcctcatctgagagggggaagggcagaggtaacacgcaccctccacatctgaaaattataaaataatattttgaggtctccattttatcttcctttgatatcaagaaaaattgtgagagctaaagaggctctggtgagtgctgagtgacaggttaaagggctccaataaagattagatggtccactatctcctgaggaaattgcataaaagtggttattccctcttgcttctattaatttcctcttcctggctgcttggaaatgctttgtaacctgatgctgcagatggggatgagaagcgctttccattatctcaatcactgcactgtttatgagacacttaatctgtttctttataaagtaatagtactgtgggtgatggactcagtgtcactggaagtctgtgtgcagggacaggaggagaggagtgtctcgagagtatggtaagcagaaggtcatttgtcatatcactgaggtgctgagaagttgggtgggtgtttcaaggtgaccttctggataccagccagaggtgacatgcacctatcccttggcacttgaacagggaggcaaatgtgtgttttgtctgttgaatggaaaatatatacacgtttaggcatggggtgctcagatcttgtctcctccccttttctgaagttgggggtggggaaagagatgtgtggtgaggtcggggagaggggtgccatcaaaaagcctcggctatgcaagtttctaggccttctgtctgaactgcaatcacttacaatggaggaaagggaacccctttctcttaaggaaacaaggcaattgtaggctgcactggtgttagaaatgtccagccctccaagttaccttgtcccattgacaaaggtcttaatgcgaatacacagcaaggtgtcggcggctcttctctttctacccacctcctggaaatgtaatggaactctcccctgcaaagtccaaagctgggcactttatgacccaatttccgttcctacttctcctgttcttccacctcttttcttctccctttgtcttttcctcttcttctgaatttcatctcctaaccatcacagtaaactgtttaatcaccattgccaagaaatgacacttttttttttttaatgcgacacagtctcactctgtcacccaggctggagtgcagtggcgcgatcttggctcactgcaacctctgcgtcctgggttcaagcgattctcctgcctcagcatcctgagtagctgggattacaggcacatgccatgacgcccagctaatttttttttttttgtatttttagtagagacagggtttcaccatgttggccaggctggtctcaaacttctgatctcaggtgatccacccgcctcggcctcccaaagtgttgggattacaagtgtaagccaccacgcctggcctgaagtgacacttttaaccattgtttaaagcatgaattctatgagaaagtatagcataagtgtggttacaaattacaagctaaaaggttaataaatgaactcaggaatactacttcttttataaagtttcttgtgactctcatcttataaggagactctgcaaaaggtgtacatccatccacctggtcccctgtgtgcacacaagcatagcacagatcctgctgtatcagaagcagcattccattgtccacctccctcaccaggaagggagcttcctaatgttggctaccccatctgcaccctgctctattcccctagcctggtgcctggctagaagtcaatccacaataaatatttgttgaatgaggggctcccaactgcagcagtagtgctgaccgtaattctgtaaaggaactcctgagttttgaaatgatacgaaagcagagaactctgttatttaccttaagttgcctgaaagtgctgaaatgtgtttggttaggctaccgctgtatttaattattattgtttaaaattgtacagtctttatgcaggtgagcagtctccaggctgccagggtctccaccactctgcactgtgtgactcccggctgctttatattctcaagtgactgacctggctccaaaggccatttgcttttgcttctcatggcctgaatattcttcatcagaagccacccagaagctttatttatcaccccaagttaaagctgctttttctcaagtgacagcatagttttcttatttatttttctatgttaaatttctagtgaaaaaatattgttaacttttgtttctgattaatggcacctgatacaagataagttaaaagggctttgtggattagcctggcactttcacccttgttttaagcatgaattctatgagaaagtatagcacaacaatgtaaaagtttaataaattactgagcatatacccaaaagattataaatcattctactataaagacacatgcacacgtatgtttattgtagcactatttacaatagcaaagacttggaaccaacccaaatgcccatcaatgatagactggataaagaaaagtggcacatatacaccatggaataccttgcagccataaaaagaatgagttcatgccctttgcagggacatggatgaagctggaaaccatcattctcagcaaactaacacagaaacagaaaaccaaacaacatatgttctcactcataagtaggagttgaacaatgagaacacatggacacagggaggggaacatcacaccctggggcctgttggggggtgggggcaaggggaaggatagcattaggacaaatacctaatgcatgcagggcttaaaacctagatgatgggttgataggtgcagcaaaccacaatggcacatgtatccctatgtaacaaacctgcacgttctgcacatgtatcccacaacttaaagtaaaaaaaagaaaaaagaaaaaaaaatctttaataaatgaatttaggaatgctgcttcttatataaattaaggcatgcctagacagattttatgaaagtattaagttataaagtctgagtattaaggagattcatacattttgtaattatatgtaaaatatattttgtagatatgattcacccattatacataacagaaataatatatgtagaaacacattcttccattgggttccaggatttatttgcccactttgggacttgaaatttatattctgaccctgaattctaaaagtccctgcaaagaaaccttgcttttgttttttaaaggagtgggtaagttgggatggagaggagttagcattatttagcacacattgatgctagcgacatttcatatttgagtttattaatttctaataatctgtgggagttattgtgagaaatttacagttctttttcatacaccttttatgcagatgagcaaattgaggctctgagggatgatataacttgccagtgttcaccaagctaggagctggcagagccaagaattgaactcaggactgtctgaccatttccaaatgcttgtttctccggggagaatggaatcagaccccctcctggaacctctctcttcaaccactccccaagcttctctccctgatgtccagcttggacctcctcccctccacttcctcctctcatggacaccttggaattcagagactcagtcacccagagctactgtcctccatcagaaacctcagaggaggcactttccacatccccctgccacttgtggatatcaggacaattgtttatgctgttaacttattaaatgtaaagtgaggaggcttttacgtgctggaaagaaagggaaaacaccttgttcttgttggactggtacattaagaaaattacagcatggcaggggccaaatatgaatgcttgagtcatcacctctacccctcccccactctccagagacagagctcctgccgagtccaggcagcacaggcctgggatttgtctgtattcactggctgcagaactgaatggggccaggaaggctggggatttattaggaaaagagccaagtgtttctcacaggagatgaggagagatatggaaagaagaaaaggaaagagggagaaatacagagagagggaccgtaatgagtgggctgggaaagatggattagtaagccagagtctcctcggatacttttgccattcagagcttctccctttcatgtttgatgtgttagatctttaataaagactcaaacagtactttttttctttctacagagaagtttcttctgaatgtgctgagatgagtcaggaagtggtccctttttacatggttcgcaactgacattgtttccccaaacctgggaaacaacattcactccagtgtcttccccgatcccaggggatgctctgcaaagtaaggcttcttggtgaaaaaacatagcattttaaaaagttttaaaagttctcaacaaagaataagatgaacttttaaaatcagcatttcaaaatatctggccacagtacccttttgtcataggtgttaacaatccaaagaacgtggatcccatgggacacatttgggttgtgccattccagaacattgtgttttggagattccttcctgtccaaaatggcaccccacccagcacatgtctggagaaactgaaaccttttcctcaccttaagtgatcaatggagtgagataactttcacagcataggaaacaattctttcttcttgtcttagcagaaaagcagtggatatttttcaaatagtttatgcgtacatcatcactatcatttctcccactgtgtgatccttggtaacttttgtaacctctccgtgtcccagtttcctcattagcaaaatggagatagtaatagctaccccatagagtaatgcatggaaagcacttaacaagacaagttaacagatggtggctactgctattattaaagaatatgctgcactttccaggagggaacaatacatttgagattagctttctataagtagaaaccattataatggcacttcaattatatgatgatcacattgtattagatttatatgacttcattggatcaagagctccttgaaggcaggctctattcttgaattccctatgtcatgttttcagcaggaacagtaaatgtttgttgaatgaagtaatgaggtgtgtaagaaagccaaacaagttgaccagtcagtaggttttacccagtctcaaaggaggatgagccagagtaggtttcatggggacaggaagagtgggggctgagataataaggaagggccttggggaagtagggtaggcagaatcaatcttgtgagggatcaacaaggaagagaccagatgtctgggctcaaaagtctttacagatgagacaaagttaagacccgagggatagcttggagccagacttttcagagaatgactcattataggctgatcccacaggaaattaagaggatgtgctgcacatatgagggcccctccagtggagatcaggtagtatcaggtgttcccaaccttccccactgccatgtgcatgatagatgacaccaagtgtgtgacacgttccctggtgtgctgtctgcaaagtcatcctttccttgccccacccccggaagcatatcaaaatgcaattaaaggagaatgatgttgttaaggcattaaccttgaaatcaccctaatttagttttaaagaatcacttatgaatttcagccctttgccatcattcatagcaagagcttgttaatacatctcatagtgtgttcctcatgtgtgctgcaacatggcattgaaaaaccgtgggtccaacatgtcattgaaaaacctgggacccctttctaactgaggccataggatgagatgtctttagtgagtggctcagggaaaggccatggatgttaaccaggtagacagaagagggagtaaccatttatagagcacttatgtcccaggaactgagctacactttagatttgttttctcaattaaatctcttgacacacctggaagggaagaattattatccattttgttcaagtgagagaggtcattggtaccaagaagatatatttcacaaaggatttttgaagaattggaagtgttaaatatgggtttcctcaaccttagatctcccttggtacgagaggggcatctcaatgttctttttagagaggaagacactccttttccggttgtagggaagagtttctggctgccacacttccattaattatcacatggtctctttgtgttctagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagtaagtgtctagtaatggctctgggctggggagtttggttccctgatggtgcaagtggtgggtctggggcaaggaagagaagacatcatcctttgatcccagggcaaagcagaattgctggccatggtgctgaaacatacaactcctatgctcggagttcagaggccttgtccctacgtagcactgggtgaagattacattttttctttcttcccccttcttcccatataagaggaccttctcccaccccagcaagataacttctgttcatcagatgtcagactggagagttctttggatgcaaaatcatgatctattatcacttcctccaagaagtccctcctggtgcctatagctgagaatctcctatctctttgctgggtttcctgtatatttgtaaccagactcccctcagagtgctcatcattttattaattgttcagtcattctgtacttatctcagttaccaaatgaagactattgtgtgccaggaccatatattcatcttcttgtgtcccttcaaatgcccagcctgatgtagcatttgtgctcctgtcaaatgacaagaccagtggcctgaccacagaatgcatctccaaggcagaaattctagggaccggagctaatgcattggctacatcactctcccattatataatatagagggaagagcagtctccctgccaaaaacggggaaaggcagctacactctctggatagggatgtgagaaggggtgcatttctcccaatattctccccaataattgtggaaggaggcaatcactactgtccctgcacagtactttggataatttgctcctactcctctgagcattgtagccctgaaatgtggatgacctctcttttaagtatcccattgtatttgggagtcagtgctccaggttagcctctaatgtgttagaattttcttcttcattggataatgcttcctggctccctgtgagcagggacctttctttacacctgcttggaccaaatcccttccatccatccccatcacagaagaatatttcatttatactttctgtttgatgaacagaaaaagtgactggactcttagtagaagaattacttaattccagccttgtagtgtatgtaacctttactgagtaaagagggggaatgaaagtaccttctagatcaagttcctgagttcaatcaatgtgtatagatttgaactgaggaaaagctcatcctgttgtaaactgattttctacagacctctctctctgtgggttaatattaacaaaaatgattgtttctgctgaccagaagtcctgtttttctgttgtgctatctcctccactgatttctgaggttgccctgggggtcttcaataagcccaaaaagcattgtttaatgtacttctttagaaatcacttaaggatgctgaatcactgctccctggatgttcagaccaaagactagtctccatgattgccgaagtatatgcccagggactcacagtattcctcctgaaaacgctcctttccattccttctcattaacccctcaggtgcacctggaagtctggaggggcctcaggtttagtgtgcagccgttgactttaaatggattatatcagtagtcacattcattcactggcagtattggaaagtttataaagagttttagaaatttaaaatgtgtcatttgacaaggctataaaacatatagtgcactaagaattaatatttttaatgaatcctgttaatctcttggggctggcacacatgtagtcattgtatttttgtagtgctacaagtgttaatttatttcatgtaaacatttgcaatgcatgttaccttttgcagccctgtttaggcatttgtttcttttatttttaatctactgggagacccagggacccctccacccttgacctctgagatgcctctgtgtgtccagccttgtccttgaattttgtcagtggactgcacagggatgcaggtgcacctcaaggtgtcaaaggggctggtgtggtctccaaatgaagtcagaggagggtggcttagagagctctgtgttttgagtctgcagtcacatcactgctgctggtctctggacgactagctcccttcttccttcttttctctccccccttcacttctacccaggcctgcagctctagatcttcccagtacttgctcatatccaagaagatgcctcttccctcaaacctaggccaggtatggaatgaggtgggagcttaggggatagctagaggcaggtgacaagtgactcctcaccactccctgctcacgaaactccctgaataaagacagactaccaggacagtgggaatcaccttcagtgaggagttactgaagggctactgacagtaaggggagggggtcatatgaaaagacaatgggagggaacaaggggaaggtgcagccccaccagcagggaggggttgcgaaggttatggactgaggaaccagctctgagctttgggcttgctgtgcttctgctgaaaaagccgctgccttcctccctgtagtgctccctgaggcactgcccagaagccctcagtttacctggtgaatcctggcatccccaaactgcctcagtcttgagtgggttctgggaaagctcatagaatcattgatttcatttagtgggtggaagatgggctttggcacttcagagacaaaagtttcaaacttgattctgtctcttgccttctctgtgaccttggtctaaatccttggtctaagctttcttacattctgtcattttattctcacgacttcataataatgtatgcttttctgagttattatgaggattcagccaaatagtattgtagagtccttggcacagtgcctggttcatagtaaactctcaatcgatgttagaacttgctttggttacatccctggaaagtgtgaagattgcagcagatattgaagcttccagcatgagaggatgttggatatctgaaaataaaagtgatgttgttgggggagcccaggcttgacgccatcaccgagcatcacagcagaatccatgatatggtcccaaaccacacagtcgccttggcctaaagaacctgctgaaaacaaatgagaaggtgactgccctaccctgcgacctggtgtgcagtgggagaaggaaggaggcacaggcagagcttctgagaagctgccgagctcgctgtccctggatgagaggtgccaagaagctgggcaggagcaatggctcacaatactggctttcaattcccaggcagcagcggcctagcagctcctcacactgagacacacttccttccacaggagggccagatggcaagggagacatggtggggtcagccgggcagagggacagccaggaacacactcggaggtgaacagcaatgtgaaaccccgcaccatgttgcagggcttggcttctgttttaaataatttctagtttactgggggacgaaatggaaaggaggaatttatgaagcaggtgaaaacagataattatgccttataaaattgctgcctgtgaaaaactatacagaaggactggtgtgaaaataattaccttgttacattgctgaccacaaaaaccccttttctgtcactcacatggaagaaattttgatggatcacagaggcaagctagtgcttgccttgtttcttttatttcttcttcaaatgcaatgggcttccctctgcagttttgatcatagaaatggaatgaaaaaggggtcattgtgtcccttgagcccaccagccgaccccttagatgagggacacagtgcctgccagtctttcggggtttccctggaggccatccctgtcctccctcctgactgccactgagaggcagggaagcttagtggcaggggcaggggttttgagtttggctcctgacggtaagacctggggcaagttacttagccttttggaacacgagcttccttctggataaaattgggtatgctggaactcaaattacgaggttgtgagaattaaaagccagcaagcaaatgaagctccaggatgaaaactcaggtctgtctgactctaattccatgacctcagtgatgttgcaaaccatcgtggcgatgatggtgattggctgttattctcactcatgaatctaccttgcttagagaaggataagaatctgctcttccttctcccattcctgcatagtctggtttctctcctttaagttcatgtttcatcttttaaggtgctggcagttgtttccctcttttatcccaggcacgacagggcagtggtggggtgggggggtggtgtccctgtggcataaggatcatgtcccttggacagactgcccaggagtgggacattcccagggcctagaccctgatcttcccagggaagcagggtggatggagaagagtgcatagggtttagagggtagaaatggctttggtatgacagaaacagaatgacgtcctctgcaggtggcctctgcagccaggtttggtggccatagagcattgtgggtctgtaaggacatgagcttataagccctctggtcttgggcacaggatctgctgcatcatgctcaataagatccccactgatggtttcctttaggtcagtggttttaaaatgcagtccctggacaagcagcctccgtgtcacctaggaacttactaaaattaaaaattctcagccccaacccggagccactgaatgagaagctctggaggtggagcccagtgatcagagttttaacaagccctgcaagtaactctgaaggctgtgaaagtttggaaacattgctttagagttgggtcatattcctctgtcctttgctttatgacttctgaggagaaaggccattgggtgaattctcacagactggaaccacagggccttcccctccccatcaatgtcctgtgtgccaggctagaaagctgcagggaggggggctgtgaatatgtatgtgagagagaggaggggtggggtctgatgtgagtgtgaatgtacgagcgcatctgtgtttatttgagtggttcaagggagggtctcactacttctcagaataatccccacctgttctggctcaatttctatttcattttcactctttttttttgagatggagtctcactctgtcacccaggctggactgcagtggcgtgatctcagctcgctgcaacctccacctcccaggttcaagcgattctcctgcctcagcctcccgagtagctgggattacaggtgctcgccaccagacccggctaatttttgtatttttagtagagatggggtttcaccatgttggtcaggctggtctcgaactcctgaccttgtgatctgcccgcctcagcctcccaaagtgctgggattataggcgtgagccaccgcgcccagcccattttcactcttgagtggtcagagcagtgtgaagacctgcaaaggacatcgttagctggggctgggagcagtgaccagggagagaagcgaatggaaaccaggaagcacaacgtggctggagtgagctcagcgggggctgaaggagaaactgaaacagaaggaaagtgactgatgggcaccatttgcctgaattcagatagaggatccagagggtagccagtgtaaatgggtgatgggccccagctcacctaggaggaaatcagaccaagaggaaaactctgaggctgctgctgcagggaggagctcttcaggccaatagggcaataagcattccacatgagacaggaatctagtgttgtaaattggggactgcttgcttgtctgcatgtctacacaatgagggtgatttttttttaattttattattattatactttaagttttagggtacatgtgcacaacgtgcaggtttgttacatatacatgtgccatgttggtctgctgcacccattaacttgtcatttagcattaggtatatctcctaatgctatccctcccccctccccccaccccacaacagtccccagtgtgtgatattccccttcctgtgtccatgtgttctcactgttcaattccgacctctgagtgaggacatgcggtgtttggttttttgtccttgtgatagtttgctgagaatgatggtttccagtttcatccatgtccctacaaaggacatgaactcatcattttttacggctgcatagtattccatggtgtatatgtgccacattttcttaatccagtctatcattgatggacatttgggttggttccaagtctttgctattgtgaattttaaacagttttcaaaagtcgaccttttgacaagtgtttacttgggttaatctagggcttgcaaaatggtaaaagaaggctgctttgctccagctgagctttacccatcgctgaccagggctttagtgtaagtcaccctgtgtgttctatttgataggtaaagagactgatattaccccgatatgtaatccatgttgcccgttaaaaaatacatttgtgtttttgaaggggaggtagtctgtgttctccttgaggtgaacttcagacaaaggtcaaagatcaataagagtcagagggcaggcctagatttgggtccccgccccatgctggcccccgccccatgctggtagatggtctatacatctggatgcaaaagaaaggagtgtgactgcaagctggaagctatctataactgtcactgccacatcaggaagggtcagcgttgcctgtgtaaatgtgctttcacacttctgtaatctacaatttcttttcatagttgtttgacccaagtgagtataacctttttgaggaattgtatagctctaagttttaagctaaaagccaggcacacaagctaacatgtttgtttcagaatttcacaagagcatttggagtcacagattgttgacactctgagcactgccaccccaaatcctcccaatgttagccttctccctccagtaaccccgagaggcagaggcggtcatgccacttttattgttctgagcatttgtcatgacagctcgtgtcttgtgcagggcagcgtcactccattgccaacagcagtaacccatcgctgggggagaggccttctggacttcagattaggcactccttcctcactcctggccattggtcggtccttaaggaccaatgctcagcaggccagtgattttaatgcttaaggacaatgttcccatctttttaaaattatctccttgaggctaaacacttgttgctttaactgttccccaaatctcctgacccatgcccctgcccctctgccatttgtccaggctcctggctggccttttctgaatctctcacatttatcgataaggctcttaaaatatagcagccagaatgagacttgtgatcctcactccagagcaaggttcagtagaaaagtcatggattttccttgtgattgggatattgcaaccttgtgttcactttggttgcagtcactgaaactgtgagctcccaccacatgtggcagccactaaacagccagtgcttttgtttgtcccctcaggaaatgctgtctgtttgggtctcccctatgtgcacttatcagtacgatttcagacattttaccttgtggatttaggcacagtgcactttcacgtacagatcattttaaatactgatttttatcatctttcaaataagcagtgttagtataattgctaagagtgtgggctctggagcctgtgcccaggttcaagtcctgctctactactgaacagtgatgtggggcaagtgacaaagcttttctgtcttcatttcctattccataaaatggggataatattggaatctgcctcactgcactgttgtgggaattaaatgcaatatactatttaggttgggcacagtggctcacacctgtaatcccagcactttgggaggccaaggcaggcaaatcatgaggtcaggagttcgagaccagcctggccaatatggtgaaaccctgtctctactaaaaaaaaaaaaaaaaaaaaaaaaaaaaaaaatccaaaaattagccgggcgtggtggcatgttcctgtagtcccagctactcggaggctgaggcagaagaattgcttgaacctgggaggcagaggttgcagtgagccaagatcgtgtcactgcactccagcctggatgatagagcaagactctgtctcagatagataaataaataaataaataaataaataaataaataaataaataaaacaatatttggcatacaggaataattcaataaaagtaagctatttgattttattactattatcagagttgtctaccctactttgatgtaattttcaaagcagctaaaatccaagcacaggcactattatttagttaacatttcttccttcaatatacaagtatttgtatacttttagaagttactcttgtggaaatctaggtttactctatactctatactctttttcttcacaggctaataaatttttagagaaagaaagaatgttgactggcctgacttacacatagagaacacacacaagttcttgtcggtccttccttgaggctcacaaagcactgatttacttgtgaagttccagaaggaggggattaacgtgaagtgcatccatgtaatctactcccttctctattttaaaactcagaacaaagctgtcctctccatgactttagggtcccctcttgccaggaatgctcctttgtggtctcaggcaattgtcttggtgtcaaatttataggttctggtccaaggcagaactggcctggaatggatgccggaacttaattgttgccacagctcagcttcttcaatattctctgctccaattgttcacctctaaggcgaaggcagtcaggagtgagtggctgtgcgtcctctgtcctctgccagcctctcacctcctcccccaggcaggaggaggccttgctttgcgcaccctgagcattctcagctattcagagctattctggtaccagaatcatgcctgttcactggactggaagctctttgacgtgctgatttgattttttttttcttttaaatctgcttcatgaccttacagagcaggtgtgtccgatgcagtcaagtggtaagagccctactgtggaatcaggtaaaccagggttgactctcagctccactccttcctcacagtgtggccttgggtaggtcgcctaacttatctgaatctctatttttatgtcccccagaatgaggatattgtttattattgtgtccattgtgaattgtatgtaaaatgcctaactcagtgttagacacatgcacagtgctcaataaattgttgtctttgtttgggtttttatgaatcatgtttaagaagtgggttttgagtctctaagatatgcaattaaaaataagaaaacatggccaggcgcagtggctcacgcctgtaatcccaggactttgggaggccgaggcgggtggatcacgaggtcaagagattgagaccatcctggccaacatggtgaaaccccgtctctactaaaaatagaaaaattagccaggcatggtggcacacacctgtagtcccagctactcaggaggctgaggcaggataatcgcttgaacccaggaggcaaaggttacattgagccgagatcgtgccactgcactccaacctgggcaacagagcgagactctgtctcaaaacaaaaacaaaaacaaaaaaacattaaaagtataagtgcaaaggcttttagatcaaattctcctggagagccatcctaggttagctaaattctgaccccatcactcccctgtctctaccccatcacaatgtgattacaaatctgtgtacaacctgtgctaccatcttggtccctagcttctcacaggtggtccccagatggccttttggtcccctttgtcttccctcttccatccatgataatggcaccagatcctgatttcatttggccagagaccaagcccaaatttcacagtgggatctgagctgtgtctcactcctagacctcttgccagtgcctcgtggtggtcacttttcagagtcaccactgccagtcagtcctggaacctgtattgatccactggaccctctgttgatgaccactgacattgtcccaaagccaggttcagaatctaccctgaatcccattgcactggtgggcccctgtctgtacacccacctttcgtcagtatgcttctcaaagtctgtccctacatctgagcttgcagccttctaccctctccaaggaccagtatatttcctgacatgtcttggagactacctatactctccttcattctccaagtctccagctgccatattggaaatctggtaccagccaacctttcccaaaccaggaccatgactttccagattccctggtttggtaatacatgtggatgtcgcatggatgctaaagccagacccacacacatcactgatggcttcacttgggtgtgacaaagaccagggatcccagtgtctttgactctgatcaggtatttagagggaagccactttccacttggcataaaggtagattctgagtgatatccacaaagagcagaggctgcctggctagggatctctccataactggaagtgtacaaaaaggttctggtgatgcctgccaagagggtttctgaataatgtatgaagttaggtaaagtggacaggaatgagtcttatagtcagtatgagcaagtccatgctttctggattatgtgtgccatagtatgtgaaagccagcattttgtagtgatttattttgaaactgtgtgtttgctttttctgagaagctttccccacaattggctggaaaattccaagtctgagccagacacctgagaactgctatgatatgggattggctgtgggcttaaaatctggactttccaatgtataaataatcactgatgattttgaagacacagagcagtctgcagtctgaagtcaacctatagaaggcttatgattccctctaccctgtgccagagactacctccaccccattaaataaaaagtgttctggctctgaagccacatcaagaagggtggcttgtcttcaagaggctgaaggatagagaactagaggctagttgaacactaaggtcaatctgtccccccttcccattctggagactagtaggttgtggcaatggtactaataggaatggtgtgctggcccctccttggctgtgtcttagacttgcaggagatgcccaaggtggccttttaagcaactcctctgagtcacctcagaggtttgcctttccaggcttaccttggaaatggcaatgaagggtgctcagttgtgcaggttggagtgaacttgcatggcagctgtgtagtgagatgaagccaggtgcaggctgtctcttctggggcagaggtgcccagaaggtgagggctggggtggggtggggggcaatggtcagtgggaacccatggtcactgccatgccctgccagtactccatgagcaataatggaaagccactcagttctcacaaagagattgtcatctactggtcagcaaaggggaactgagcaccaggtaagaattggctctccctgtaagtgaaaggcaggctttgtgcccacacccggggacagggtctgcatgaggctccatgaggtcagccgtgcccatacccacacccgtctgcacaggtcaggttgtgaagcaccaagtcttcggagacagagaccatacaccattaccatgctgtgtgccatggtgctccactactcagtgatagctgattggaataagaacacatgtgcatacctctaacactaataactggcatttattaaagtgttgctacagtttaggccctgtgctaagcctctgacatggtttttctcagttaacctcagagattataagacaggtattacaactggttccaatttatagatgaaggatttgaggcccagaagggctaaatgacttgcccaagtttccaccttattgagcagcaaagcccgtatttccttctacgcctgacaaggttcaggtctccagctcttcaccctcagtgctagtctacttccctcgggaaggaggaggactattgcctctgatgtgacctggcacaaaattaatggtagaatcccagctaagatggggaaggatcacattttgttgattagaactagttatgtgctctccatgcaaggcggctgggaaaggtgtcttctgtgagacttgagaagagaacagaattgcacagggaggccctagcaacccctaccgagtatacagttccccatgggtgagtgtttgggcccattcagtgtttcattaatataaacaataatactgccacaaaaatgcatatccctatatttgtggaggaaattcacctagaaatagaattgctgggctacggggtgcatgcacttagaaccaatcaatattacaaagtgtttcccagaggccttggccagtgtacactcttcacagcagtgtgcatcaggcttctccacacactggcctgatgatgctatcaagacttttattttttgccaagttggctgacctcctagtcattttgattagtatttctctgattataaatgagtgtgtattttttatatgtttattgaccaatttagtcttctgggaattgtctgtttataacccttgcctttttctatatttaaaaattgatttctagatgacaattaattatatgtgacaccctgccctccagccctccatttatttttaactctgtggatacttgttttgtcatattgaggttttaaatttttgaactcaaatctgaccatctttttctttctggtttggagattggtgtcttgagcttttgactacattttatatatgtccttcccactctaaggcatgaaaacactctcttatactttctttcattttctttttctttcttttttttgttttcttgagtcagagtctcgctgtgttgcccaggctggggtgcagtggggcaatctaggttcactgcaacctccacctcccgggttcaagcaattctcccacctcagcctcctgagtagctgggctacaggtacgcatcaccatgcctggctaatttttgtatttttagtagaggtggggttttgccatgttggccagaccggtctcaaactcctagactcaagtgatccccctgtcttggcctcccaaagtgctgtagttacaggcgtgagccaccaagactgggcttttatactttcttttaattctctgtatggtgtttatgtttagttccttcttccatctggaactttattttgcataggatgtgatatcagtattcttttttatcttattaaaaataacatcccatgagctccacctgaattgtccacattttggtgagatgtttcttttattatatactaactgtttgtgtatgtttgtctttattctttctaattggtggttctgtctgttctggcaccagttctaaactgttctaaagatggtagctttctgatatgtctcaatgactggtgaactaagtctctgtatattattcattctcaaaaatagctatcccattcttaaacattgttttcttcaagatgaatcttacaaccagcttgacaaatgtcattaaacaatcctgtttaatcagggttggaattgcattggatatatagattactttggggatgattctcttctttatgatattctttattccatccaggcatgaggtattcaagtcttcttttacgttcttcggtaaagttttgtagtcatcttcacagaggtcttgtgagatttaatcctaggtattttatggttttgtggctattgtgaataaataattttttattatattttcaaacaggttatgattattaacagatgacagtgtagtggtgggaatagtgagctttcttctgctgggcatcttgtgttagtggacatctaacagaggctggccaacagggagggactgtagagggtgtttgtcaccagagatacactgaccaccaaggtttcattgcatgccgtgaattactgtgtctatgaaatgtcaaaatcaggactttctcttgggtgacctataacaccctggaaagtatacttacctttttcaatttcttttttgttctcttgaccttgaattgttgtcttaggaacgagggccttttctggatacctggagagaggcagcacatgtctcttttacagctgcgtaagccagtgcctggaagttatccatgaatatttaacccacagtcacttcccagctgttatcttgatgccagtctgatctgcggtctctagaaaaagatggaaaattatgacaactagaaaaaattgtgtcatctaggaagggggctcttaatcatttttgatggactgtggagatgcaggactcctccccgggcatccccatctctcaggaatggtggagagataggacttctgaccatacagtagcccagaggttccatcctatctgcatgcagcagggactcctccagtctggtccaggtggttgtcttcttgtaaaagaaacaccttagaagtcccatacccttccctcatcagtgcctagtatccaaaagttcagcagagtatgtgttgtgtggaactagccaggttctgcactcctgagagtggcttgcgaggagctgagatcctttacctgcaaggctttcatcgtatgtgacctccatgcctgatggactttggcccagtggctaccaaccagatctccagatgcaaagcaaattcctatccagatctgaatctccacacttgcatctgcatggagagaattactgagctctgggctgtatcaggatatgctaaatcaaacgagtagttttgggtggttcagggcctgagtgcatcaattagaaataatgtccagaacaaggaactctgtagaagttctgtcctgtaagacctattcctctgttgtgccaaagactgaagtgtgtgtcaatgtcttttcacttcaagaagactctaaccggcttgcttggactgttgcctccagtgacagcaaatgccttggagcctgtcctggcaggatgtggcctggtatggtgatctttcagcaggaagtgctctggggattcttcctctgagacactagatcagaggtgctgtgagcagggcttggcacaaggaccctacctaaaggcctgggagaacctatacaggaggtctgcttggggtctcaggggccctaggcaaggagatgtttttcctgcttcacagggccttcaggtcaagtgttctgcacaaagtctttttttttttttaattgtacaggtgtgcacttggtccctgtttcccttctagaaagtgaatagatggaaagggactcccagataactataccaggcagtcccttatgcatatgaagtacactaaggatcacagaatgctttaacctatgttatgccatttgattctcccataaagagggcagtgttccctccaagttcccatagcacaatgcctggccatctccaggctcagggggatagatctccactagctttgtcagtcagtggtttgtgtggctgttgtgcaggtgcctgtctcctttgcagaccttcagcttctcagggtagacatcggtgaacttttcataaacccacatacacagcacagcacacaggagggtctcaataaacacagatggattgatctgtcaaggatcaatgaatgattaggctgagagaagataagtgactgcttaaggtcacactttggcaaggctaagactcagccccagttttttctttgagtccagtgcatctttcctcactgtagaaagcttttgatgctgcatttcaggggtatgaaaggggtcttgaaagccatgtctttaagatgacatgacctatagttcttgacttggagcatttccaggggattttcaggggtggcagcatattgtacctttccactctttggccccaccttgagccacagctagaagattcaaccttctatccatctcccgcatggatagtaacctgagactagtcataaatacctccctactgaggtgcactgcctcccaggatccaggggcctcagccattctctaagggcttctgcagcctcaaggaaacctagactctcagacttgagctcaggctaggtagaggggctgtctcttttcccagaatgtataatctacttcctttcttccagacaattggctccattgaagcaggagaaacaataagtactttctacaaacactggttttggtaaaatgtgtagcactaggctctttgatgctcctgaaatccctctcagcagggtccctccttgttttgactaatcatttcttcttattactaactgttatgattaggagaattgcctgagtacaggcccagtgtttccaagaccctaatgagcaacacgtgcagactcgcttagcatagtcctggaatcatggttgttctgtttcctcagggaagctgctgagatgcctcagggacaggagctttttcctgcctctgtgaaatctttccccagcccccagaaaatgctttgcatcacagctgtgttgtacagcattaggtgcctctaccccaggtggaagagttgttaaggatgagatttggaacctgccagccctgcactcaagtcttggttccaccagtgcatgagttgggcaagtttctttatactctgagctagagttttctcatgattaaactgtagacaatagttcctacttcaaagagtgttggaaagataagattacattaagtaatccacaaaatacctaagacagtactttgcatacagtatttatcaataaaagaaaattcaaatttccatgttgacctccactgctttcagatgcacctagtatccaaaagttcaatttctctttcttggttccaaagacaattcaagggcaagtagaaatctgctccagggaaaggacccaaaattggtcatttgggcagtgatatgaacaagtttcatcaagtcagagccatgtccacaggaaggcaatgggacagggagcccttttggtcacctagaaggcaagcaccatgcccagcaccagtgctgggcatgcatacccatgtagcaaatatgcctccgctagtgactgtgtgaccacagacaagacattctgtcactctgggcctttgttttcttattgttaagttggggataataatgcctcatagaattttgagagaaaatagtgacatagtatctgtaaaaagactgttcgtgctgttcagagatgttacaaagtattcagaatctgcctcttctcatctcctctgctgatgtcattctggcccaagccaccatcacctctcccctagatgactgctgtgtcctcctgattggtctaccttcttccacctttatcctcttctagcctgtcctccacaaggcagcataagtctaagcatgccatttctctgctcagagccctccttacagtaacacctcatttacagtaaaattcctggcaggctgaaaccaggacttatgagtctgcctcccccactacctttctaatctttattatgacccctctacttcttgattgttatatggcaaccatgctgcttccttgatcttcctcaaagaaggaaccaagtacattcccacctcagggcctttgcacatgccggtcctttgggctggggaacactccctctagatatttgcattgcttctgtctcatcacactcaggtctctgtccagatggcctctgctctgagagagctcccctcaccacaccagcatgctgtctcccctcctccttctctgtgtatcatcagagccctatgactgctgatactattcatttatctacgtattgaaatgttttctgactccttcactagagaataagctccatgagggcagtgtctgtgtcactgtcttcacattcatcattaccatataacaatgagttaaaaattacagctgccaatagagaagccatcctaagtgactggcactgttctaaacctttacttacactgctcaattggtagtccattacaacactcctatgggttgctgtgatcatcatgcagattttaccagtgaatatgctgaggcttagataggctatgccaaaatccagaattcaactcagttctgtctgtatctgaagatctgtgacctcccatccttagtaatttgctactggggttcatttaaagctgatttcaaaggtggtataaaattttctctgataaggttgtgctcacatggctgttagaaaaagtagaccaacatgatttccctgagctttaatgccctctcctccttgccccagtgagatatcctacactttgaggacaggagcctcaaaggatgcctgagcttgcggtgagacaggcatcagccaaccttctagccagcacctgctgctttggaccctcagcacaattccctctcttgaagggacacctcagaatttcagacaccacttattccatattgagcaaaaccatgtcccatatgtctggtattcattgtcggcagattgcagacaatgcttggtctgtttttttctgaagatcctgagcccttccaagcttctgctattgagaggtggatgtctttggcatcctttaaattacttaccagtctgtccactttggtgccactagtttccacaggcccctggtaacttattcctcgtttcccatattgcctcagtaacctccctcccctatggtaaaacagggcaactcttgcaccactgacctctgttattgggatcttattatgatgcctgacatagaatctttagaagcacccccactgttggccagagaactcagtgaaagggacagagaacacataggcttatgccactctccaaggtcctgaaccaacatgctgcaaaatatcacagccctttcctctatgatgctggtcattcctgtctgatgtgctcctgttgagggaatgatggaaaaggaattactatcatacttaggaggagcaagagaaggagaggaagagagctgaacttaggctagagagtgtcataaccacaaatggtacttagaaagaataaaggtttggtgttgttttcttttgttttggcattgttttcaaataaccatttatcaagaagaaacaaccactgcacatgaagctgaattcatgtttatttgataatggtactacatccctgacagttgaaactttccctcttttggcttatgttatcctccaatccatcctgcttttagccgtgtgtgccatactttgggctaggtataataaccagcctgacttttttccctgcatatttcgcccccatagaagacctcttcaaacttctacagcccccatttccctgtctgcttctgcttcttgaattctgcttccccataacatctcaaagacccttttaccttctccagggcgccttccaatcactcagacatggttcctttaagtagctgtgtcacaataaccaatggagaaagaaacactctggtagaatccttattttgaaaattgaattctggaccatgctactttcccagtcactcacaccacagtctctcccaccatccatacgcctgatatcattttctggtcaccctctctaccacctcttcacctttattctatattgaagagtgctaaagttgatattgaagtacatattcaatattgaacttcatattgaagtaatttttccaaactacaatcttgaatcttctcagccatggagaacattacatttgttgctttcctgactgataatacctaggagtcttgagtatcaagtgtccttcctggcttattcccagaccccactgcaattctttcacctaaagagagaaagaaaagagggcacagtttgctgtgggagtaaaggaaaggtttcctttcccataggtcaggggaggacaatgaataccagataccaagtcaaagtcaggctacctctagggaggccaggaagcagagatacaggtacagacagaagtcacaagcccagtacctaataagaactggacccattctggagacacagccccatgctcaaggctaagtttctgccccttggtagaagtgcttgctggggctaggtggccaggaaggtgcagattggggcaggcagactccaaggtgtttctgtgacaggtaccagagatcatctctgaatctattgatttgcactggtcatgtcttttcccaagcatctgtaacaccttgcatctgtaccactttgatcctttactgtatgtgttcacagtttccagcactccttaggtatgggctcctacatcaggtttccccaacataggttccatgacctcacggctttcacagtctttagcataattctgaatgagaggtctctgctcaagaaagggtggctgaattaggtcagtcttaattacatgagcaggtgaagattcccgataatccaataatgacaatacaaatactactactaccactagcctctgatgttactcaatttctctgtggaccagctacagttaaactctttaggcatgtcatctcattaaattctctgacctaccatctttcagataaggaaactgagacttagaagttcactttctcaaggtcaaccaactagagaatatgttttaacttggttactgtgaacacttaggaggatcatcggttggtttcgggggactaagaaccccctcagagtctgaaaaatcatgtgttgcaacacgtgttcacttttctgggggaaaagctttgttgcttttatcagattctgtaagtggtcatgcacagagtagggagggccccacctctggcctgatgcagaggagcatgatcccagcctgaatgtggggttttccaggggagtgtttctcccaagttatagctccaaccttgtggacaaccactgtggttgccaccttcaccatcacccaatggggagggatcccaggacacagaccctggcttcagcaatgcacaatgagctagacccgacctgcttggcaccttgtaccagcctgaaatttactactaaattctgagaccagaaggttagccttattaagattcctgataaaggaattggctttgggggcttacctgtcttcagcagattttcactttgattactcaggagtgctcttatttccagcttaatgcctgcaaataaactcacccgctctctcccacacaccctgtctcaccattctttaaaaaatcatctggcccaaatcacattaagaagcaggagattctatcttaatatggtagcacttgggctggccctgtgggtctagaaggatcctgtttaactccagtgacaaccgtgctccatgcaggctaagccaacctctcaggcacatcctggaggacatcggagacccatcttcaaaactcatgaccaaccacactccctcctcacccaaacagaaaatcacagctcaacacttctcccatcctttaaaaggactgaatttccttagccctttaaacagaatgcattcatcagaagtaaccgtggcaacagatcagagaggcttcaaaaagcctgtctgtatgtaattaagaaaaatgaggaagagcatggagcttagacggggagaccacggtgctgagccctgccactgcattcactgagggcttttgcggaaggagatggcagattttctttctctgttctggcttccctctctgctcccccttgtaatgtttttgtttagtggtctcaattggcctccttcctggagatgttgctggggtcccagattctggatgaatactccctgcaagagtagggctccaagccaaggaggcaatgcctggatgggtagggaagtggcttagcatcttcctccagggaggtttatgcagacgccaaatctaccctggtcagactttcatttggccatagggagactgagcagtctacctgcaggaatatgcccatctcatcaggatgctacggcacagacacctggggccatcatcattttaaccacccagacatgaggccctggcttgccagccctggagcgggcctcatgggaataagagacagacagaacccagcattgttaggaggccatctgagccctggtgctttttttttcataacacttattcttatttaaaataatttcatttatttctctgtttccttctattctattagttttctctcactggaatataagctccataagagaataagcttgcctgtcttggtttttctgcctctcaagtgctgaaaagaatgccgggagtattagttacgggagtaaatgagtgaatgagtaaataatgaatggtcatttttttgtggcccagattctgttcacctccacaaatatgcactggcacttgctctgtgggaggaagaagacacacccctgccctcaaggaggcaggggaatgatacaccgcagggcatgtctggctctcctagccctctgagtccattctccagggaaggcccttaatgtctgtttctgctccttggaaggaagggattcagatttatgtactcctgcactcaacaaccatgaccttcacaagcccctgttcatgcgccacagatgcatttgctctgaaaagcacacatgaatgggaagggggcagtggctgctttatatgaagacgtttattaaaacaacatggaaaaaaacccttcccctggaatggggggtgggggtgggggaggaaactcactgcatttcctcctgagcagctgggagtaaatgaacagacatggagcagcatcgacaagggtgggtcttcccagctgtcagggaggccactagatgagagactgggcaaaactctccatccagctcttcatttgccacctttgcctcaccaaagcctctgccactcagagtaacaagcagtgggtcatcactgattactgctgctacttcaaggcctctccaaggcccctccatccacctacagcaaggcatcctgtctcacgctggagaggggtatatacatgggaccttttccatgcacactgagcaaaggtagaaaaccaggtgggagggcaaagtgctgtctggggatagtaattacagaaacagaccagacaactgcccctgtctaccaggaggctacagtgtggtgaggatgacaaagaggaagagactatcacaatgcaatgatggaatctgacttaggcacctggaaatgagctatggaagcccagatagggagatcatgactgctgggcctcagggaagggtcctagtggaatgggtgctagaccttgaagagtgagcaggagttcaagttgatacagagggaaaagaacttgtgacagagggaaaaacattgtgtagaggctcagagataagaagagagtttagtgtgcacaggaaatttcaggaacatttctattagccaaaatatgaggggtgaaggtcaactgccagggatgagatcaagaaaagcaagatcccacgggggcttgaatgacatggaaaggagggcaaccattttggataatcaggaagcaggggggaaattgtgcagaagaacgctatgactccatgtgcaatttagaactcatactctggcagaagagactatatcagagaaatgcagaagcaatgttggagaattaattaggaggcttttgcaatagggtaggaaaaatgatgaggcccagaattctgaggccatgaggatagagaggaaggaacatgtctaaggaaaagtagaggaagatggacagattgtgctaatggtccatgtgttaggtgatacagaagatgtggctcccagggcctgactggtgactacacaggtatcaaagaaggtaaggattgaattgtgttccctggatttgtcacatagaaagccaaaggaaaagcagtcatggcagagaagtggggaagtaatcagacttcagttggctgagcagggagagaggaaagacagtaagtgtaggctcttgtttgcaaaagcttggctgagccaagagtaaagaagagagggtgtgcaatgtagatagatgccaggtgatgatgttttggtttgaaaatggcaaagacttgtatgagtttacattgagaagctggagtcagtggggagagtgtagctgaagctcaaaggagagaggaaataattgaaggaggaaagtctcaatgggtgagagggatggatgatcactctcttggtcagtgcctgcctctgccccttcacccgaggctgctttctgagtgatagcctcaggatgtcccaaggatgcagtgagataaaaagattcaccccacacctagtataaagcaagcactcagtgaatgcctttactttgagatgagaaacaggggcccgcgggtgagtctaggctctctgctatagaagtgagactaacaagagttgcgttgactgctgagagcttgtggtatgagtcccatcagtcagaagcaaacagatgtgtccaagacaggcagtgaccaatatggatggtaatgaattgtgcagtgtgtgtcaaggttggcccagccctgtaagagcctacctgggacagtactgactgccttcccagcactagctatgtgattatttgaaaagagatggatgtttattcctgggcagatgggtggggaattcttgaatgctgtttgcaagacttcagtaaaaatgctccatgaattctgccctgtcacatgcgtgcatgaacgctgtgctttagctcaggcctaatgggctttatatggtacagtactgattttctttcaagttttaatagaacccgatttaatatttgctttctgctctagctgcttgctgttgactgattcaacacagaatccttccctggtgccccccgaccttattgttattccctcattttttgtgttggcatttgattcctgtctccagcatgaaccactttacacatgtcttcgttcagctggtgacagtcacgtgcatgaattctgaatgcattactatctgaagcggctgctccagcagacctgccattcgaaaggggggcttccgggcaggattcatttttatcagttagacactgaggagatgcaaggctcaggcttgggaacctgaggctatgatctgttctggttttgggcagcagattctccaacttaatctcaaaatgcccagcattgtggccgttaattcagcaatattttgctcttctgtgaagcaccaggatttccacagttttgcaacaaggcatttcagtttttgccagattgtgaaaagtagccataaacagagctttccagaggaaagaggctgccctctgtgagtcccagtgagcctgtctggtttgtaagagaaggtctgttcagagcagggctatagttgagaacgtgagctttggaatcccgcaggtatgggctttcacactggcttcagttcttacagagctatgcgatctatagccagcctcctttctaagctttacttcccctttctattaaattgagataattattttatcttcctggtaggggtctttggggggaataaataaggtaatgtatataaagcagctagcagaatgtctaaacacattcctgtgttttcttacgtcatggggcccaaagtgactacatgaacctcttccactcaattctgcttcttttctcatgtgccaaagctggtccaatgtaaatatacatctattcaggtgctctggaagcctgtccctacagagatgcatccctgctaccacgcacacaccagatagatcccaaatgtgtgagattttgtgcagaatttcagaatatgttagggtttttggaggggccactcatatccttctacccttgagttctacaccaattaagattagacaaagaatccagtaaatgttcaatatatatacattttattaaccctaaacctggctggaggatgtggcttgatcctgagagcaaaaggccttaaacccaggtcctggaaccgtctttcccttggcacacatgattgaaagaagaaaagcctcagtgaagatgactgaaatgggagctagggacaagttgtcatctctgttcacctattcttcttttaaaatgaattgaagcatagccatttggggttgaggaaggagtgggaggcgagcgcactgatgaggttgggaatgcaccagaggcagacaagagagctgccggacaaggaagcttatgtctagcctcactggaccttctttgtctccctgcaggcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccggtaagtctggaggcttctgtgctcctgtttggatgtgtggctggctctttgtctctaggcagggacacagctgcagccacacccatcctgcccgtgtactgtcaggcctctgcccaggagtgaaggtgtcaggtgatgggcatttgtgatcacatagagaaggcaggtgtagtgttgcgcttctgagaatgagctgcagactaggggattttcttgtgcccagcacaaaagcaaagaggtatatccaagccagaataggacctagtgctcttcatccagcctgagctcaacaaatcctgttggaaagatggatgaagagatggacagacaggtgtgtgagtggacaaacagaggattgtgtaaatggatggacagatggacagagggctaggtaggtggacagatggatggacagacagatggtgagtgagtggaggcactgaaagactttgagaacaggacgacaaatgatgctttatggaaacccaatgacagaaattttccagagatcatatgataaaatcaatattaccttcattttccaattaaatctatgtagttcaaaagtgtattctcctttatagcttgctctgatgaatgatatgctgctgttgagacctcagatagaatggcaatagatcgctcctgatagccagcacatccttgtgggatgcatagctcagaacacattttctttctctttatttctgaatcttacactcttctgatcttttctctttattacttttcacagctcttgcaagaatctgtttatttttatatcaatttaacgagtccattcatgcacttatttattcgttcatcattaagagacagtcatttagcatgtactgtgtgccacgctgtggattagacacagtgaaggatgcagtgatacttggacactattgttcctcccatgaaactcattaactgaagaatttagaggatatagatacaaagcacaaagctgcaaggtaaaatgctatatgcatgcagtaaataccaagggagttagagaaaaatgagcaatctctctcccggggttaccgtgcaaggctgcagaggggaagtgaacatcacatgcacaggcaatgggggtcataggcagtggaccgtgatgctatttggaattatagatttttctcaattaacaaattctaaaaggacagcttgttagtagaatagcaggagccaagcatctatctctgctctctcttcctctgtgtatctccccctccctgacctcctcttttctactccatccttttctactcacctccccaccctcagactcattctgcttcttttaaaaccaggcatcttaggcatctttgatggcatatgaatcttgagtttaagctgtcagaactgagaagaaaaaaggtgtcgtaggagagcatgtctgtccagatggctgtgttgctgctgtgtgtgggtgtgtgtgtgtgtgttcatgtggtgtgtttgtatgtatgtgtatggtcacgtgtttacatgcatacgtgtgtagtgagaaaataagagtggaaatgtagaagcctccagctggtgaccacagtgttggtgccgtagagacaaaggttgtgacattttgtcttacccaaagaaaggagaatggtaatttctgcattatgttaagcatgtaacatgggcagcctttgttagcagtatttcccttgaagagtttaggcagaaaactggctgaaatattttagtgtcccagcttttgggaatgacaatcctgccaggctgtcatgttacactgggcttggctgtcttttctctctctctaagcatgtgcgaacaaacctgccacttatatcggtttgcttttatttctgccctcccttctcttaccctgctattcccgaacctgcccatctgcttgtcttgccatctgcaccttcctagactgcagtggagctgggggaccaaggctcttgcaaggggccctgcattaccaacatgcaaaatattcatttgtatcctcacccttttgcacctccatgagcacacttctcatgtgctttgttccccctctggcaggccctttaatcttaatcatccccgattttgtagtcctagcctccattatcaccttccaatctatgattccctgtttggtaactctggaattctggtgtcagagagtttacactcgctgagagaaggatgcaatttcttcttggtagcacatggttattgtaaaacaaatatcaagttgaccagtggttcctaatctatgggctgtggactgaggaacagggtgccatcgcactgatttgatgaatctatgtgtaaatacaaattattttcaaccaacagatagtatttttttaaagatgagagccatcaaagtaaacattcaaacctgaacttctgtgagaacagtttagaaccatgaacagaagctatgcattttaccagaggtggacaagagactaaaaagtaggcatcataaaaactctaatgactcagatccattaagggctgaggtgggtggacccatgtgttaccaacaggtcatgacatgtctaaccttcccagaatacccctgagctggtccactctagctcacactgggtcagatctagctcagtcttcctcccctggcttcatggtatggtatgacccctctctgtgcctgtggccacctgtcctactgtttgagtcatgagtagctagatggcaggcaaagaatttgaccaagaggagtcctgggatcaatcattaagtcaacctgtgtttattgaatgcgtactctatgtctggaactgcccaaactgtgaagtggctggggactattgagtgggtcctgattgagaaatagatgagtaataattattatagttaacacctcatgtttgtgtttcttttgagttcacaaagaattttggaattgtgtggactcatttaatcctcataattacacaatgacttggggattattgttcctatttttctaataagaaagcagagacttaaagggatttggagaatctaggattagaaagagatcagcaggatgtcccttgtctgtgtctgccttgtggtgttctgtcctaaaagtggacagtacctctgggctccccatttcatagtctccaacaataggctcttcttgattccaagagctgtgatctaagaagagaccttggagatttttgctatcatttgttttttggtcattgggcacatggtagatacagtttttcactcagagacaagcttgtctgttgagttctgagattcagagagccttcatcttctcccatcatgaccccaattatgtatatagtcatgactattcaaggaccaggtatcacttggagagtttcaggactggatccttacccagtccaaaggcagtggcagagaactgacatctttgagcacctccaatgtgccaacccctaccaagtgttttgtttttgtttttgtttctgttctttttacagagaaggtgggtcagatgaagaaacttaggtcagagcagttttgaatttgctcagcatctcacagccaacaaaggattctaagaaacatcatttgcacctccctaggctgcagatatttctgagaaacatcatttcttggctgtgagatgttttgtggccattttatcctcagactgatgaaaaatcacattatagtggactgtgtaagtcgtaagctctctctaagctgttgccacattgctaggccattttagctgtcaaaaactgtccatcatctttggtcaggattggtcatgaattatgcaagctcagatttatgtgaggtcttcagggatacatccttgcactgaatacagctgccatgagtttaaaatagaccagatcaggtgcaactctctctgttccagtggccaagtgatctgcagagagattgttatcaccactaactcctgcagtcactctctggcatctggccccagattcagactgatggccggatcatctggctgtcagagagaattaagtgaatgacaaactttacttctctcttctgtcaaatagactcggagtgtcaaagttggaaaagaagacctcagaggaaatcttgggggtataaaagatgaatcagaccagcacatgagcttgggaccatctaagccagagaacaaactcaaagacccctaaggccaggcaggtaatggagaggagcaaagcagagccaggtacaaggcaatagagagtggtggggactgcagggaactttagaggcagccattgttcagctccagcaagagttgcatgcccagcactgcctgattttataagctgaaaatccagatttaaaatgttgacaactgattagaaaattttaaagcacttgagagccaaagaaatccaattctggatttagcctgttggcgatggtttgtaacctctgattcagagggtgaatctgattaacccaagtcttactgccaagcatgctctgttttccattctcattccaccacggggcagtcatcttcctcacctctgggctcatggtggcagagtgctgtggggtattcctggggttgcttcccctctctgctcctcacatgaatcatgcaagttcatttaactggcaagatccctcatttcttgcctataaaacaggtgtcatgatacctgcttcctagtactatagggacaagcaaatgagagagcagatagaaaatcactctgtaaactatgctatggactgagagattagcatcatttctgggaatatgtcttcagctagagagcaatttgccgtattttttctccctagactgtttccttccaagccttcacagtttctttgtttgggactgatgttatctgtatcagatacataacagatattggtttctccagtctgtgctgggaggggtaggcaccagaaacgaaagtagcaaagtctgtatcccagtgagctaatgatgaggtaggaagtggagcccagaacctaggtacctgccattggatgattctgatgctcagaggagcctctctatctttcctcattgtgtatttgaagaagcaacaattttcccctcacttgcatgatcttatcagcacaatttatatctgacatttatattacatgcagttcatgtatggcctgcgtgccacttccatgtggaatactatccatcatgcccacaacacagacacaacccattatttacttttcttttaaaaatgctgcactatttctgttaatagttacaagcccctatagtttgtccatttttaaggcacttttgaagttcttagacagttaaaatcactcagatacactaattttcttacaaaagaattacctagcccatcaattcctctgaatacatcacctaatttgcattattccttggttaaatatagtatttgcatgcataaagaataatctttgaatatgaaaaggaattttatgatattgcaatatattgagctctttggaggaaagatattatgtaaatctcaaaattaaatattaaaacaatattacactgctgcctgtaaaaatgtggagtgttaagatccatatgctgaagccagttcatttttaagggctgtgcttattggaaattagcaggcaaaatttgctccaacacagagaaaagattgagtgagaactttaaagactagaaggacttgaaagaaaactttcatcgaagttaataaagaaaagttaaaaaaaacttaagcaaataaaattttcactgttcttaattcaatttcatagtttgtttcattgctttcttctcattgttaattctagaaaattttgtttttattgtttcttaagctctggcattgggaaggaacttccaagtggcctcagaaaggccctggccatttgcaaacaatgatgtgttctccgttgagctcagagggtcggcagatggcactgcccctgaccaatgtcctggcttctatccttggcaacctcgcagtcctccaccagatggtgagctatgtggagagtcacactttctcacctaccaccagtttcctgagagagcagccgcacaatgccaggcacagagagccttgataaatatttgccagatggcttcagtccccacagatgagcattagtatgtaagtgtttggctggggagtggtgatgagaatgtgtcctggtgacccacaggtaacatcttaatatccctcccagattagtcatgtaatctggagtcttcctccactgtggctccttgcaggaaaacttagggaatgttgcttaggatgatgctacaagccctgatccactcagaggaacacagaagagactcaaccactctcaaagggattggtttgtttgggcattttaactttggaaatgtattcattcacttaacacattctttatgactgctcaccaagtactgcttgcaagtactggctcaagggtactgctttttaggggctcccatttattcgcctactcgtcaaatatttttcaaggcctttctgcatgccatatactgctctagacactgggaacacagcagcaaacataacagacaaaaatctgtgcctttgtggagcttgcattctagtcgacagcactcactgagactgggatcagaggcccagaaaagtcacaaagtaagcaggtgactgattgggaagtgacttgatggggtgcaggaccctcagctgggctcttggtaccaccctcttctgtggtgcccattcttacatttcaaaagttaggatggaaccacgtgtcgttgccagagagcatttcagtttgtggtggatgttgctatacagtgacaatgtgtttgatgggatattttattgttcaacagaccagtttgaatgaactccttgtggatggatatcacacgctgggacacacagtggttgggtatgggaattctccttccaggttgtgagcagtggcttgtgatgctgctaatagctccagaacagccttcactctgctaggagtaccagagtgcccacaggactcagggacctatttgcttgtttactccatcttggtccaggcactccaagtacatagcttcaggagtaaaaatggctactgacaatgagactggaggaaatttcttaccctgtaaggatctcatatccacatgagattgttataacccttattggagaggggacaccagttggattattagatagttgctgttcaccttgtgagctatcccataaagaggcatctcataaagaggcaaagaggatgggagggaggagggtgcaggtgatccatcctccatgctcctgtggcaagtcaagtcaactccatgaactgactggcatctccaggagagaacgccctgtatccatcctgttgactattgtgtccagataggcgtctagttgggtacctgaaatatagaaagcaatcaataaacgttcattgaatgaactagtaacttgttaaataaatacatgaatgaatgcttcagtctttcttaaagtaatctcaggcatcagcaaatggtgcagctttagctgtctctgtgatctttcctttatcaggcacctttgggtggggagctgtgattgcagttaccccttacattctcccagatgttggtaagacctcaggcttcctgtgtgcactgcacccccaaaccataaccatgttctgtgggagttgctcttctatgacctggcctgtcctacctcccccactggcagggtcccagctgcttgagcaattgcagggagggtggttgggatggcatcccagcactgttgtctgtccccctgcatgccagccccgcgcctatcattttcacagtaccatccatgttaaacaggcaggagcaccaggggtttctgaatgcagcaattaacaaaacagtaatcaagctaagtgtttaatttcagaaaattaacatcttctctgagcggatgtgaaagatggaggaaaaaggcacattgaatgttctgggtaaataaaggcaatgctggaccacaaatatttttcagtgcaaggtaaactctttgccaatccctcaggcctcgggatcagtttccttctggtagccaaactgcaggaaaacctttgctgtagaattgagccttaggattttaaagcgtgtgcgcttctttcctttcctttttttttttttttttttctcttttttgatggaagagcaaacgctttcaccattcagaacagcttgggggaacaacagcccagtcatgccccctaagagcgcatctgccctgtagaaacggtgacgtatgttgcccttctctgaattgtgcttgttaaagggacaatacagtgatttcttggatgtgcatttgttgtttatgtgcttaggctctatttctcttggcagactgagggctcccaagggaaaaggccatgtctttctcctcccagtaaaccctgcccctcagcaatgtgtcctctgctataaggtgtcctggctgaccttacaccatgtcacatgctggtgctgcctcctaaaccagcgggctggtctttgtttgcaggaaggggcttgcatgtagggaaggaagcttgctaggaggtgggtgtgcaggagactgggtccctagaaggacagtgaggtcctgctaccatctgtttcatcatctgatggcctggatgggagtgagtgcctaggatagaggattgggagggcaaggaaagtagctttgtgtgaggcatgctatgaagtttgaggcacagacaggcagccttgagactgtgtgatgaggtaccaccagtaaccatggaggcagggctctcagagtggcattgagcctggtgctgcctgaggaagcactgaaaaccatgttcccacaggaccacaggtcctcagggaggggcctggccatctggcttaataagcagtgttccttgaggggtcttgaaggcagctgacatggagaacaaagaaagcaaagcaggagaatgagagtatagtttgcgagtacagaggagacctccccaggggctcccagaagtattcagggactgcatcaacagaagacaggttcgattctgcacatgcataatttgtggagagtttgagtactcaaatcaggatattacttatgcagttggatattcaggcttctattttctctggaaggtgggaaataagattggttgctgagagtgaagggggaagtattggggttgaaagtttgaggagaatggaaaaggcttggcagtgctattgaagagaatgggaaatggaactacccaggtaaattcaatatttctggaaagtattgagagctcatttgaagttggtgatcacacgtttagaaagccacctctttttcctcttatgtggctttctcagcagtatatggttccgggacagcaggccctacaagaaacagatcacaaatatacctctggttgagttttgacagtcatatgctctgaaaagataaaggcaacatatgcctaaggttttgaggagtattgtgaattatgttattgcaaagatggagcctaagatggataataatggatatgaataaaggagaaggcagatgcattgggtggaagtaaaggccaagagtgccagatgaagccaaaaagagttgcagtgggctcatctgaggttgtggtgaggaagcagaatatttagacttgtgattttgaaaatcgagtgactttaggcaaagcagagtctaagtgtgccatggaaattggcaggcatggaagagttgtagaggccagggaaccgagattatattgtttaagtggacattgaactcacacacaggagggcaaggctcagggtagagaggaagacaaagactgaagctcatgcctccgatgaatgggggcgtgacggtgggagggagcatatggtggtcccaagacctggagagtggtggtctagccaaatggcatttttgcaaagggtgcaggagatggcgagtgatggtgtgaaagagacagtggggagcaaggatgacacaccccacttcctgaccctgaggtgtgctggatgcaaaatcataaactgtcatcaggtgagagggctgcaaggcaaaggtgtcctcaagggacagctgctcttccttaatgcaggcatggagtgaaggctctgagggaaggaggtgggtacaggggagtttcctgatttgtaagtggagggcccagggtgggggtgggctcagtagtcagtgggaaagtcagaatcaagaagaggcccacaactccatggggctggtgatgtccagaaaggggctaaagagtgggcatggcaggatggaagcccgcctgtgcagcctggtgggctgctctgaggaggaggggctctggaccttcaggccagaagactcagacctccaggcctggaggaggatggtcacagtgactgcaggtgcagctcccctgcccagcgttggtggcagtgatgtcagccttagggtggtggtggtgggtcctccagctgcattaggggtttggctgaatgtgtggggatgagagccaggtgtaacaggggcacacaacttgcggtggggtatctcctgtggcctctccactgctagtgtttggagtggactgccgttcatgatcaatcattaaacagaccaaagctgccagtgctctgctcttgtcctacacctgggaaaggctggcaggcctgaggggaggcagaggccagtgacatgccccagttgacatgtgagtaccaatggttgtgtcctcagcagccatcacagtgcttagatgcctgcctgaagagtatcctgctccacagacacctccacagcctcccatggttgcagggtcacagaatgcaggtttgctatagttttcacataaatggcacattctaagacatcttttgattcccccagcagggaggaggagctgtggaaaactgccaggttgcagtgacccaggaggcagaagtgccaccaggaacacactgcagcctgcctcctcctccaggcacagggctctgcacacttccaccataggtggggacccctgatctccctaagggcacaaggggtcccagaaggcagtgcccatccattagtgatgctgatgtaactcaatgtccccacccccatgcctggcctcctcaaggctctggaaatgcagagtgcatgagttgtggggagggagccctacactgatctcagggaaaggaggcccagctgtttctggttctgcactaacctctggggacttggggaagtcattttcccctctcttatcttcattgctctaatctataaattgtaagagttgaccaaaactgaatggcctcagatgccctgtcaaactttgacattctgatttctaggtttccagacaagcagttctcaaacttgagaatgtgtcagactcctgtgaaagacttgttaaaacacagattgctgggcccacacccagagtttctgattcactgagtctaggatgttgctctagattctgcctgtcttaccagttcccaggtgaggctgatatgggactacattttgagaacttacagggtcagatatatgatcccaataaagaatgccaccccaccctcaaacacatacacatcaaaggtaacatcagaagtgagggcctgtgctataaatccacattcccagatcagccaccaaccctcaacccccacctgtcaccccccacattcccctttggcacggaaccgaaacccttagtggatggaccagtgaaggaggagcctgtgactccctgccttggggtgtgagactgaaggccaggcatgaagccctctctttttatcccattcacatctaaaattcagccaggattctacaacagcacagagcagagctacacacccaaggaagtcctctgtccccaggtgactcccagggtaaggaggaagataggaagggaatgtcagagacatctcaaggcaaagcccagagtaaaagcaaacaagaaaccaatgtccacaatagaggaaaacaatgagaagaataattaattctgcttttgtatttatacccagtctccaaattaattgcttatttgtttaatctactttgaccagaagtgttactgcaccaaaaatatttaatgagtcaggtcttctaatgtaaaattcaagcatatttgggcaatgaaatgagttttcatctacagtgggagatccagctatctaagcaggaccttttcagcaaagttacctcctagaatagaaatgtcagagggaacacagttcatctgtgttgcaaattgttcttctttggtcatgagtactagtgggctggaagtctttagttgacatttaaatacaaactttggttttttgatatgggaagtgtttcatatatttaaaaaaaagatggccagccagcccaatccttcattcacaaccccatcactcatagcttctaggatctcacagaagtccctcgaggggacttctggagactgctcagcattgtttgggtctctctataaacttttcagagtctgggttggggagatagaaaatggactggcttcaaggccctagcagctctgattcacccagagcagctctgcattgttctgtttcacactttatacttcagggagaactttgtttggagaaaggatttcatagctttaaaaaatagaaaactgccaatattagggtaacgttacagctgaacaatcccagtgagatggggagggacccagcctgctaggtgtcttcatttacaccacagagaagaacttctatctctaatcccttgggactaccatattcaggcctattctatgttctttgtgagatgcagtctcaaccctgctgactcaaccctgccgagtcacaaccctggctcccttttccacctcatgctccttcaaaggccaatattcatgtttgttagaactaagggattttctgactccttttacctctgaggtctttagagaagagcccgcaatcattgcagtaagagtaaatttttgttgaacatttattatgtgctagcacagtgtgaagaggctaaaaacatggtccttgcctaaagactttattgcactgatggagagcagaggtgagcacctcggaaggtagatcacagtgcactgtgtcccaaagtggagatcacaccccaaggggctttgggttgggaggcaggaaagggcactctggtgggcatggtcaggcaaggataagcagtgtggggcagtgtgaggctccccctgtgccttcaaaggccggcaaggtcaagaaaagagatgcccacagggaatggaattagggctttttctagtggtgagccattgaaggtttttagcattggagtaacaaaggtaaaattgagtttagaaagattaatatggctacagagtagtttgaagtgaagaagttagaggtggacaagagagttaggatggtaagtacatgaggcacaatgagatacaggtgacgagacctgtggagaggcagtggcagggccatgggagcatcgggggctcctgggcctgagccacacattagatgggaaggctatgcttgttcactgtccagagtcactcggtctccttatccttagggacaagataccctatcacttactttctaggttgcttcaggttatctcaaaatgttcaagggaaaccagctctcttctggagcatttatcactccagcctctggggaacccagctctttgctagcttcccctttctccaagcccatttgtatctatcacatccaccatggcttggtcgacatatttatatatcctctcaaagatatttatcagataaatacctgaggctgtctctggatcccactttttacatttaccttggggaatgatgcccagtgattgatttgcatatgtgaacagcagtggacccagaaggatagtttggggtggttgccaagtccccagcctggcaggtgggatctggttgaaaggagcaagagaccacacagagaacatcttcaaaacatttgggaaattaataacataagaattaatattcctattttacagttgaaggacctgaggcccaaagaagacaaggccttgggttaaccttatcccaagatcacataataagcaaatggcagagccagaataggcacacacatctctctgcagcacctggagggccctgacaacagcccttctttatttctgctaactcctgctgctctgagctgggccctaggctccttactattccttaccttacccgttttcttcacagctatggtctgtgctatagatcacaggtagttagtccaaggatgatttggctgggaaacgctgttctagagagaatagaagaggttagtattaccatatgatccagcagttccaatcctaggttgattcccaagagaaatgcaaacatatgtccacacagaaacttgtgtatgaatgtttatagaagcattattcttcaacttgtgtatgaacgtttatagaggcattattcttcaacccaaatattcctcgactgaggagcatttctcccagacaaagcaatgccctatgagggtaaaagtggttaccaagccttaggttcacactgtgcaggctggggcagcagcatcactctggggggtcactgggagggcaccctccaacacacacactgtatggaagggccaaggaaaactactctaccctgtccacccatgagttattgtgttggggaggcagatggcctcctctttgtatgggtctccttgggaattttagatgtgaaagtacctctcactggaaacagcatttgccgtctagaagagttgctagagcatttgcccaagctaaggcagaggcagctcagctgtgacctacatcttcctagagctggcaagagatgtcctcaaacaaggctgtccccgtcacaatttccacccacacacacaacactgttttcccttttagataagatttgctgaactctgaaatctgagtttcataattttataacctctttaaacattttactccaatagatcaactgaagtctgagtgtatgtacgttaattttaacacagtaaactgttatatcatttgttaggtcccaaaactgattatggttaaaactgttgaaagaagtattttggcacaaaaatcaactaaaagattgtgaagtatttttaataagcattgtaatgtattaaaacttagtaattgtcctagaaaaaaagcatcaagtaaatcttgtatttttggaatctgagatgcttaattgttggaggaggatgcccctatcagataaggaaaacaaaatgagtaagaagaaacctttgaagataactgagtcggtaactaaattaaagtgtcaaggaatgtcataaacataaaatgcttggcccacgtgaacctgtgatatgacagtaaaactcctgcacatcagaactctaggatccagagtctgggttattaacttttgagatagagtcatgccaccatctcagacccagcctgagtctcctgggacttcacagttccctttgggaccgtttgtacaaatggagggctgtctggtggtctgccaggctgcatcttcgatactactggcagtgaccagtggtcagtgactagtttgggccaacatttgttccacgtcatctgtgagctctttcacaacttgcagctagggccatcctgtccctgtaatttattcacatctcctttgtcaattcaggcaagaacattctgtgctcttcctctgctgtatgtgatatactatcttggatctgtctgctttaaaagcaatttgagagtaagttttccccaaagtctttggtggcaaaaacagagacaaaggactcactcactcagcctgcctttgtttttctccatcccagagccccttgaccagtgatgttttaattctctttctgcttctgacacatttacaaggccttttattgttggctataactctcttcttcgacactctcattctgattctgtttgaaccctagttgatttttccttggagtctgatgacactcttctttgctctttgctctcctatttgggtgcctgtactctgttgggtcagcctcttcatttgctaagaaagggtgcagggcacctttgattccatttggatttactgggcactgcctctttagacctcacacatctttcttgaaacttcatcaggttctttccaagtaaccccaaactaagtctttctgcttacgttttctgaagaagggtccatatttgtttctttgctaaatttgaataatcttgtgaactctttattttcatttctttctctcagtagaatgtgtaatttattcaaaacctttatgtgtgtttgccaaaaagagactctttcagatgttcaagcaaactatcccttcatctgaggaatatagagaaaagacaattagccaggacttactgtgaaaaccattgtatatgggggcaaaaggggatacttctttgaattaatcttctcatccctctttaatctttagctttagttttgctagaagaagttggtgtttgagtgaataccagagctcattcttattattttctgttttgtccgaaagtttcatagcacataaaacaacagatcaagaggtgacatttgcccttggagagggaaaaaccaaattcatcactgcaggtgactgttgatggcagagcactgaacataagctgcccgtgattttcagggaggataagaaatgctttcttgctttctcccatgtgctaaatcccatcgtaataaaatgtaaaccatttagaatgacctgtgtgagaatacacagtcttccacagggcctgtaaccctcatgtcattgccatgaatctgagaaatacaggcagggatggccatcaccctctggcagctcttcccagacccgagtgctgctgactgctggggagtccataccatgtgtagtgacaggagcgtttctctccatggatttcactgtcagttgcctctggatcactctgccctgtgattgcctctttaccatctgaccccaactagactcctgcacagaagtgcagggctgtgactttcttacttgttcttctgtccccagtgcttagaacaggactggcacagtgtttggcaaatatcttgagtttttaatgatggctttccagagagtagaggcaaggagaagaaccaagcccggcaaaatcctcaggccattagcattgatctttccattttttaaatacatgatgtttcagctctcaagacagagggactctgaagtcctgtatgaaactgacgtgattcacaacatgtaaattgtgcctccgcagaggtctgcaagggcagcctgagagtcacagcgtgcagtggaaggaaagaactgtcaggagctatttgttcaccctgtctttgtggacccactgggatcctcaaatgatctggactgattccagaaaactgcctcgccttccctgaactgtctttatcctcccccatgactctgtcccgtgattgcaaggtgttgggaaagatgatcacaggccattcacatatttaaccatcaagccttgttgctaagtccaggactcagctcttactttcattttacctgacttagcaacagcatttaacgtattctgtcctcctgggagcaccttatttccacttggtttctaggcgatcacactctcctggtttttcttctgcttcattggtggcttttccttctcaggcctctttagtgttttctcctcatcttctgaatcttgaattttttctatctattgattctcttggtgatctctgcaagttccacttatttcaatatctgtgaaatattggtgactccacattggtctccaacatggaccttatgcacctatctggtactcagcatctgctctgggacaccttggacatctcaaatctaacaggtctgaagtggagcacctgggctctcctctcaaactgcttctagaaatgtctccctgttctcagttgatggcagccccattcttccagatgtttaggccaaaacccttgtagtcacttgactcttctgtttcttccacatcccatattcatggaaatattctaaatagattcagaatctgcctactgtgctgctcaggccaggtcttagcagccattgtttcccagctatattactacagcagtgctgtgattggcttcctgcttttacatggcccctgcattctatttggagcacagcagagagtgataatagtatcatataagtcagattacatcaccgtgccttgttgacagtcctcctatggccctccagcttgctcagggtagaagccaaactccttctagtgtccctcagggtcctgccccctgtggactcctctcttctgggtcccactgactccctgatgcccccagatcagcccctttgtcctggctgctccagatacccactcagctccctcccttccctccttcaaccctgtgctcctgcatctgcttctcaggcagccttccctgatcacacacctctcacctctggcatcctgtgtccctttcccctttccattttttcatgtacttaatatattttaacacagcttatgattcatttattagctctagtctctgctgaatccccccactagaaagtaagctctatgagggctagaaattttattttgttcactatggtgcctctagaacctaaaaagtgactggtacttgacagatgctcaataaatatgtttaattaattaattaacctgggttatagatactactaagttgcaggcaagaaaaaatacacttgacagcttaatcaagataaattatttccacttactaaaccaataggccaaatttaacaccgtaaaggttgagatacatgtacattctcatagtcaaagccaaaagccaactctacagacaaaagatgaggagcataccatggggaaacctaaaggttatatataactgccatttcaggactgaacagcagggacatgtttttgatccgaaggctattggtcatattaatagatatataatacacagatcatgatagatattagttttattctaatctttgctgctcaaatagtggaaagagaattggattcacttccaagccccaagcctaaggagaatttagggaacatggtctcatttggaaaagagccatcttgggtggcatgtaatggtcatgggagaaatatttgactatttttttttcagcaggaatagctcaaggaagatctaactagtttccttagatatttgacaagacattttgtgggagggggaacatcctttcttacttcagttggtagaaaggaaaacagtgggaagaagataactttcaaataaagatcggaagatatgtaaattggtgagacttacctaagtatagaacagcagctcctggaggcaagaagtctcccctctctgggggtacagcaggagcttggcagcaaattcccaacagggaagttgtagggggaatcaaaactacattaattcagaccctccatgaagcagacacaaagatgggattagatgtatgaaagatttactggggaaatgagatgggagtcagaggaggctgggaaagccatcagaccataagaaaggtctgatctctgtaaaggagagagggaaggaaggaggattgggtagggtaggaagagctttagcttgctgtgggggttataaggtagtgttggaaaggccactggggagtctctgattggaagttgcccatcagagtagtcccatatatcgcaggaatgggtctgccatggcatccctgctgctctcattcattggctgggagcagcctgtgggaatcagggcctctgtgtgaatatggtgatggactgcagagtgcaggaactggagctgttagttaattactcttcaaggagtaggaactctgagaggtgcatttcacagccaccacaaggtctctaatgggaacagggcatacctgccttcaaggtcccagaggacactctggctctgagtccttatcacacttctaactctttatggctttcctggactagcagcatcttcagaacaagtgctctgcatcctctccctgaggggctgcatgtagtagggactcactgagggtccaatgagtagtggagaaagcagcagccaccttgtgaccccgtagttgtgcagtgtaaattccaggtctttgagggcaatctgttaacttgaattgaggatagtaaatgtcactcagccacggtccccagagaaaccattgtaaagtggagtttgagtgaggaaaagaccttcatcactgcagaagtgccaggactaaacggaacagcccctgagcagagcacagattgaagcctcatccattacccacctcttcccctagaaagacagccctcatttattatttccagactgttttcattttgcttacaccatgtgaaaaatgttgaattgggaaataaataatattatttccaaacagagatttctgaatcaactttacagattttggaattatcttgttcccaaatgtttgatttgtttatcatttcttcatttatacttgtgaactccttattggaaattccctcatttggaaaactctgaccatacctctgttgttggtctgtgttcatgtctttttgagagatacctcctctcttccttttaaagtataataaaatctaacttgcagtatcaggaatagatgtttgctagaatgctcctttctgttgtagagtaattctacaccaactggttctactctctcattatcatctcttgccccaggttctcatctctgcaatagctcagcccacaactgcaagactgaggttccttcaacaccttcttctcaaaaacattacagtgttcctcctttccttcagtcttttcctttgattcctccaactgtctcttgttttggtcaagccttgccacctctgaaagtcccatgtccattccagctcctgtgcacacatgctttcctttcctaaatgctaccttctctctcctctgttatccaatctccattgattctgcaaaacccacaggaagttctgcaggtccagctcagctgatgataaagaaggagcagagttcaagccgaatgccatttttctccctacgtacctctggaagatggcccttcccctataattgagtgtctgttcagctaccctgtttctttctctctccacagccccctccaccgttcccatcatgcaccaagtcagtgccactatgaggagcatcaccttgtcatggccacagccggagcagcccaatggcatcatcctggactatgagatccggtactatgagaaggtgagccagctctacctgcaagcttgcaagacccaaggccagccactgttccatggatggttgctagctgaaggcacaaaggagataggctgctgaggtggggaggattctggtgacagaggccagaaggtccctgggagagttctccaggtctgccctgacaaagccttgttcaaagcccaggcactttctgtgccaactaaggagagaaacttccagtccaccatcctgcaatctggatagttcactggctgggaaggaccagtcccatttttccagtcacatgtttgatatactaatgcagatgccacaaaactgccaggggtccccgaaccttcagaggagtgtgtggtttggtagatcagtgtttttcaaagtgtttgtgtacctccaaaataaatttatttataaattatatgcatgtactactgcactaatatatttgtggaggataaaaaaacatgtaaagtgaacattcaaaaggatgagataaaaattaacagaaatataaatttatatattattttccttgactactcttgagcatctgcttctgaggatgacagtggggcatggggctgccaagaaaagggaaatggtgcctggtggagctggtccctggcctccctcttaccagggcaaaatgcagcatttgcaaaaatcttaggaaaatacagtgccttccgttttaacccaacacattatttgtaaaaccacattattcattcacttatttgttcagtaagtattgtcaactatttgacaggcactattctaggatatattagtgatcaaggagacaaagattcctgcctttgaggagcttactttccaacagagggaaacaggcaataaacagtgaacataacacgtaagaaaatcatatagtgtgttagaaaatcaacagcatagaggaaaaaagagaaaaaatagcaaggtaaatgggatcaggagggttaggcttgggaaagagcaggttgcataattaagtagaggggtagagataggcctcttggagaaggtaagatctgagtaaacctgaagaaagtaagatcgttgtgaagcagttatctggaggaggaaagggcaacagcctatgcaaaggtcctgaggcatgatcatgactggtgattcaacaagcaggaaggaaaccagcatgactggagtgatgcaagcaaatggggaagtaatagacagatgagagagattaccagaggaggtcatcatgttgggccttaaagactgggccgggtgcagtggctcacacctgcaatcctagcacgttgggaggctgaggcaggcagatcagtggcgctcaggagttcaagactagcctgaccaacataatgaaaccccatctctactaaaaatacaaaaaattagccaggagtggtggcaggctactcgggaggctgaggctagagaatcacttgaacccaggaggtggaggttgcagtgagcctagatcacaccactgcactccagtgtgggtgacagagcaagactttgtcaaaaaaaaaaaaaaaaaaaaaaagactggagcttttccactgagtgagatatggagctatagcaggttgaggagcggaggagggacaagatctaacttacattttggatggatcatttaagctgttccactgaaaacagagcctagtagatctacaattattaacgaggatgatggtgtaatcagggtaaaagcagagggctgttgaaatgtagttgatttccagatcagctaaaggcagagccaacaggatttccagcaagttggatttcgggcatgggaaggttttagcctgaaccactagaacgatgtagccggcactgactgagaaggtgatcactgtgggtagagcatatctgatgtgaggaaaggaacagaagttcagttcagtgtctaaaatgcttgtaaaatggccaagcagagatgtgagataggcagcaagagattcacatctggagttcaagggaggggaccgggtgaagatatccacctgggagttgtcagtatgtagatgataagaaagtcctgagcctgggtgaggtcttgcagtgggtcaatggaaataaggagaggaacagaaacagagacctatgggcctgcaacagggaggccatgctgaatagtgggacatgactgcactggcagcagaagccctcgtttccagtgccctgtgcagctaaccagccatggagctgtggtccaattacttaaccactctaggtcacagttttacatttatagaatggtagcagtttacctccctgaaagcggaggtctagatggatcaccaatcccagtctgtaaggaggtatgcccttcagccattagagctgaacttgcaagcaaggtggaggattaagcggcattctattctacttagagaatattgagttttataaggagttgattcagatacttcagtgaattggaaataatttaaaccagctgaattcataagcatctgttatatctgatccattttggatttagggctcttacttgctagatattttttgtcagttaatgaagtaaatgttgactttttaacatattttggaacaatgtgtttagactaactgaccacatggtctcattttgtcatcagagttggcctaacaagggtccacccagtcccccttcccacacatataagcttgtagctctattgaaataacacctcatctcagaaaaacaataataatttctccccagcgtgcacctattgtgtgccaggggttttataaacattatctactttcttcctcacatgccagtgtggtaaatgttagtatcattgctatgggtaaagaagtttttaaaaggaaaacaaagaagttaataaaacaaaaaccttgtccagagtcccacagctgggaagcgagcctgggtcctttgccctgcagcaggtggtggtgctgggaagggaaagaatatgttagagaccatatactcctcctcttcatctgccgtgctcagagcagtcacttcagtgggtagccagggcaggggtcaagggcttaatgacaggccgagcactgaagccacgaggctcatgcctgtataccttggctccttcctcccaaaccagcccaagctcctctactacctttccctttacagctttcccttgaaaactgtaattaacctcaactttttatgctgtaaaagcagcttattctcccattcaggctacctccctgcttcttagtaatttgtactaattattaacagacacacatacacagcagcccaatgcctgcagcagcttccacacctcagtgaagcatattattgtccccactccagaggagagaatgctttccttggaaacagagaaggttctttgggcaaatattggttaccatttggtatacgactgtggaatgctccttcacttacgaagtgcttgactacaaagtccattacattgctttgactattcctaagactaccaaagaaaaagatgttagcccatgagggccttttgaaacaatgatgataattcatcgtatgttgagtatctattatgtgccagatatacacagatatattagctctgatccttaaaggaaaaaaagtgtatacttgaaaatatatataaccaacttatagatgatggagctatgtcatagaaacattaaatgacttacccataacagcacaggtcattgctagggagtcacagaaccagaactttacacatttttatgatacttcggtggtggaaacttctgagcttgataggagagtggatgcaagcacctccgatgctgaggatctcaaaattagtgtggctcccaaaataagagattgtatcttaataaatccaaatacttgcaaacagaatgatctgcttacctgctccatgtggccttggaatcctggtctttagaagatgtaaacacaaatagaattcagcacagtagatgtcttggatttggtccaaagaagcaaaccccattatttcttcatcttgtgccatctcctcttcccccaaggaagtcccagcccctcatctaaaccaggagtcagcaagcttttcctgtaaagaaccagaaagtaattaatttaggcttacgggccatatggtttttgccccaactgctatagtcgactctgcctttgtagcgggaaagtagccataggcaatatgcaaattgatgggcacggctgggttccagtggaactttatcaaaacaggtagctggtccatgagggcagttttgtaacccctgaaaatcttccatgggtctcctgctccacataacccttggtttgcgcttaggacccctttcagtttcactctatgaatagaattgatgaggcttttgcttcctccaccagctcattaatagagagctcagatgccatcaagctgatgacactcctggagcctttcccatgttcatctccttccccattttaatacacttccattcatcattctctcttgtttactgtcgtgtagcacttttcactcctggtgtcagcgcttgtagacaaaccgtaggaggagcatctacatctgctctcagctgtcttaatgattaaatgtttatggttactcgctcttcataataactatataggctaggactggctggtttaggccttggtaatttctacctttcaaattttaggatcgttttctcatagagactctttcagaccttggcaatatcttgtgctcaatcaatttgttcaaataactggaccgaagtttactgtttatttattcatttggcattgagttgttgagcgcccaggtggtacaagcattgcgctgcatattggggtggggaaggagaaatgagggaaacatggtttctgccctcaacagctgcattctccatcctgcatcctctgtctcccacatacttataattagtcataagcaaccaataataataaaaaaaagcaactttgttcatggctcttactgatttgcctgaaattgattaatgattttgtggggaacaagaactaatattcattttaatcactgaacttcttcaagaatgtttggactataaagtgattatggagtaatgtttggtcctcacaatccaaataccaatgatgtattaaaacagtttttcaataacagctatccagtcactgcttcatatttatcagccagtgcctgatttcagcagattctattaaaaccagagaattcaggcagctgcttggattttgtagcaatgggattttattcttatttgcaaggtgacttggtgattttcacagtttcagatctcagatctccactgtgtcaaagtagaaatgatcaaagttctggatgacatcccttctatagtggacagcctttcttctgaatccctgagtgggggtggggaggatccccttgtgtttaaatagatcaaatagtgggtgggcagctcctctgcaggcagtctctcccagggcccagtagacatccccttcattagagtgagaatgggcctctttgtaactttcaactgtgtgtttgagctgacctgggacctgtggtccctcacaactgcttctgaatcatttatgggcatttctatgccacccacacttcagatatgccaattacttgcagtctcctgaactcctctaggccgtgcttttgcatgtttaattctgttctcactctccacattcatccatgtggctaatttatttcatcttttgtgactcaactcaggtcaccctttccctcagtcactctgcatctcctctgaagtctgggctggatggtcccctgctgtgcccccacaatcccctgaactgctctctgccaactcactcaatcaacactgctgtcatcttctatttatttaccagtccacccacagatgttacatccccagaggaaaggaaccatgcctttgtacctgcagcccatgtatagcacccagagatagtagtgtgtcataaatgtaactggctggccaaaagaaggaatgagtaaataaatacacatcaggtcatctttgacttcgcaaagtaggcttttatatattttaaacaatgggaatttcttatcactgtactgtattctttacatatatttacataaaatatattctttatatgggaatttcttatcactgtactgtatcctagctcagctctgtttcttctgtcattttaccgagaatacagtttacaatttgtaaagcatgcttcttgaaccattgtgcctagaactcatctcagtaccccagatctgcacaggggacacagggacttggatcattccctcctagtgatccaggctcttcattttcactaaagtccccatttttttctaggattcatggtgcagacaaagacaggcccaggcttcaagcttctgttcatgcatacctgcagataacccaggatctttgcaaagaaaagatatgctcctgtgaaaatgattagaggccatgctggtatacaagaaggtgctggggtgaggtgtgattcggaatgacagtgtgtagacagtccacagcccagactggtgaaagaagccttccaagagaagaggccttgggaaacataggcttaagcaatctggagggagtagaggagccctggagagaggcattttagacaaagaaaagagcctaagcaaatgtctgctggccaagatgtggtccccggatttaggggaatgtgagagattggaattgacttcattatgaaggacctgtgaatctatatttaagagttttgcctttgtatgatgatagtttttaagaaaagaagtgtggcgttgggtggggtggatggggaacatcaagaaagaaaggaggctgcaaaagtccaggcacaaatcatgtgtttaataagataagtagcaaggagaaaaagtcaccttttaagggcactcacgatgagaaaaagagtcatgcttctggaaaacagaagcaactctctgcacatcagaggacccaagtgtgcagatgacagggactgtagaggtcagcacagaaagtgctggagagagtgacagacaggagaatggggctcatccagagtaggtgggggggatgaggacacaggggctgctctgcagggagaaggcacatgcccgctctgaatgctggcggaaagtagctgggggatgcactctcagacacagggcaaggtgagggcagaagtaggtgtggagggcagtccagaatggcctctacctctccagcagagtggacacaaagccttttgcctgagcacttgaaggaactgaaggggagtgatgtagaacaggcactttggagagtgtctagggagatctgagtcaggagagaaaacagaacaactcagcagaagcaagacaaagagaggcaggcagggggcagatggatgttgcctagtttgcgtctgctgaggtcagagacttgaggggattttgcaaagctggatgtgctatgttatttcacctctgaacccttggggaggaggactagagaatgacaataagcttcctcgccagtccctgagcactcagtcatttccctgggccccttttttcagagtgtggccacctcatagtccagacctgaccctacattcccttggcccagatcagacttcttgtccccatccagagggatggcctggagctgatgacaacttctagcagatatgcaggaccaagaaatgatggggcctgaatactccagggtggagtgggctgggggtgtagccttcaggaatgggatagtgaccctttcccttgctttcttttaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacggtaagggtcggggagggcagtggcataatcacagggcaggcagtgtgggagaaaaagtagccccaaagatgctgcactagccaaaaatgctgatctccaactggattccagtggaattcccttcaaacggtttgcctcccagtagggccatgtagattttcctgatgtctggctcatttctctcccaacgcctggttggatttgcctctgaagggtctcttgccatgtgtgatcttgcatttcagcagtgagactcatacctgtctcatggagccagtgtgccctcttgcctaggtatccaggtccagatgcctctgtttcaccctcacgcccacttcactcctctgtgcttatggtctgaaagctgagctcatggcctagtttcatgagccaaggtcttcagggaggaaatggagagacaaaatgtgggatgtggcagtctcatgcacctgggatctcagaaatttgaagcaacttcacatgtgacccccagtacgtcctgctcggatgtctccagagagaatagccaaggtgtcctcaaggccagaaagtctatcaccataaatatacttctacctttgggttttattagttccctattatcactatctgccccactcctctgagaccacccccagcaatagttctgaaaaatctgatttcccagtagcctcagcattgtgctcaagtgatctatctgactgtgcctaccactttctctctcttagctagccatttaccatagtttatgtaattatttgtgtatctgcctacctacctatatatctatatttattattcacttatgagctgtttcctgatagttttccaaatgtcagtctattcctgactccccaaattgaaagctttccatttttccttcattaattaaattatccataaaacagtctgtccttatatagcattttattttaggccaatgctctcagtctgggtgtttgatagggtttgagattttatcttgatgcacattgtattttttaacaattttgaaattaattggaaacttttaaaatcagttgggttcttatacaaatcaggatgttgatgttcttgtgaaaaaattgtaagagaagccaatacttgtgggcactctggagtgaggaccttgccttaaagctgagaggcagctgtctgcatatggtacccaccacttccaatatctctaacctggatactttgatgtgaaacgtctggcccctgtaggactggagtttgcaatctattgtgagtttatttgaggtgaactttctctcatattttgaggatggtgagatggggtagagaggtgagccagttaattcaggttgataatgctactggtatgaaaagaacacagactgtcttctttttccttaagggctctgtcctccactttgcacctcacttactgtctagatttataggcactctggcatcaggacgtacacaggattaaaagcccaaaactcaaaatgctccgagtgctggtctcttggcaattctgctagacaaatcaagaagtaacaaatttctcccaagaaggctgtttcttttacatttggcagttaagttttgcaaacccaagaggggctggttgtaagagagttctggtaagtggccaaatttgggagtatttgtcttacgactgaggttcacacatgggtacggattatgttcactggggcagcaggcctgtctgcagagcgaaggtagtcagaaggttgatcgatgatagggtcattggggcagggaggacctgtggaatcctgcccagagtcaatggccacactttgggctggtaacctccacatagggcagacccactatggccctgggctgctcttagctacactgttctgatttttgacgtagctgcctaatttttaaaaaatcattcaagtttcatattacattatgaagtttttaatttataaagacattgttaaggatgcttcattggggttccctgtgtatttttctatcgccaactttatgttttaaatacatatattacagaaagtctcagctgagggcaactgaaaattttccttcagtctttaaaatcgacttccgtctttaaaattctagagaatgggaggcttcaagaaccaatatccttgttcttagaaatctttctcctccaacatggttgaaggacagttctcaaacattggggaacattagaatcacctggactgtttgttaaatatgcagataccctgctcttcacccagaggatctgattcagtagatctgaggaggggtctggaaacagtcatgtttaacagtcgggctcaggtaattctgatagctcatgggaaacctcactttaagaagtattgtcagtgggcatggtggctcacacctctaatcccagcactttgggaggccgagacaggtggatcacttgaggttaggagttcaagaccagcctggccaacatggtaaaaccccatctctactaaaaatacaaaaagtagccgggtgtggtggcatgtgcctgtaatcccagctactcgggaggctgagacattagaattgcttgaactcgggaggcggaggttacagtgagccaagattgtgccactgcactccaccctgggtgacagagcaagactgtctcaaaaaaaaaaaaaaaaaaaaagaagtattgtcattagggttgctagataaaaaataagatgaacagttaaatttgaatttcagacaaacaaaaattatgttttagtgtaagtatctcccaagcaatatttgaggcatacttatactaaaacctttttcattatttatcagaaattcaaatgtgattggcagtcctacattcgtatttgctatagctggcaactctaattgtaatagaacataaatagcttgacttctctatgcctaggtcctgaacattaggtaatagttctttaacaccagtgaaagcataaccaggacaataccaatactagccagctggcccaaattatttgtatagattaaagaaaagagatttggtatttaggacacctatgatagagcagacagggtgaaatgtgcttcatatgatttgatttttttcaacagacaggaagtgtgagggtcagaaggactaaatcgtgtgtccagtatcacaaagcttgcacatggtaacgccagggtttagatgagttctgtctgcctctatgacctgtaggcttcccattccactgcataattcagcatggttctaacatttggcagaagccttgatcattttcttcttgagcgggaactcagagtgctgggccattcatttctcaggcatttctttgtcctccacagtgcctggaggtagtgctggctgactgcggatactctttaagtatctgctcaatgaatctattgactctgtgccatttcataacttcatgctttagaagatatttcagcagtggttttcatttagataagtcccctttattggaatgtccttaacatggctgacagttcttcgagagaccttccaattgagggaatgtagattgggaatcatctctgctccaggaatgtcatcagctatagttcccagattctgtcacggctgttttgttttcattgtcctttgtttttggttgtttttgtttatttataacttaaaaattgctgtttgttttggttagacttacaactctgacacatagaaactatcctctacatatatgtatatttagatcatgtttttggtattgtgcactgagtatcagctgtatgcaaaaggcacatggggaggattctaatgcctctttctcacctagatgattacaagtcagagctgagggagcagctgcccctgattgctggctcggcagcggccggggtcgtgttcgttgtgtccttggtggccatctctatcgtctgtagcaggtaggtcctccactctcacttgctctccttggacccaggaagcccctctccatgtgccgtttcccaggctgcgtggatcagatagggtgtgaccattcacgaccacaatcatcactccatctcaatccaagagcagcctagaattctttagatatttatttagctgggaaaaaattcatatgagagctgggcaaggctatgagtaaacagcatccatcctcaaacctcattttaacgaagacttttagccccctcttacacacaatggcttttcagagtgacagttgcaaaattgcatttgactcactggagcatccagcctgtgcataacccatcctccagttaagagagctcaggctctcagcagccagcaagagggaggcaggctggcaggagagaagatgaggaggaaagggaaactctgagttctgcagaaaagctggccccgaaagccttgtgattttttaatactgctgctactgccttcagtggttagcccagattctgtcacgcaaagccctgtagttggctccctcccaagcagttctgcaatgtagcttaagtgctgatggacatcctcttcacctctgcccccatcagcactgccctctgaatggggtcccacagtcccgccaggcttctgcaagaccttggctggaaagcagaaccatctgcccacaggagtgagtggtggtcaacaagagctctaactgcagcaggagggctgaagtgagagttgcccagtccctaatcctgggagatgccccgggtgagcccctatctggcctggggcctagatggaggtacctggaacagactggtgggtgtgccctgtggctgagagagcccctctttttatccacaggaaacgggcttatagcaaagaggctgtgtacagcgataagctccagcattacagcacaggccgaggtaagtagaaagcagagacccggtgtctgacccccacaggccactgagtcaagtgggctagtgctcagagctctctttatagccagactggctggtcccagtggcaagttctctctcagcccccagtgccttggccacctttctgcaggtccccaggggcaacaggctaccctcccatctgccgtctacctgtcatgggtactcattggatgcctggtgggtagattattgtctgcactgataagcccatataggacacaaaatgcagggaaaagattgggtttagcaagtcaatgaatcctcaaatcagactcagtgggaaaagatggagttctctattaacatcttctgccttatcttatccaattgagcagctggggaatttgttaaccaaattcacagataagccatagaacatgaaggtagggaattaaaaagatagcagagcccaagaggccaaagtgctgggatatctcccaagtgttttcctttaagcagtacctttaaaagtttttctcactcattatcctctctcttttataaacctatatttataatatttttataactaaaatttcttttcaccaaggtgcaacataaagttccctgtcacactcattttctcatctgtataatgacaacattgcaggatctgagaaaggtctctctaggtcatttgggccaccttcctgcctccagaaagcagaattctcagatccttacagcagacacattctgtttctaaataattccttttgaattcgacagatgccctcagaaatctgtcccagcactgtgtgctatgctctgtcaaggcttcttctgtgagcctcatctcacctcaacccccttgttgcaaagtaaggctggtgcttcctgttttctcagcaattagcatggaaaacagacctcccaggtacctacacaccaaacctgtctccacaggggggttcttctgggggtgaacatggactcccaggccaaagttctcatggaccagactgcttcttctctaaggttacccaaggcgggaaagtgatgccaggatgttcacagcagcagctgcaccatgaaggagcttgtgttctaatgcagccaatgccgactcgggctgtacaaagggcacttcatagatgtggcttccaatctaagatcaagaccctgccaagggtttgcagaggcccaagcccctggcagctgggctgctgcccagggcacttattgctggagggagttgtgggttctgcactggctcgagcactgctgctttcccacggtgccccaggggagcccctaccatcagcagcccaagtgtgggggccctctaggccacaggcacagctcctgctatattcagagtcctgcttattcctctttctttctctccctgggccaccctgttactccattgtcactgatttcagagggatcaaccctgctgtgttctctttcctttcctatggccggactgtgtgccttgctgcataatctacaggatgcttctatttatgttggcctgtgcattagcccttccaggcagggccttaccttccccaactggaaaacagggactttgcttgtacctgtgattctcaagtgatggtgcactcaccagggtgcctccgtatttcctcaagggcgaccttcgtctccctgcttccctgcctctgcctcaggatcctgacattgcctccctgactcttgctcagggctggctctttttcatcatgagccactgtaaggtccatttcagatctggcatcctgtgaatgctgtggatgaaacatttagaggtggtcatgtcagtctgaaagtggagccaggaccataaggataaaaaattaggttcaaaaggaggaatctcacttcgaagtcaagagatatccaaagatgccttaggatgacttaggtgagagctccctttccaaaagcgtgcaagccaagccttggcttcactccttggctggggtatagaggttctccaaacattgggtggggtgaaactttgtgccctttcggctactgcaacctgagatctggctgttctcctgctctcgaggagtagctatgccaggccatcacatggtgcccatgtgcacaaaagcatgcttccaaaatgctcacagctaccttttgggggactctgttacctctcaggccaacagaggaagattttactggttcctgagatccatagaaaaaccaatcctcagtctgcagtaatagtggccttgctggaacaagggaggacagctgaaagaacattgttggccagctacatagtcgccattcctgggactcaggatggatgcagggttttttgtgggtctgggttcactcccttggcttccttggaagtctgtcctctttttaattcggtttgccttttataaatcttgtcatttccctctattcataactattctcttttgatccaaccttgggcacctggctcctctttgcacccaagttctctaaactcagtctcatgcattgaattgcatttgtgcgtttactcctgtgaatatccatttccctgactaaagctattactgttggagaatcatggtcaaaggaatgtagagctggcggatggctcagcacacatacaacagaaggggaaactgaaggctctgatggagggagggcctggccaaagagggggtaggggtagaagtaaggggttagggaactccctacattgggagttttattctggcagctctcttaaactcattgagtcttcacaaccactctaagagaaaggaactaatctaggagggttaagtgacttatctagggcacatgactaagtagcagaggcagactacacaccctctaagccggctgcagagcccatgctctttccacagcctgattatgaggagcagctccaggactaatcccagctgtctaagttggtgttttgtggctccccactctgaatcccactgcaggaggcagaaagattgataatgtctgatccgaatgtgtgcacataactatatctggaccatccacaggcatgaacttctgggggttgcagacagcaattggagctctgagatcttcctgaccagggagtaacagaaaaccagcagctccccagcttgttcattaatgcctgagagagcccctgcctttcttgcctgcaggcaaggcacaggacactacagagaggctggcagcccctcccctcccagaccttcctttcaaactgatgcaaaggctgaagaagaaatgacagaaatgtttgcaaacagaataccttctctagctagttgagacgtggcagatctagtaaatctgataacataatgtggcttctagggcactggtttaatgttcctcctcagaacctggagcacagtgaataggaatatagagaatttggatttgggtggaaagagactagctggaaagcaggttggaagagaagatgtgctgggtgtggtgccagatgctcttcatctgagcctatcatgcatgttcaagggtgggagggtggggatgtggctttccgagtcctggaagaggcagagaaacagtttgttctcatggtttttgtgggcccattctcagtaggtgctggctgactaacagttgcctggatgagatgatttaggtggtccaggtggccacctcgatgatctaggtgggcaagtataagtttgagaatctatcttgaaaaaagttccagttgattctacatttgggaaacgtagaatctaaaaggtgtttacaaagattaggttactacctactttgtagaggttgacacctccctgatttctgagttggctggaatgtgtaggggtagggagagtggaagataagagcttgttaaggggtttagggtcaagggctttcagaaagtggccctgacagactcacatccgtgtgcaggcaactgcagataacattacagcactactgttggtgaactttgggaaaagcacaaacaaatggggtatgtgcccaaagactttagattggcaaacaccctagttttcacatagggtaagagggcagagcacagagattacagaacaggagtctgaacttgatccctgccaaacacttggagagatgattaagcagatgagttctgggcattcacatttgaattcagtgatcactgggaacccccaaagtttcattaagaaaaaaaaatatgaggacctcgtctaatttaccagggttatacctttagtaaattcaagaggaattgcagatggagtgaatttttattttgaaaaaaatattttatggtctcctaagggaaagcatttttaagtggatactgagcttgtcttcctaccaaaagaaagtaggttagtgactctgtcagccaggaaggaagtccctggtgttattttagtccttgtcctattcaatctcttgtttgtttgattgttttttaaattcatgactcaggtgcaagcatagggaagcttatcgagtgtgtaggtaacatttggagagcataactaacaccacagaagatgaatcaaaattcagaactatccaacagctttgaatgctaatttgaaatctgcaagacaaaatgttagcaggataaatctggaatctcatgtttaggttaaaacaaaaataaagcagtgcaaataggagacctaacttgctgtttatttgtgtgaaaaaaatgagttagttgaccacattcttagtatcagtgatacatagctgacaaaaatccaagcaatgttattgatgcagtataatactgctaataaccaccagtattgcacacttactctgttaaacactttacataaattaactagtttcatccccctaacagccccatgaggtacattttgcatatgaagaaacaaagcctcagagagaacaagtaacctgttcagagtcttggaattagtgatttgcaaaacaaggtttaaaactcagatctgtctgactctgtggtctcgataagggttcagatcagaaaaggtgatatataaacagtgtcttgataagggttcagatcagaaaaggtgatatataaacagtgtcttctgtgtggtaagaacacatctagagtgatgttagttctgggatcccatttcgagaaggacattgtctgcaaagtagctgtccagaagagagcagcttgcttgtggagcagtggcaagttctgatctgctaccaaagagactcggaaatgccagtgttcagtgctgcagacacccaggcaggaacctggaagtcatcatccagcataatgccattatggcaaaagaaagatgttgttggcttcatgagattaaatggcaccatcaagtgcaatatcaaagtaggccagatttattcattgtaagtgcactgcttcctcactagagctgtccagcaaagagacagtctgccttgcagggaggtgtgagttctctgttcctattcaagcagagactagatagctgtcagtaaaggatgctagagagatttctgctttagacaggatattggacaaaattacacccagaagcatgtctagttccaagattccacacccagtttctggattctgggtggtgtctgtatttcagaactgcaagggacacagcatccagcccagaagaaatcacctcaggaaccaaagtgcaggtcaggtgtgtccctggaggagggagactggcaatttcggctccctcttctggagggtaaccagagcattagtcaatgaggagagtaaacgaagtcttattgggagaggaggaaagtctccttggtacaaaaggtggctgagtttacagcgggggcttattaaatgtcaaataaattttatgagctagattcacccatgtgtctgctgctggctgtaagccagagactcaagaaaccgtgttaactcttttggtcctgagatcatcagctcctgccctttgcttcccaacagctcctcagtgatccagaatcattgggccttgctgggaaggaccagcctgtccccgtcattgatacccacaaagcagagagatgttaagctttttttctgaaatagtttctttttttttttttttttgagacggagtctcgctctgtcgcccaggctggagtgcagtggcgggatctcagctcactgcaagctccgcctcccgggttcacgccattctcctgcctcagcctcccaagtagctgggactacaggcgcccgccactacgcccggctaattttttgtatttttggtagagacggggtttcaccgttttagccgggatggtctcgatctcctgacctcgtgatccgcccgcctcggcctcccaaagtgctgggattacaggcgtgagccaccgcgcccggcctgaaatagtttctttaagaggaagcagctatggtctactttccttctttgggagacagatgttcagtaataactggtttttggggcagatcccaaaaatgtggtaaaacccccaaacacaaagtgtcaggaaggtcctcctcccacccactgcttttccagcctgcattgtcctccctgaggttcctgtcctgggttcttcctcaagcactggctgggcacccatgacccctgctctcatggaaaaagacaaccacccagtgtcctggtcttagccctcagaggtcggtggggcagactatttctagtgcccgtcagccttcgctagttggtttactccaagaaactgcccagtcttcagccttcctgctaccacccgtgtgcctcccaaacccacaactccagctccactcttctgactctgtcttcagtccgagttttctgaccagcttctaagcacctgcatatttcatttgtacatccaacgtctaaaaccacatgtgccagcacctcttacaataggatttctttccaaaagcccttcacctggttaatagtgccatgtgattctagaggtcttggcattgacttggattcatcttgtccctccctaattccccacatctgactgctcatcaactgcaaccacatcttcctttgaaatttgtcttgtctcttctgctgttcttgttgcagtactccggttgaaaactgttatcttacacctgaattagtattacataacaacctcatagctatttttccaacctccagccccttccccacagcactgcatgcaaatgctgcagcttgccagcaagatgagccccccgatgccccactttcagtacatctgtcccctgctgatggaaccattgtcagctctgtgtgtctcatgacatcaatcctaatgcctctgtttggtaaccaaggccttcccatgcttctgactatcactgattccctccacattcaagctggtatcactctccccactcatgcactgccaggcctcagttagctgtggctcacgacactccaggctcctctttttccagtgcaatacgatgtgcacttgtcctttcaggctcaagctgagttctgatgttttcaggattctgaccctgaagactggcacccatagcctctgccttttctggtctctgcagcacttgcaacccatttccagatgtgggctcctgatccaagactatccagcactgttctccagttatttcatatcttaattgcctaaagaaacttgtgaactttgttttgccgatagtttccacagttcttagcacagtgctggtttggagtcctgattagtgttgaggaaaagggttgatcaacatactgaggcagaagattggatgaagtccctgtatgtaaagatctccaaacacataaaaccccttgtgcttaaatatctggaccaattttaggggagtcacaaaaatgacatcgtctgccttgaatccagaatgaagaacaaaaagccacactttctcattggtctgttcaaacctgctgggacacaaaaatattaatgactaaatacagcctaatgcactacctctgaaaccatactgtggaattctaggcatcctccaccagctgggaagtgccaggtttgtactggcacccctggagccatgtgggtattcgtgatctccactaagatgtccacggtattgattttgtacttcctgaatgcacaggaggcctggatagaagcattcactcctctccctccagctttcaatccccaaatatcacctactgtttaaaatgaccctttccagccctcttctgctcttccctgagaccctggctcttataaagggtctccccgacttttcagatacactctacatgtctacaacatccccagagacatgtcccagccttttcacttttgagagcatcctgatctactgatggaaggtctctgacaatgctcagaagtttcttctgcttcaagaactactccattccatgcaacaaggttctggacagtggctaaatcatttctccccaaacctaatatatttaaaggcttggttcatgtttaagattttataattctcctgagactatggtcctttaaggctgtagttaatctcaactatagcataagtgaactttgaggtcaaagaacacacatgactgcaaagtagatctttaatcaaaattaataaattaatagaacataaaattaaagatttttctctcttttgaggtactaataaacagcagtttaaatccatacataacatttttgtgccaaaggtatgtaacctatgatgacaataattggaaactataaaatataaatatgttaacaatatttatattaggaataatgataatataaagcattgtacggattactataaaatgctttacattataggtatatattacatctgatattattattactgccactaataatatttccccaacactcacaaatctgagaacgttttctgagccctgtctccaaatgtttggctgtgcctgactctgtagctgacttgaattccttgttcactgtctgatgattcattgcactaaacaccattttcctgataattaaaaactgctcactggcaagtgggagcaggaacatgctgatgtaggatttatgcagaaacacaaaatgagccaaaagacaaatgacctgttctgcctagctaaaggcttttttttcccctcatcatcttctaagatttggaaaggctagctatactgcaggagggaggtctaggaagatgcgtcattctgagatgaggcggatacaggggagcccttacgtgcttggttgagagtgctcaaccaagtcactctcccgatttagaacacagactgccgccccacacagaggagcaacaccaaggccaccttcccagcccaccctatcagaccttaggggaaagtcattgagtttgagccatttgttagaccaatgattcactttttcagtttcccttcttcaatgtgacaatgctttcctcaatttcaggggaaacgagtactgagtctaattgttgcatagatgcagccattaagatgttctaaattgacgttgcatcactactccaggcagccttcttggcttctggggaaaggtctcagtgacaccaatgcccatggccccagaacagcagctgtgacatcacatatatgtgtgcacacacacacacatacttcttaattctacaagctagcaaagcagcacacctctcttcgtcagtaaagtgcacccatcttcacagtgcagactttgttccgtttatgtgcacttatttgcgcattactggcccaaaagaatcctggcaccattaagagataagccctttcccttctgggaatagctccttccttgaactgattggggccaatatctgtaaaactcattaactcagaatcctttcccattcatccttatgtatgtctttacttgcaaaccattcattaccgcatattctagattgtttaattaatttccatggaagagttcctgtaggacagcttagcatacatcgttcaaaagcctttgatctaaaataacaaggtagttattttcgaagtaactaatataaccctaagcggcttacaacccccactgcccaccctccgcttgcttcctcttcctacctccccaaacacttcctagaacaatttactgatgatataacaagtctatcagtcagtgagtcatcactgtacatcaggcactgtgctaggtatgtcgtcagcaatatgttctttaatctcacagccactttgggagggagatgttaccgccctcataggcagaggagaaaaccatgctaagaggtgtgtgccgacttgtcacattacacggggctagtaaaaggtttgggggccctgacctcacctgtgggtcccagcatctgggctgtttacgtcctctcaccacagcacagaatttgggagaagtcatagcttgttaacgctgacctgctgtcccttttgcattctgagtgcatctgttgctgccagtcgcacatcagctgacttccacctgtggcatcagtgtttctttgcctgactgctttccctggccctggagcctcccctgcccacccgtacaacaggccaagcagcccctgaccaattgtgtggaaatatcacagctcccttgaccccagagtgggacaactctgaagcatgtgctaacctagacattgcttagatgtgaatctcaggggaattaggcctgctcaatgacccacagtggtcagtggcttgagaatgcgcctcttataggctgccttcctttccctatcttacttcccttctcatctcaggtacttcttgggatcaccacccagataagccacttactttcaaaaatcttgcctctagggctgcttctgggggaacccaaggtaagacagggtggcctggagatgctgacctgggttctctatatgcttccaatctggtttgactgttcttactcttcacttgttctttataacaagtcaaaaaggactggcacccccatctccatttttctctttgtccactgttattaaagcagaagtctcttcctacacacgcacatccctgatatccatcctggggactagaatattctacataaaggtgaggatctctcaatttcctttgtccaaatttcagtctatatattctcaagtcagtgtcctcccaaagctttcaaggagacttctagaatggtgtgaacaaccctaaaacaagtgactgggaataactcatctttcagaaaaaaactgttctgggcagggcacctggccctccttatcttaaaaaataatcccctcaggccaggcgtggtgactcacacctgtaatcccagcactttgggaggccggggagggggggtggatcatgaggtcgggagttcaagaccagcctggccaagatggtggaaccccatttgtactggaaatacaaaaattagctaggcgtggtggtgcatgcctataatcccagctactcaggaggctgcggcagaagaatcgcttgaacccaggaggtgaaggttgcagtgagccgagatcacaccacaccactgcactccagcctgggcaacagagcaagactgtctcaaaaaaaaaaaaaaaaaaaaattctcctcaatggtttgctgtatcttctgtcttcctttggattacactctagtctaatttccagtccttgcctgaattggtgaccaagcaacaccagtttaggagagctatagagccatcagaagttttttggatggaaaatgtcaaaactagagctgggggtcaccagggaacaagctgtagtggcaaggggtggggaacatgaagaggggggaggtgctaaaatggagctcatgaaacctgaggcctaacctcagccttgggccctagtcactgcacctggagcagtgtggcttttttaggcctgccttcccctgctgacctgactgtttcttgaatgagacagcagtacctggcagagaaagcccctactcttcccaaggctgtgatatcagaccttgtcatttgaccttcgaagccccagcctttccaccacccaccaccatgtaaacaattcctgtactttgcttaatgacgtatcaaacatgttgaaaaattacattgtgaatgaatgcattggtttcttgggttccatttcctttttttttgttccctctcctctactttttgaatgtattttttctgcagtgacaattctctactttgtccccatgcacacctatttatcttgccaccgtatatatcagtgacaaggtctatattcctttatgtatttctcattcaccattttatttgtttttcatacttcagtgtgtccgaaggcatgaagagtcaatcaccatttttctttcataccacctcattttttctatgtagactttgctcttttctctattagtattttctaagcttttctcttcacattttctcttctggtgtaccgtcttggcacttccatctccagatttttctaacagcaatttctctctttgtaaaaaaatccatcctcttccctcttacagccctgcaccacagccgtcagttataaccttaacagtggcctccactcaggaaagttgtcaagttgataaatattgatatctaccctaccattttaccaccacttttctgctaatgcatttggttggcatcagtcagcttccttgccttctgtgagcacccggtgtgggaactggtcccgatctgtcacttataagtaatctgttccacatttcaccaagagctcaaaaaaagaagaaaatatggaggagaagtagaggacagagaatcagtctagaatgacccagaaggaagggagatgaggaggcccagcaagaggaggagaggcagagaaaagttgcagcctggtgtgtaggagagctcctcccaggaatgcccttagtgctggggacatcagcagtgctgaatgacaaccatgtcctctttgggatgttaaccctgcttatctcctccaacaaggctccccagggatgaagatctacattgaccccttcacttacgaggatcccaacgaagctgtccgggagtttgccaaggagattgatgtatcttttgtgaaaattgaagaggtcatcggagcaggtatggctcttccctgtcttgtttctgttctcctggtgtccaaacatcttctttccaccaccctagatggtctctttcagtatgaaaagccccattaggaggagagcttctatcttctttctcctcagaagatgagtctgaactatctacatgtgtatctaggacagagagaaaacatcacttgggatctttggggaccttgaccatggtggccaagcttgtctgttgttgcagaaaagtcagctgcagttttatagattcagaaataactctggaaatggaccaccaaatgcagataaggtacttagttgagaaggctttgaaagaaatctacatttgtagtattccacttactaacaatgatatctcaatgggttaaagtcaagatatcttgccatactgtaagttctccatttcctatgtacatgaatttgaagacagaccatgatgaatagaagagagaccactgtttccagaagaaagtcaacctatcaccttcttttttttgtttgttttctttgtttgtttgttttacaaaaaatctatggtacagctggtaacaacacaagacgaatttcactctcaagaaatgtgtgtgccctcatccatcttcctgcactggaatagaaacccagcccagtgtaaaactcactgcctgagatgctctcaggaaatcatacctaagactgatctagaattttcatcttcctttaatgggttagtagctgagtcaatttggcaatggacctagacttattaatgtaaatgagataaaacatctcaaaaatcactaaaagaaatctcattcctgcgtcttatgaacctttttaaaagatgtgttaaatttgttttattttcttctgcaacattcttcgtcttttcttcctcttcaattcttgttagccattgtccaagctctcttcactaatatgctgtcatcttttttaggttcctagatctagaagtgctttattcatatcattattgggaaagccatggaattgcctctctcaataatattttaactcaataaaatatgtttagtcaaagtcttacagctacttcatatattatctttagggggaatgtcaccatctttctgttcactgctctcttaatgcactcaggggtcaaaaagccatctgtgaaattggaagtcacatttgagagtctgtcccattaggccgccatcttcctgctctggtttccctcttgaatagcttcgtcctcacacttctttcagcataagtgtggtgggtgctgggaaatgacacaccacctgctcccgccaacccctcaggagtttcagctgggtcaccagactcagatccacttgagtttatgcatatttcccattgacttttacattaagaatgttgctgaaccacgactttcacttctgtgcagataattttctcttcccctttagatgctgacatatttaaggatcatgccttggaaggctgggtaccagataaattggataactcttaagggctcagatttctccagtaaacatcaaagagtgttggggaggcgggctttcagtcctgtactctgtttgctcgtgttattaattgttgttatggcttgtggtaatggtgctagtgactttaatgttgttatttatgtcatgtgcttagagcgatgtgttctggactgtatttcatcccagagagcacacatcagccccacccccacctgcttttgtcagaggaggagtaaagagctttctcactttatgaccctactggatagttacaatttggggtgagttcaccagctgctggatgcctgtaaaaggacaattgatagttctgccccatccttcacctccatttgtgtgtagcatttgccagtgctgccatgttgtgcattctgctcagagaaggttcagtcttctccatgactcatgtgatattggggagaaatgatgcatttagtagtttctatgatgcccagtagcatgacataaagacctctgcccagttactctgcccagttaccattctgtagcagagacccatctccttgtaattcagaatatcccagagcgaatccttgtggatgttaacttactatgcataacttcatgcaattttaacagaagacactcctgcagagaaccaatttttctccaggtccttttctcctctaccatcactctcatttccctcataccctgccccactgaggctgactcttcagtgctaaaagagctggtgtgaaggtcaaattgttttaaaagtaaggaatttgttaaggtaagatttatgccatgtaactggcaatgtttctcttagccacttgaaatacttgaagcagggggaaaacttgggttgcaacatggcaacaaaacatgaaaagaagagtcggaagtcctttattcttcctttatttttttctctctccctccctacttcctctctccctcctcttcttccctcaggcttttactgaatacttcttatatgctggatgtggagttccagaggcgaataaacagactcagaggtctgacagatttagtgggaaaaactcaggccagtaacagttaattattccacaccatccacacaggcatgtattatgcaaagagcagcatccagcttgctgttcttggaggggctgagcatatcaggaaggctctgcaaagaatgacctttggcctgagccttcaaggataaacactagtagaaaaagtaagtttttatgaggcgtatgagagaatgagatagtgacagaagaggaaaactaaatgatttaagaaggataatgaacatgaccttccagcagtggacatgctatgctggacagcctgcagtagcttgcaagagccaattatgcacatctgtttctagccccatgtttagtgacaccatgttggtagcttgacatcagccatagtagaagtatttacatcatgggaatgggcaaatgctacaaatcctgagcctgccctctgtttgttctttcgtttcttttctcttttcttttcttttgctttcttttcttttcttttcttttcttttcttttcttttcttttctttcttttctttctttctttctttctttctttctttctttctttctttctttctttctctttctctctctctcttcctttctttcttcttgacatcaatcatagtgggagtatttacactatgggaactggaaaatgctacaaatcatgagccccttctttccttcctcccttccttcctccctccctcccttcctccctccctcccttcctccctccctccctttcttccttccttccttccttccttccttccttccttccttccttccttcctggagagctggtagttgaacacttataagcacacccccaccctccagactatgtaaagttatttcaaagaggttgcagaagaactaccctgcaccagctaaatatagagccagaggagaaggctatgtttgttgcaggagggattaagtttagagttcagaaagatctttattcattaaacattgtttctgtgcatgtgactgggggtgatgctggaaaaatatactcaatgcctaacaagtcctgccatgcaggggttattgtctaaagcacacacattcaatgccactcagtgagaggaaggcagtgattgagagctcagatgagggcccggagaatgtgtagccctggagatgggagagaaggcttgatggcaggagaggactcagggaagagggaacaaagtggcctctgaggttgtgaaggctttggatggactgacattgtgtgtcacatcctgagaacaaggggaaagaaagttgctggagagggattgcctgtgggtaagtactgaacactaaatctggagaatcaggccaagatctagagatccagaggctgctatatgaattttatcccatagaaaataggtttcatagcagggtgggtgaaaggaccaaggttctagcaagctgaatcctataaatgctgtgcttggattggactggaagagggggatgggaaacaatcgctaaaaccttggaggtgggaagacaagttatgaggttttgtttagatgttacagagaggctttgagatggttgatgctaggatcaaggctgcatttaagtgactaagcttatccaaactggggtatacccaaatgaatgtgatgaatggagtgactagtgagcttggtgcctggaggtgatggggagtcatagcatggaggctgtgatcagaaatgaggggcatcaggttaagggagagtaaggctgcctggcacccaggttgtggggagtggcagttgtgcatgtgagtgaagacccacggagggaaagttcagaaattgtgaggctgaaaagttgcatcagctgccaaagtttctcctaaagttgttgcaaatgttgatcaaagaaataaaaatataataattgtgagccaggtgtgatgccacccaagaagacaataataaatcattaattattaagtaattatttgtttaatgttcgtctttcctcacaaggctcaaagttctatgggagcaagggaatgtatgtgttttgttggtctggtacctggcctagtgcatggcacttaaatgctcaattaaatatttgttgtatatggcgaatgaaagtaggtccttggagggagaacatggcagttaaaaatctggagaactaggtagtgtttgggagaatgaagagagactggacaggtggcatgagatcatgagtcatttgatgctctgaaagtggcccagtagagtgaaggaaagctgactcttcctcttctcactgcagataatgagagtaattgaagtatcttcacagagggcagcaggttaccttggtatcttcagagagtaccagtttattgttaccatgagtctgactaataggcatcatgtcataggtcaactccaatgcattggttaattctggtcagtttgatcagtagacttgcccagaacatgaatcagggctctacagcttgaatggcactcctgggtgcagtgtgaaacctgtataactgtatgcaacagcctaagcatgactgtcagtgtatgactacataggtaaaggtgtcactagaagttgttggcagaagaagacatgccatttgtattttcatgaataaatatgtctcctctgactctagcagctagtgattcaacatttccaggaatggatgatcatctggaagaaggaagcttgcagtgaaagggctgtgtgagaatagttgggatgagggaatgtgtgatatgtgtggatggggatggagtcatctgtgaggccaacaaaggcccgggtttccttggggatgatttggcagaaaggtcacttgcaagtttgacagtcctggggtcattcagagtgcagatggacagcatgagggtagctccacattgaatagaagttacggcaagaagcatttctaggagaagaaatcatagacatgtctccaggaacatagtcaaagtagctagcatctcttgaacactcaccgtgtgtctgacaatactctacatctttcacaagcatcgtcttatttaagtctcttattgctctgtgagttagagcatatatatctgtatgcatgtatattttcttgtaactggtaaggaaatcaacattcagaggatagcttgccgaaggctgtgctgccagttaagtttatgatagagctagaatttaaacccagctagagctgatccagatctggagaatgtaaccctcacatgaatgtaaccctagggctgttgcgtatagttacagagtggccagctgccactcttgttgctatggaaaagagcagctcagtatacagaggcattgcttccgatggcattttggaatacccattgcttctctctagcagttttgaatactcaagcctcgttgttgggaattatgataccatcctagaattcattattactctattgtgatgctacaaagactgtcccacatgccctggagagagcatggtcctcatagaataccctggtcctgtcttctggttttcttcttctaagtgtgatcagttatcagcgttaagaaggacaacaaggactgagatatttagcatctttaattataagtgcttgcttatgaaaataagctaattacatataaaatgtagatgtatgtatgtgtgtgaagatatatacactcatatgtgatatataggtatgcagttgtttaacaactataaaaagctacaagaaaagagaaaaccattttccctcactctctggatattaggtattgtgaataccgtggctgtcaagcaggttccatctcatgtgccaactcagtggcctggtaatgagtatctgaggaactctgatgaaagggtgaagatggttgtgatcaactaataatgtctatcctctgtgcagggtcaggaagtggtggagtgtgtaccatggttctgctctccctggtttagccgtaactcatttatcttgcacaagctagtgtgttaaaacttgcttgaaatcatgctttaaaacctagtttaaatgtattctttaaaaattccatttctggtgtaagcttgaattagtaactagaagctctgctttcctttttttccccccaaggcagtttttgacttcaaaatgctgcttttttaaaaaaagtgcaattgtgtgtagatttgagctgtgcataaccagaagctactgcttgaaatacctgctggcaggtgaatgtttcgttttcaaaaattgagaattcttttcttctgattttacatacaatagttgaggcatttaatgctgctgaagcactttttctctcttcctcattttgtcaaggaaggtaggaaagaggaattggcaaggagctgaaacttgcagggaataatttcagcagctatctgggatgaaatgcataggaattggttaaattaccctcagctgacagccttgagggccaggttctcaaatagatgaagcaggcattagaatcacctggaggctgctaaaacccaggtcacaggccccacctactgagcttctgatgctgtgggtctaggtgggttttgggaaagtgcattttctaacaagttcctaggtgatactgatgctactggtcaagaaccacagttcgagaaccactgctgagcacattggccactagactgacctacacctggatctgggtcctaaccaaatagatgtctggctataggagaggacccaatgtcagacacaaagatgtgtgccaatcaaagtccagtgggaccaaaattaggctggccacatttactgtcagtaaagaatctgtgtgaaaagaatcaaccacaaccactccccagcacagtcgtttcctttaagcgtctgtcttaaatataacgttaattcttgaattgctggaaatattttctaggtattatgaatttttattaaaaatgaaaacgttatggccatgatttggagctcaagtaaaacgaagctctttagagttcagatgatggcgaatcgaagtaccacagacatcaagtcctggccctaattacaggaaaattatcaaaatgcaaaaatagtttcttgtagatactatattaaactgaagtcaaagatcacaggcgacagcaatttcttagattgtaagtgacacagggtcttgatttcctgtttgttattaataatagcaatacgcccatcgactcctgcctctctataaggctgtaggttgtggtgtgctcaagggccagaaacccagactttagcatcctaggcttacctgaagacaccctccatgctcaggcacctggcagggaaacttcaccatgtcccctggcaaaaagctctgatgtgtcttagatcagtcaccataagtctcaaaaggctgcagaaacctacttttcctctcttttctcttccagtgagactcccctactctgcactccccctcccaactacctacttctgttttgtctttttaaaacaggcctggcatggtggctcatgcctgtaatctcagcactttgggattctgaggcaggcagatcacctgaggtcaggagttcgagaccagcctggccaacatggagaaaccctgtctctactaaaaataaaaaaattagataaaagtggtggcacaagcctgtaatcccagctacttgggaggctgaggcaggagaatctcttgaacgtgggaagtggaggtagcagtgaaccgagatcacatcactgtactacagcctgggcaacagagcgagactgtctaaaaaaataaataaataaaggccaggagtgatggttcacacctgtaatcccagcattttgggagcccaaggtgggcagatcacgaggtcaggagttcaagaccagcctggccaacataatgaaccactgtctctactaaaaatacaaaaattagccgggcgttgtggtgggcgccagtaatcccagctacttgggaggctgaggcaggagaattgcttgaacccgaaaggccgagattgcagtgagtcgagatcacgccactgcaatccagcctgggcgacatagcaagactctgtctcaaaaaaaaatagaataataaataaataaccacccacaagtgtttcgaacagtttgtagtttacaaagcactttctcctagacttctctcaacacactgttggtaaggcaagacaattggtcacttctttttattatataacaaggagaaagctaagttctggagaaatgaagggcccgccaacatccaatgtctcaggtgttgtttgcgtgtagacatggagcttcttcctccactcactaccaattttcctcccaactgtactcaggggcctacttaattacaggggcgaacataatctcctggtgaggattagatattaagtggcattctttgcagttggtgctttgaaaacctcctggcttggagaatatgaagacacttctttgccagacaggaaaggaattcttttacagaatttccattctttaagtcactgcagagcagatttctgagagcagtgacaccatgaccacgaaggtaaccaaccacaaagtccaccatgccctacccaaagaaggcatgtttatattttataatttttaaaaactgtatgatgagtttttagacttgaagaccagtcacaaagattaaaaattaaataacgtttcccaattaggaaagtagtttgattcatactgtcctatacatcttcattgatttcttccttccttcttttcttctttctctcctctcacatctataaagtccatactatgtgccaggacctgtgctgtatgaggcaggctatatgtgtgctttgctttcaaaagtattcagaagtacagagagaaatttcaggaatgccatggcttttggcagttcactaattcatttgaaaagagcttggatggtttaagcctatggttttcagcctgagcggcatgtcagtatcaccgggcagccaggcctggcttcatggacctgtgactggtgcattttcacagggccggatgttcagaaggacatgcacttggtttaatgctctgctgttacagtattgaaattctcaatagtttttgaacaaggagtcctgcacttttactttgcaccgtgctctgcaaattatgtaaccaatcctttgggcagcttttaaatatgtcaatgtgcaggctgtatccaaaccaattcatcagaatctctgaagtgaggcccaggcctctggactctgtaagtctcttcaggtgattccattgggcagccaactttgagaaccactgaggtagaacagaagttctcaactggagtctttttgtgtgttgtgggggacatcaaattcacctggagcacttttccaaactccacacactgataggtagaaactgataaatacactgatttccaaatattctgatgccacccaactcccaggcaggaggcttatgtgaaagacatctgcctgttaaacagtatcacttcttttgttctcacatggatattgagttgctatgacagtcactatatatgacttgttgggacctgcacatttggggcatgatggtccctgaactataacttcatatctatgtagctttattccccatgtccctgccaactgaaacatagctatctagaggcagtatggcaggaaaagatgggtatggaccacagccctggctgtaactcccagctgtgtgattgggacatgttttccttgtgcctcagtttccttattatttaaatggccatagtaatacctacctcacaggagtgttgtgaagattgaataagtcacacaaagtgcctagcacagttcctggcacatagtaggtggttaataaatacacatttgtgtgctgtctcctccacaaagaaatattaacacacctttaccctcaactatcaactctggcttttttctaaaagaaaatagagcccattattatgacaacaaggaagaaatactaaccaatattcttccattagtatacttaccaaatatgtaatttgtgttcattcagctcatagttatatatatatagcatatatatgctacgtatctacatgcatacatatatgctacatatatacatgcatacatatatctagacatatatacatacatccacatatacacacacatatgtgacaggtctgtattgtctagtacttttctttaaattttactcattttaattactaaataagttaagctattgtagtgtttgtctatagaagatgatgctgcagtaaatatatttttaacatacaaattcaaatagtagtacttctatttctggataaagcagagataagaatcttcagcagtttgtaacccaagagtgagcaaggcaaaagccaaacatataataataaatatgatacaacaacttttactggcatgtctgctatgtgccaagcaccacagtggagtggatgtgcaagctacaaacaggaatgagacttggtctgacctccagcagttcaccaaaagagtatatgattcaatgtgaaaagcagtgttgcagccaggtgcagtggtgcacacctgtggtcccatctactcaggaggctgaggcaagatgatcgcttagcccaggagctcgagtatagcatgagcaacatagtgagaccctgtctcaaaaaacaaaacaaaaaaaaaggagtggaagggaggaaggaaggaagggagggagggacagagggagaaaaagggaggaaggatggaaggaaggaaaaagaacagcccccccaaaacacatagtgttgtaaatgatatttatctgagtattaggtccatgttgaaatcttcctaatggtgcttaaccagcctctactccagccccaggttctatcaagttctgttgactctggagaagttttgcataacagtcctttcacacagcttccttccaatcttttttgcagcaagaaaacaaaaggaactcccaaatgaatcacaggagcaatgttaacttgtctttctaatatggcaagtaatttatctgattgctcagtttgctccatcattttcttccagaagtggaaagtgagagagaaagttttctcagcagaaagccatgtttcttctgctgcacttacaagtagacactgaactgcttcacatgaaagaattggaagtaaccaagccaaattaaattataaaataacttttgaaagcatgttaaacaggattcaacagatttttttttttttttaggcagctatgaaataatgtcaccataattgtttctactcttggtgactttactgtgaaaatgtttcaacgctgtggcatgcatggaggtgtgcagctcatgcctgtttggagaaataacttgctattcagctgccaaaagtgcagttagctgacagcctccagctgcagcaccttcagggtcggccccggctttcctgcagaggcccagctcttcccagcagcccccagccaatgactgagcatggcagggatgtgagggctgggctgcttttgcaatgggaactctgctctggctctccctttgggttagctgggatttcatcaggtctgcatggtgatcttgggctgtctccgcccaatcctgcttcctctcacttttgtctttcacaagtgaacctcttcccttcctaactcctcagtgtctgttttctggggcacccaataaacacaaatgctctcccagcagtgtaggaacataaacagtatacatctcattcagagggccaaagtacctgaacatgtctcctatcccctgaatgttcttgcaccagtatctgctaaaaatgaatcatgatcctgccaaagtgaaactgaccatttcatttcaattattcagctggcacacaatggaaaaattaagtgtggggaaaaacaaactcacatatattctgaaattccacttaaaacaaactcacatatattctgaaattccactttagttacccaaactatttctaagtaccaaggtaaggaatgtactttagtaatccttttgtgtttgccatgaactggttacagccaaaacaatatagttacaatgagagaagactgttttaatttccgccactttaatcacaattccacttggggcaccattgttctccattagatgacttccctcttgagtccacagactgagaaggaagaggatattaatggcatttttgctgttgcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcagggtaagagcaactcaggggtttgatgatgcacttggatgcaggtgaatgatggctggggagaggggttccatgagcacaacctaccaatcaggaatcgcctgatccagtgtgaatgggcattggagatgttagcagagatttgttgctaaaagaagagaacaaaacagggcttgtgggatcctcaggaggaggatggcatggagtagggcgttgacaaatgcttattggatgaataaaatgaatagagagggacaaagaatggccattggcatctgcatgaatcacagagattgaagagacttttggctgctgcacagccctgtgtgattcatgcagacatccgcggccatatctgcctttcatcagcacagccaccctcccagactgctctctgcatttacaggttcagaagtaaaacaggttgccattttctgatgcctgggccacctgccctctgaggaggcacttctgagtagggaaggggaagactgcatcacaagcatccacgggtatttctgtgattggcgaagattcccaaccaacttgcagcagaagtggggagttgctgaaggcctttggctgggagacctgtaaaagatcattgtcagaatatgcccaaagtagagccaggcccacaatgaaaccattttcatttctgtagggtatcactgagcacctagaggaagggtgaatgagaatggccatgatgctgatatctggggagtggaagctgatagcttcagccaggaagcagaagctgagagcagagggtccagtgggcagcatcaaagaatgggcagagccttctgagcaaggacttcagagtgatacccagtagctggctacacacattaccaaagcaaccaaacaatagctgtggctacagattaaagggtcagtcattgaaacattgctgggatcactgctctggccaggccctattctggatgctgtgcctatagagataaaggaaaccttgctctaatgctacgtaacaaatcatccccaagacctcagtggcttagcacaacaacaatttattttgctcatgaatctgcaatttgggccaggtttgggagggacacctctgatccatgtggagtcagttgcagtagctcaagggctgaggcttagaattgtctgaagcctctttcattcatatattaggtggtcagtgccatctttctaggtggcctgcttggacttccttagagcaagctgggtctcaagaaaaagcatcccaagagaggaatgaggaatctgtattacttttgtgacccagcctaggaaggcacatagtgtcacttccaacgtagtgacaggcccagatacaaggggagaaaacaggccccacattttgatgaagggacatcaactcaatgtcttcttaaacatgatagatgggagatcttgttgtgttcatcttagacagtataacctgccatcaatgtagtccctactcctgctagtacccaaagcttctagtaatcatttgcctatcttatactttttttccccataagttaagtacagatgtagtaagtgaagaagttcttaaatcttcctggagaatctagggaaggcttcaaagaggaggaagaatttatctgagattagagaatgaggaatttgccagacaagcgagaagcaggtaggtaggctgatggaacagcgaaacagtgtatatgaaggccgaagtaaatgtggacctatttggtaatttatcagctgctgcatggtagctccagcactcagaaacagagcttaggggctgtagtgtggaagggtagctgggggacttgtctagaagcacactactgaagctacctttgtacaacaggaacatgctttttgcccagtctgggtcactaggaagtagtggcttttgtttttctgagggtgcaggggtggagaacaactgatgtagattactgagcccatgtactttccctaggacagcctccttgagggtatggggttatgctttgtatttggaaactccaatacctaacacagtgcacacctggtaaatgctagttgactaaaagattatttctcaaacaaaaatgctagggagtggcacgagagctctagtcatcctgtgtgtacattatctctcactgtccttgctgccacacctgtcatgtcagtgcaatcattgtctatgctttcctggggacattcatttattatcagagatctcatgaagacagttgaataaacaaagttgaatgaagttgagttgaataaacaaagttgaataaacttgaataaaaggcaatgtgagaaggaaaagcattttctggaaccactgtcaagacccttttgggagtcatttatttcctaccagtcacctgattgtacttcagagagagtcactgcttgatttggggactgtgatcacactcccccgctggagtgtgcaggggaacagggagattcattctcatgagcctgcggaaaatcaaaaccccacactgctgctcttcctagggcctgttttctttttatttatttatttatttatttatttaagttttagggtacatgtgcacattgtgcaggttagatacatatgtatacatgtgccatgctggtgcactgcacccactaactcgtcatctagcattaggtatatctcccaatgctatccctcccccatctccccaccccaccacagtccccagagtgtgatattccccttcctgtgtccatgtgatctcattgttcaattcccacctatgagtgagaatatgcggtgtttggttttttgttctcccgatagtttactgagaatgatgatttccaatttcatccatgtccctacaaaggacatgaactcatcattttttatggctgcatagtattccgtggtgtatatgtgccacattttcttaatccagtctatcattgttggacatttgggttggttccaagtctttgctattgtgaatagtgccacaataaacatacgtgtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcatccactttttgatggggttgtttgtttttttcttgtaaatttgtttgagttcattgtagattctggatattagccctttgtcagatgagtaggttgcgaaaattttctcccattttgtaggttgcctagggcctgttttcatttggggctcaggtcacggaggcatgttggacaccagcatttctcatgttgatgagctgagcttgcaggggaagaaaacctgggggcatgagaggagcacgggaaaacagaggagcaggcatggtaagaaaggagtggtgggagcaggcagtgccaggaggagagggggaaatgaagcgtttctgactcctcacactgcatggaggcaggtaatctataaatctaatttcagccttactaccgaaccctggagcatagcaacattaattgacatatctgctgcttgataaaatcgaaaaataggtcatcagttcagttctacagggtccatcttctgggaagtaggataattttaggatcactactcagagaagaaaggaaaaggattagtcttcaatttctggaactgtttcctcccctccaacttctcctttcccactggtcatagcgtctttggagagtggctacggttctagccctgaatcagcatctgagagataccattatgcttcaaccacacattcagtagatggttcattattatcaattttctaaaaattattgtgccatggattatatagcatacaaatccataattaaatttttccttcttgatactcaaattcaagggattcaacctggtggctcttccgtaatattagaaacaattcggctgggcgcggtggctcacgcctgtaatcccagctctcagggaggaaagaggctggaggatagcttgagcccaggagtttgagacctgcctgggccatatagcgagaccccgttctccagaaaaaggaaaaaaaaaaaaaagacaaaaaaaataataataagcgaaacaattcctgaagctgtgaccagtatcccatggtttagttaacatggttcttgacatgcgccataaggccttcttgcctaaagcttggctttgtggttgctgctggttctttcacagataatcataactggaagactcttgaaagtcgctgagtaatgtcaaacggggacatttctcatcagagaagctcattcatgggctgcagctagaagatagcaacccagaagtcaggaagagaacaccagattggaagtcctgagaccaaggttctgctttggcttctgctgtgagtcaccctgtggcctggagcaaacctgttaactcaattttccaatttataaactaaaggcattgagctagatgagcttgaaaggtccctttcagttagaaaaaatctatgattcattttgttcaaacaaatcaaataagagtttcatttcctgaagtggattcgtcaatgaaagttgaaatacctaaatccttcctgtctaatataagggccagcaagtggcttcggtgcatttgcagaaaagcaatttcagcagaaagcacttcatgaagggaggaaagtttaaatcacctcacctagacctgtatttcttctctgtactatgtttttactatgtgctcagcatggagccaggttctttcccaaagtcaccaagaaataagttagtttttttttttcttatcttgttcatctttgaatgctgctgttcatatctctggaagttctttttggagaattatgccaatcaactgagcatgtaacagttaaacatgccagaaaaatcttaatatgtttttatctttaaatttcaccaaggttacgaattcagcagacatgaccctacatatcttgatatgtggttctcttgaagattctaaagaaaatgtattgcccattgcagagtcagcatattccaatggcaaaagcacaggataggagttagaagacccagataagagtagcatcactaatccatcatggttcttctccctgcaaagcttatgcacagcctttttctccacacagcgtttgaggccaccattaccagttgatcggagatgggttgtcagtggagaagtgatttaccattctgaactttgattactgttataactcaaacccacaccgtgatttaaggctgatcacatacattttctggacctcctttatcttgtctgtgaaaacaatataatattgcctgtcttgcctactgcacaggactggttttaaggatctaaacatattctgtaagtattatgtgccattcaaaagtcaagtgatggatgctaccaacatttgtgactaattgagccaaagtttaggcctgcatcattaggtcccaaccatctcctacaattacaggtgcctatctgttacctgctgagctcagcatgtgctgagtagtgggctccccaaggacaatgatcccaggatgtttcacacacacacccaggaagccatgaaaacccagagttctggtcccaggtgtcctcagtctctctcaccacactcatctgaggtacaggggaactgacttgtgagccgttacttaggctctgctgatgttagcagggatcattgctaccgtcttaggatacacaaggcactgagctagggcctttcatatgtgttatctcatttagtctcaccagaaccctatgaagaacggacactatgttcttattttacagatgtggaaataactgctctggaggttaaataacttgcccaagcccacacaaccactaagctgcagagcctggatccaaatcaggtctgctggctccaaagcctggacctttcctcatttcttggtcttttttgaccccagaaactataaaatttataatctaaattttaaaacaaatcagataataaagaagttctaagaagacttaaatgacttaaagcaaaaatgtagacacattgctgcatgcactttcaacattactgttctcaaagttgtttaagccaccccagtgctctccccaaatgccatcttttttagggagacattctgtatgtgtagacactgttgcctatacttacagagaggaaataatagactgaattgaaaaaatacaatccatgtgacttgtggctgagatacacctctgtaatatatagaaattgcatgacaactttttgaagaagcaaatccccagagacctacttggagaaaatgcttcgtgctagcaacagcctgcctaacttcttgagaaggtgttgattgaagtgtattagtgagaaggaagatctgcatcactcactgcacatccagctcacagatgggcaacgtgctgaaaaccagtcagagtttccaaaaagtagctctaaactttctttttgagttgcttagaagaatctattatggagaaagcatacattcaatctcctgggcaggtttggaggtggttaaagttagagttagaaatagcctggaacttgaagtgtgtcaaacacaatatgtttgggggcccttctactggcagacatctttaggagggagaaagtcaatttgctctattccttcaattgatcaaggagcataacccccagaacatggatccaggcttgcaatcttgcatgaggaacagagtttccaacaattcatgcaatcattgttagactttttgattgttgttgttgttgctcctaagtagagtatttttataacaggtcttttatttttccttgcttatttttgcatagaaaatgcttttgcaggagcatatgcatgtgagtgcattgtgtaacatctcgcatacagtagatgctcaatgatgggagctcctctcattgtctatgctttctgcatttcacataaggactctgggatgcaggtggtggttgccttgcagagtgcctatgtttagcagtaaacatagactagaccccaggtgtcctgcttccatctctcctccagtcagagcattctaatgactaggctgtgctctacttatagaacataattctcagccctttggggagcatttggggctagattagatgggaaaatatgttcttggcagtatagcttagggtctactgatttaactggtgtgtgcaaagtcaagacccaggagccttggggagataggaggaagacactgttttattcactgaagagtctgttgtctaaccagagggagggcatccacccaagaaactctgagcccacaaatgataggagagaggacagcactgcaggttgccatgaagaggagcagcaacagctcccattcactaggagagttccctgtgccagacgctgtgcatgaggttcccctgacccactgtccctatgaggtaggtgtggttataccagtctaagggctgaaagccctgggattacccagagaaggtgctttacatgcttgattttggaaagaggaaaagatgtattcatcattcattcaacttgtgtttattgagattttctatctaccttaaagtttacagcactgataatactatggtgaccaaaaaggacagagttcttgtcctccaagagtataaaatcaagcagcagagacagacagacagaaagacacacacacacacgattaaaacttgtgatatgtgctaagaagactaagagtatgcactaaacatttgtcatgagaaagtgctaatcatattttgggggggagttaaagggatgtcctctctaagaaagtgacatttaagcggagaactgaagggcaagtagatgtcgattgttggagggaaaacagagggaatagcacatgttgagggccctaaggcaggaagagtttgtcttggaaaagaagaaagggtgccagtcactgtggctttagtacattagtgatgggtatggtggcctaaggtaaggcagtagctgatcccaggcggtctcatggactgtgctaaggagtttggagattttccttaatgcaatgggaggctattagatatttttaagccagggactgacatggcctgatttatgtcttaaaaagatggctctggctggagagaatggattggggggcgggcaaggaggctgttgtaggtgatggatgatggcgacttggttggactggcggcagtggagatggaaagaagtgaatgggtttgagatgtaatttggagacaaaattgacagggcttggcaaggagaagagaacaaaacattcaaggagaagaatgggggatgggagtgggaagagaggaggacacagtgagtggcttggcctggagcagacagaagctgacaagcagcagggccacaacatctctccctctgcttaaccattgaagcccgtcttgatcccaatgccctctatgtcttattacagcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttggtgagtccttcttggcattctcaagtagaagcatggcatgagttaaaggggactctacatggctgggaactgtgacagggcacactgggagggaatggaacctgaactgagctctccactgaaagaccaagatgccaggaggaccatccagctgggagaagccatagcagctggttgttcaagcaagaaagcaagcatttgggcttggactgtgaggaagggtcagtgtctattatgaagctatagtgttccttgggaagaggaaattttggaacagatgatttgagggaatccaagcaggtagacactggtaccagaggcatctgtcagcagagagcagaccccaggcatgcatgaggccttcagtctgcagctgggttgggaactgtgtcactaggtagactcttgatccccttctctcttctctctatattgcttccaaatagctctaagtaccgtcaacacgatgagtactcttaaacttgtatttcctgctcagcctccccctctacattctgagcagctctaattatctatatccaactgcctagttcacacaatttcatttagaactttaacaagccgaaaatagagcttgggatttactctccaatatcctctccctagtccctccatctcagtagttggcaccacttaactaaagaatgaaacctaggaatgatgtttgatttctttctgtgtccatttattttcaatccctcagcggcccccatagggtaccaaaaaatctatccctctttccatctctactgcccccaccctattccaaagcaccattccctttcacctggattgttacagtggcttcctaactggtgtccctttccttttgtctccttacatccatttcaacagcacccaaagtgactgatctacctactaacctgtctatctgtctatcctctttaaacctgcaaaagtaatgcataattattacaaaaatcaaaacaatgcagagaagtaaaaggaaacgccaattagaatggcaatcattaaaaagtcaggaaacaacagatgctggtgaggctgtggagaaataggaatgcttttacactgctgctgggagtgtaaattagttcaaccattgtggaagacagtgtggtgattcctcacatatctagaaccagaaataccatttgaccgagcaatcctttactgggtatatacccaaaggattaaaaatcattctactataaagacacatgcacatgtatgttttttgcagcactattctcaatagcaaagacttggaaccaacccaaatgcccatcaatgatagactggataaagaaaatggcacatatacaccatggaatactatgcagccatataaaagaatgagttcgtgtcctttgcagggacatgcatgaagctggaaaccatcattcttagaaaactaacacaggaacggaaaaccaaacactacatgttctcactcataagtgggagtcgaacaatgagaacacatggacacagggagacatcacacatggacacatgtgacacatgtgaacatcacacactggggtttgtcagcagatgaggagcaaggggagggagagcattaggacaaattcctaatgcattcagggcttaaaacctagatgatgggttaatgggtgcaacaaaccaccagggcacatgtatacctatgaaacaaacctgcatattctgtgtgtgtatcccagaacttaaagtaaaatttaaaaaaaagaataaaaaataaactaaaattcccctgaggcagggattggtaaactttttctcaaacggccatctagtaaatattctaggctttgccggctaagaggcaaaatgaaagataccatgtagataattatataaccatttagaatgtaactaaccccttaaaaagttataaatatcattcttagctcatgaactatcaaaaaagggaccagccaggtttagctttcagaccatagtttacctgcacctgccctgacgcattaattttcaacaattaggtgtgccttctttgacatttttctttttggtcaaaaatttgaaaatttttattctacaaaatttggatcatattatgcctattcctctgtgatctggggtgtcttttgggcatcattgccgccaagattacttttatgaaagttagcaaacattcacactctaccaggagtgtatggggccgggcttcagcatcctcaccaggcctggaggtgatccaccctcacaaagggttgctgcttcaacaatgaaaaatgatgcctcatttttaaatttcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttagccaggctggtctcgaactcctggcctcaagtgatttgcccgcctcggcctcccaaagtgttgggattataggcatgagccaccatgcccagcctctttcagtttaaaatgtataattgaattattgttgactatagttaccctgttttgctatcaaatactaggttttattctttttttttttttttttttttgggtatttaaaccataccccctaccaccaccccctaccaccacccttcccaacctctggtaaccatccttctactctctatctccatgagttcaattgttttaatttttagatcccacaaataagtgagaacatttaatgtttatctttctgtacctggcttatttcacttagcataatgaccttcaattgcatccgtgttgctgcaaatgacaggatctcattattttttatggctgaatagtactccattgtgtataagtaccatcattttgttttaatttacattttcaactgactgctagtgacattgatatcttttcacatggtgcagggatttgtgttttctattgtttgtacgtgtccttatctatttttctatcgggttgtttgttgatttctgagaaacttatagaaagtctttttatattacagacattactcctttgcctgccatgtgtgatacaatttatcttttcccccatctgttattcctttatactgtttatgataccctctggcttataaagtggttaacattcatgtaatagctatgtcttcttgggttacctggtttattttaaaagttatgttcactccaaggctataaaatatttcctggtttcctgggctattttattgggaagggggtttgttttatatttgaatatttagtacctgtgaaatgtatttatttttcccacattttattttgaaaaatttcaagcacacagagaacttgatagaatttggcagagaacagtcatatgcctaccacctagattctggaattaatatcttggtacatttgctttatcatgtaactatccgtctatccatccctctgcccatccatcacaccatctattgttttgatgtatttccaagtgatttgcagacatcattacatatcacccctagccattttagcatacatgtctctaacatgtatttgtttatggttcttttttaaggtaaagtgtgcatagagtaaaactcacaagtctcaagtgtacatttatagagtttttaaaaatgcgtgcaactgtgtaacccaaactttcatcaagatacagaacattgccatcaaaccaggaatccccctaacctcatccctccccattgcatcctcacccacatccatacccagaggcaaccactgttctaatttttttgaccatcaattggttttataacttcatataagtggaatcatacagcatgtgcttttttgcatctggttgctttcacttgcattatatttaagagaaccgttcatgttgtgtgtgaagcaggagtttgttccttttattgctgagtaatattccatggtttatttgtccattcacttgttgatagacaccaggaatattccggaattcatttttgactatgtattgggaagtatattctcacactgttttgttcaggtgaacaattatgccagcactacttattaaatatattattcattttttattgaatcatatgtcatccttgacatattaagttcattatatgaaactatgttttgattctcaattctgctcttttaatctatttattcttatgctcaaccgtgttgtcctgattataataatgttagcaaaagttttcctgtctgtattctgattatagtaattttattaaaagtcttactgtaggttgggcatggtggcctgtgcctgtaatcccagcactttgggaggccgaggtgggtggatcacctgaggtcacgagttcgagaccagcctgaccaacgtggtgacaccccgcctctactaaatccaaaaaattagctaggtttggtgactcatgcctgtaatcccagctacttgggaggctaaggcaggagaattgcttaaacctgggaggcagatgttgcagagagccaagattgcgccattgcactccagcctgggcaacaagaggggagccccatctcaaaaaaaaagtgtcttactgtctgggtaaagcaagttatccttcattatccttcttttaagaaaaaaaaaagcttccttgactgttctcaaatatcttttctttcaagtgcaatttaaaatcttcctgtccagtttcaaaacatgcacatatacatgtatactcacatgtggattttgactgaaattctactctgtctttaggaagattaacatttcaatgatcctaagtcacctaaataatgatgtcagccaaatatacaatttacatatacacgacattaaaagtttctttggtaaaagatttcccacgttatttttctgtacacattatttggattacttgctgtgataagtgtctttgtagatgatagagcttatatgtttctaggcctaagagttctcaggattctacacagtgatatggccacctgtctcactatattttactatcatttctccacactttgccttttattcaaaatagaaaaaattatttttgattattaagcaaatattttttctaaaaatacaaacaatttattcaagtgacaaatatttattgagtatctactatgtgtcaacattaggccacaagctggggggacataatcatgatcaaaaggagacattgttactgctctcagttaagtgaggactggggacattaatcaaacacatgcccaaatgagtgcataattaccagctgaaataagggccgctatgttttgcgagagcatgcataaaacaataaataacaaaattgcctaactgtgtctaggagggcttgcagaggaagagatggtgctacagcagagacttaaagaacagtcactgttttagtcagcctgggctcccatagcaagctaccacaccctggatggcttaaacagcggtcatttatttcttgtcatctgtaggcttgggagtccaagatcaaggtgctaactagggatggttggattcttattgagggctctattcctggttatgtcctcagatgccttttgttggcatgtgcacagaaagagagatcttgcctcttcctcttttgaaagcacatcaatcccatcttggggactccaccttcatgacataaactaactgcagtcacctcccagaggctccaccttcaaatatcacccaattggggattattaggacttaaacatatgaatttgggggacacataaacattcaatctacagcattctgccccaactaaatgtggcaggtcggacttcagaggcagagaggcagcatatacaaaggccctgtggcaagagggaagatggagtggaactgagaagggacccctgtttagggcatttggagatttagggaggaagcatccaaggaggcctgtagcagtccatcatgtaggatcttccccaaacgctgtgataggagttgcagccttagagcaatgggaaacctttcatgacgtgtgtgtgtgtgtgtgtgtgtgtgtgtgtgtgtgtgtgtgtgtgtgtgttgtgcacacagagagatgcacacgtgtggcccgaaagtgatggatttgaattttagaaaaatagcctggcttttccttagccttttccttccaatatctttccttgccttctttagaaataactttcttggatttcttcctgttttctttcaccaaaaagccattaagcagactcaaccagggtagatgttctaaacaagggaggcaagccctagcagagatcaggacccatgtgtgaatgggctgctggctcagcaagattgagagacaagctatatacagggagatttaaaaataaatttgaaataatggaaactgtgggaacagaggtataaatatggaaagcataaaagctagaatgaattgtatgctgtggaatcaaaattggaggtattagtgtgaaccggtggttttaaatatatagaaatggagaaataaatataggctgagagtggctttgaagcagtaacatctacatagcaaggagtacagctggctctcagatcttggattccatatactcccctaaaagcaaccaggactcattagagacatggccccttccaaggcctggagagggaaaatgtgagatgagaccaacacatcttttttttgtgccagaaaatgagaaagtactcaaagaataatgggaacatacaacaaaaacaacatccagcttgaagggcctccaaatctggataatttgagcctcacaatatataataatagtaacaagttataatctactgaataagatgggggctattgagtccacactaatatgcatataaatgaacaaatagaaacaagagaaagctcttccctgtagaggaaagaatgatgatgttagaaactcactatttggcaaccatcagattaatagctaattcagataagaaacataaatggatgcttaaacttaaggtgaacatcaggagagaaacaggattttacatatcttcaaagtttctccccccaaaatatttatttattacaaagagggagaaagtaactttacagagaagtttggcaaatgccatctgaatcaagtgattaaagtcaacatcagcaataataggacaggtaaatattctgtgcaacttagaggatgcaatgaaaagtacataatacttgcaatactctgttcaaaatttataacttgggtctcatcatgagaaaacatcagactacctaaaactgaggtacattctattgaatgtgtggcctatgcgcttcaaaaaatgttagggtcgtgaaagtcaaggagacagagaaactgctccagattgaggggcatgatactgggtataccatgtgatccttaacaggacatctctaggacaattgttgggctggaatagggtgcctaagggaagagtgtacaggcattcattgtagtattcttgcaacttttatagatatttgaagttgtctcaaaataaaatatatatatttttaaatttaccttgactgcagcatggaggatgggtgggagaggcactagtagagacaggaagatgcatcaggaggctacggggcaatgggcctgggatgcagcaaatgaatcccagaagttctagtggggtgatgcagaaggacttgacagcagatgccacttacaggtgaaagtgacagatggcggaggatgactccaagtatccagcctgtgcctctggatgggtgatggctccattctctgagagtgaggatgctggagagaaattggttgaaggagtagaagagttgggaatagattgtgggtttggttcagaatagttattctcaaattctcaattctcaaattctcaaatgttgttgagtatcagatttacctggagagttaatacagagcacagaggcacagactcattgaagtagaatagtctggaccttttcattgttactaaaattttccatatgattttgatacttagaaaattctgagagacacttgtttaaacattttgacttttatatgtctataggatatcacagtagagctgctgaatagggagctgaatatgtgggtttggggcatagaggagaagtccaaatgaagatgcacatttaggagtcatcgttggcatacaaacagaaacaaaacagtgcgtgcaaatgtacttcatttgggaaaggatagaatgggaaaagagcctggttctggacatgaaggagcccagtttgccaatacagatgtacataagataggaacagtagctgtccaattgtcccttcctcctgacagtcaattaagaaataagaatttgccataaacccaacctcctcacttttggatgaggaatccacagcccagagtggtcaagtgagttactcaagccacacagcgtgctattgcagcggcagctttggcccttccatctcgttctccagactctgagtccaatgctcaggacactgtgattccctctctggccccacagtgtgccagactccctgctcaactttggtcatttgtgatgttctagaaagcctgtttctctggctttacttttccctcttttcctctcaaaggcccagcaaaggattctctgtagagtccaaatcagccgtcatctttgccactggctctactggcccttggatgaggcacagagacgcggtggtattgcatccctctccaccccatgtacaggcagagatgggcagacacttaacttttacttattcttgattttcagctttacttctttgcatttacttttttcatagttactctagaactaacataataatatgtaacatatgcatatataatatatacgtcttaatttttcctagtctactttgagttcatattgtaccactttacataaaatgtagagaccacataatcatatcatatagatccatttaaccatccactcccactgctctttatgttatcattgttatatatgttccatctacatacatttatagtcccaaagacaatgttacaatttttgctttaaacagccatgtgtattttaaagaaatcaagaggaaaatgttttacattgcctcaaaatagttatcatttctcttgttcttcctttattcctgaagatccaggtttccctctggcatcattccttcagtctgaagaactacctttaacattttttgtagtgcaggtctctggcaatgcatttcttagttttctttatcagagaaatgtctatattttgcatttattactgaaatatatttttgctagatatacacttctggtttatagtttgggttttctttcatcactttaacattgttgtttcattgtcttgtggttgccatggcttctgatgagaaatcccacagttacttgaatcattgttctcctacatatatataagtatgcacacacacatatatattcatattcgtatacgcattgtgtcatatttctctggctgcttccaagattttctcattatctttagtttttaccttggctatgatatgcctgagcatacttttttccccaaatttatcctgtttgaggttccctatgctttataagatctgtaaatgtctgtctttcagtgtatttgcaaagttttcagccatattcttcaaatatcatttttgttcttttttcctccttctggtagggctgcagttatctagagggagaagttttgaaaatgttccacaggttcctgaggctctgttcattattttccctgattttttcttctctttttcaggtctactttcaaactcattgattttatcatttgccatctttgttttgtttctgagcccttccggtgacttttttctaataattgtatgttttagagctatattttctaattaatccttttttatagttttcagaatctcagctgatattttatctttttatcattcataagcatatttttctttacctcattgaccatagctaccatagcagctttaaaatctttgataatgttaacatctgggtggtcctgggattagcatcttatttgttttttcccatgaaaatgggagacatttctctggctctttatacatctagaagtttgggattataaacatgaacgttatgatgtggtgattggattctgctacactgaaccagagtgttggtatttttggtttagcaggaaattaacttggttagactcaatctgtaaactctgtcatgtttgcagtgggcaacagctctttatggttttcaatccgtcttatacatgcgtgtttcgggggtcagctagaaaattgggaaaactttatacacagaatttggtattacctttcccttgttatcttgtttctagggattctccctcaactctccagcagccctaattgtgctgaattcgttcccttggttcctccagtcagaaagacagtggggttttctattggggtttgagccactgagcagactatggctgcccttagggaaaaactacagaagataaaaccttgtgctgttcagtttccagaaacttcagttcatttttcctgtattttctttttccttctcttgtgtttttcttcctttgttgtttgctagagtccatttgttagaaacatactggacaccaaaagtggaacattcagcttatccccctaatcagcagttctataagacagtacttaagacctctctactccatcttaattcccctattttatgcagttctttcaagatctttttaacatcaccatcttctaatacatctggttttactttgtaagtgaagacctcgttaatagctattaaagttttctagtttttcctaccaggtcctcaaacttcatctctcactctgccttaattctccaccttgttttcccccaggtgttccttctgttttagatcgctatttctagccccaggagcatttccttcccaagaagctcctgaaataatgaacagatcgaattttctcctttgcgctttcttatgattggaataaatccactaaactaaggaatagttctgaactgctactaatattcctgctctttaagagaaacagacaaatgagctaggctggactctgaacacttgcatggtttacgcaactttgtttttggcaggtatatttctgaatgtcgttatgtgtgttcaaataaacattcccatgcttctgttatagactagttcttgatgtttgacctcacaggtcaccttctcattattactggttctgtctaatgttaccaagagaaaagagggcatacacataccaggaaaggtgtcacatctttgattaacttattgcatttggagctcacgtacacactcacaaacttgatctttaccttttatcagctgacattggtgggcagagctccaacaggatcccacaaatctctggatagcagctttatgctggttaaatcaaaagctctatttcagcatggctttctttctcttctgatcagtaggaagaggcccatccagtccctctgtgagcataattttcccttcttagtattcagtcaagttccttctgctaaagtagtgtcaactttcccatccttcagagcccccaggctgtctctccaagaagcctccagctttgctcgagccttctgcacagccgtgctctctgcaggcctccctgtattatcatgaattgcattaagtcttcaaggcgcctctgatctccctcagccccttcccctttgactcctcttgcagctccttcctcttgtctcaaactcccggttcctctcacactctgtgtttctgccacttctgagattccctttcttccaagcccgccagttcctcctcctccttactttctctcttctcatgtcagctgatgttctctgccctgctgctgtttccttctgggaactgcaaacagaaccattccttggccatctgccccctcctctcaggccatttgccccctgtgctcttgtccttcctggatcattgtccctttgtcagctcttcctcacatgctgccctggtggttgctgcccctctttcccacattaactgcttagatccacttggggacagctcagctcttccatttcctctagaatctgctccatctgcatcagactcatttctggtactgctctagggcaccaggcatgaagggtccagcctcccctcatgggacaagggacagcctttctacaagggtaatctctgtaagcacctggtgccatggcccatcctgaacctgctggaggaagccaggcctgtcactcatgtgcgctccagaggtctttgttctgtgacgaatttcagtcatcccaggtcatggtgtaggcagcaccctcatctcaccaccaccaaccccacacacacccattatccattattcccatgaattattgtctcagctgcagcctccatcctcgctgtgcttccaggagagagcatgcatttcagccacaatcgcttccatgctgaaatctgtagggcccttcctttcacaaaattcggccttcattcatgatattgtactgcccaattgatccctgtgttcagcaatgtcgcctgagaaaggggcaaaaagaccatttctagaactttctttcccagcatggtgtggtgaaatagttctttggcatggtacgaggaatgcagggtttggatcacactatgctttatgaacttgggcctagttctcttcatccataaaatggggtttgtatgattttgttagatttgtaaaaacccatctgataaactggtgaacatgctaggacaagttccgtcctggtcacagcttatatgagtgttgtggatgctaccataagtgcttccccatctctcagaatccctatcccatggcaagagatggcagatgtacagttttctttttttcttttttcttttttttttttaagacagagttttgctcttgttgcccaggctggagtgcaatggtgcaatctcggctcaccgcaacctccacctcctgggttcaagtgattctcctgcctcagcctcccgagtagctgggattacaggcatgcgcctccatacccagctaattttgtatttttagtagagacagggtttctccatgttggtcaggctggtctcaaactcccgacctcaggtaatccgcctgccttagcctcccaagctgctgggattacaggcatgagccaccacgcccggcccagatgtacattttaaagctaactagcgaaaaggatcctataactttctcactttccagtcactctataacagaaaacaataaggcagacagccaccagaaatccagaaaagctgatattcgcgaaggaaaattgaggacctcgtggcaggatcaccatgggaaaattctgaggaaaccctgtcaagagagaacaggggaaaagaaactaaaatgactgtgtccattgaaacctgtggttctcatgcttccctggggaccagagtttcctggagggcttgtaaagacacagactgctaggccccacccaagagtttctgattcatggatctgaggtggagccttggaatctgcatgtcacgtgagttcccagatgatgccgatcctgctagtcctggaggccacttgaaaaacctcttcattgaaaccgtttcagggagcatgaattttatttcacaaacttgcattgtaagaaatgtcaattaccgtatttctcaaaaatccaagtaaatctgacaccaaatccccatcctgtcaggctggaaaagaaagtatattttcagtcatcttagaacttctccttctccaagcccagggaagcatgaaggccccagaccacacttgggctccagcatcttttcacggggtggcaacacctgtgctgtgactcaacttcccagatgcccacccagccatcacgttgtctgagaccgaggagacagcgagggcacagggccagtaggtgccgccagcacaaagctccacaccagcatctacctctaggtcctgggaccctcattctgatgctgctacatctgcccccataacaacccatttcccagagtctgaacccctcccctcatccatcaactcttttgtggaaaagaaaaagcaaaaacctatcaaatcagccctggagatcctgaggattggtatgaaggagttggagacaggtggataaaaattaccctcagtcttgagccgggcacggtggctcatgcctgtaataccagcactttgggaggccaaagtgggcagatctcttgaggtcaggagtttgagaccagcctggccaacatgatgaaacctcatctctactaaaaataaaaaaattagccaagtgtactggcactcgcctgtaatcgcagctacttgagaggttgagacatgagaattgcttgaacccaggagatagaggttgcagtgagccgagatcatgccactgcactccaacctgggccacagagtgacactctgtctcagggaaaaaaaaaaaaaaaaaaaaaatcaccctcagtcctgagatttttctacaccactgaaacaaaaatatgcaaattaacacctcaatcatttccattgttatgcatctatcagtgaaccagatgccctgttaactggggtgaatctcaacaaagaggactttcttgcatcactttggttgcaaagccccatcttttctaagtaaatcactgttcaaggaaagaaggcagttcggtgtgcctgatgggggtcacctgtgtctggaattaaaaggtcttttctcggcagggaacttgctagggtgtctttcaaagaggggatccataagagaaaaggtcaagaggatgccaaaaccttagccttaggggccattcccttcctcctgccaggccctagacctgacctgcacaggagatgtgggtgccacaaacagcccgagaccttcttggctttgacacagccaagatgagtagcagacctgccaccactgtccctggtagcagcagggcactgagggcagtgctgaggataggcatcaccgtgtccacactgcccagacattgccgctccaccagggaccagcagtgctatgcagagtcctcatgggtagaaaatggttagggttaggggaactctgtgatgaggacaaaaagactgtgaacttcccctaaagcctgcaatgaataactcccatcagtaccacacacacacacacacacacacacacacacacacacacacacgcacacggggagagagagagagagagatgtgtgtagtgtagttatgcacatgttgttacgcaaagcatagttagagatacacagtgaaattcagagcgatgtacacacagaactatacgcaatcacccagggctacccagaaacatacaagtacaggcacaaacattccgagtaggcaccaggtaatagctggacttttttctctcattacccctgagcagtgagtttgactgcaacagtactctgtttcagatttttttaataatgcacttagtacattataaaatgtgcaaagaaagcagaaaattatctccaagataatcctttctgcaagattttcaggaaaaagctgtctgcactttgctgcaccactgtaagaagttgcttctcagtcgggtcgatccatctgcctgatagattttggctaaggctatgaccttcatctgtcagaacgggcaaggtttactggctttctgtccagtgaccccaggtccagctttacttctccccatagctcctggcagtatttacatttaaatcatagttttcttctcttctgattcatggcctgcctcatgaggcagttttcaaattatgatttcttactcatctttcaatcattgagcttgggtagcagggctgtctcttgggtgggtaggaaagtggagagggatgaagacaagcaaagacaagacagagagaccctttaattgaagccaggataaaactgagtcctggtcccctggaaattctgctctaacattaattaagctgagagtaaaataattcaaatgccactctatccccttttccaccactcaaataattcttcttcaggcagatttggctcctccttgctctgatatctctccctgggtcactttgttaccaatgctcagttagggatatcaggccctgactgaaattcccttttgaaaaagactcagcataattattcttagtaatgcctgtatattattagcatgggtgggatcagtatggaatttcagagcctgagccagcatgtacccagggactggaacaaggagtgggtcaggtttctcagaaaacacatctctccattctgggccccacaggggtgtgatatgcaaagccctcttcctcaatatgcctgtcatcatgtgggaggggccagccacctgggtgcaggcccatgcagtgcctctactggctgttctcctagccaatacatatttttaaagcagctaatatgtgcataacactgcagttaacaaaacaggtagttcctgagctcctccagtttccttcctagcaaaaaaagacagacattaaacaactaattatgcaagtaattatataattgcaattgttaggtgctatggcggagaagcatatatcaagcgtgtatcacaagaccctgaagaaggaacacctgtgttgaagcccaaggacgaaaaggggttaattagggtaagagcatggccagtgcctccctcatgggaatgatcccagagctggacacagactctgcttgctcagcaaggacagagtgtggaggagaggagggagttggaggagcctgagctcaagcacaggtgggggaagagttgccctcccacagaaaaggcccaagagatactgaaagaaactgaggtagacgtaagcctcagcagaacagaggaggctagaaagtacttgatgtgcttactggatagtgaacaggaggcctacttggctagtgtttggaaaagagtgtgaaaggtgtgttagctctggaagggccctgggatcagttgaattgtatccctcccaaaaagatacactggagtccttacctctggcacctgtgaatgtgaccttatttggaaataggcttttgcagatgtaatcaagttaagaatgatgtcataatgcattaggattaagtctaagtccaatcactggagtcattaaagaagggggattagacaaagacacacaaggagaagatggccatgtgatggcagaggcagaggttgggtgatgccaaggaatgtcaaggtttgctggcaaacaccagaaactagaaggagcaagtcaggattctcccctggaggtttcagagagagaatagccctgcgaaagccttgatttcagacttgcagcataagattttagaaaaatgtaaaaaacaaaaaatctttataactcttggttgttatgttcactgagttggcaatgtaattttgcagaagcattgccttccaagagctgtgaccacaagatgttaaataacagggactcctccggtttctaaagccctgatcagccttgatactgtaggagtctgcaaatctgtccagttctgtaagagtcctgtgcattgttacagaaattgataaggaaggcggggatcttgtcccatgcacccagactaatagggctccagaatgttgtagtgtttgccttatgggccctacacagagcagaattccctcacaaagaaggcctctggatctagcacatctgtgtaggcaaaatgtttatccaggtaagggtaactaggcccttcaattcagctctccaagagtacacaggcaagagtttttttctaaagaccctggtagctcaaaaccagcactatcaaggctaatcacattatacttcctatgggaatgctgaattcaacaatctgaaggtagtcaagaaactcatccagtataggctacagatgtctagggaaaagagagagtgagtccaagtcaaagcaagggggaaagagagcagctgagtgaggaagggaaagacaagggcatggccaatcaaaggctgctctgcggatgctcaccccgcaggcattctagctgcagggggaatatgcaggaatgatttcagaaatgaagattttattttaatcctcccacaaaagcattcaagtaagctctttctctgtgagaaagctagagagtaagaaacaggaaaggaaggttctcagcgaaaagatccatgtcgacttctaatattgctcacttagagaatacatgccatctgggcatttgataaaaagaaaaaagggcgtagagaaaagctcaaagccatggattctgcttgtgagtgcaaggtgctcgcctttcctcatggccagctctttcctttgttggaggcctttttttttttttttttcctggtcagcaatgactttttcaaagtgacctgtcaagtcttcctttctttattccctgtggccaaggagccaagcagtgggcaaagaggagagaagaggagaggacccaggtgacaagggcaaggctggtattttattcattaattgtctgagtgttatctataaaatgcgaactcacagcccacttgtgcctgaggctgaccccagcatactcacaacttgctactccaagccagagaggacaagaatacctgccttgtcttcatagattttcatactgtctcttagaggtgcatgttttgggcacaaaatccagggctttctggcccatgacttagtcaggagtggtcatgggtctctcactttagccctgtcattttgaaaaccttttcctttggaaaggaatttggcccgttccagggactattgaagacaacagaaaaccaaagagctaagcaattaagtttatgtgcttctaaattgacatccccaataaaatgatatgaaatggctttgtagctggatattctaccctgagaaattagaagggcaaaagtttggccaagaaggggatggggagtgggtggaaaatattttaatatcactttaagatagcatgtgttcttcccaattttcttcccattgcataggctatggttctattatccaaaaataatgattatttaccttactattctatactagttctctgtactagaaaattattttagtaagcaaattaggcaccatcacttaaacctcattattcatttttgttgttgtttatttgttttgacttttggtatccattaccgtactagtaatcattatcttcaataataaacacaatgaactcattctttccttgttctatttttcaatgtttttatcacatttccaatcatttagcatagtaagtcccaggagctctaatgacagacaatctaacgcacaggacttaacaggagataattctgaatggtggccccctcagcagttgaggctgaattttgatccagaaaacatgattttagttctggttctaccagttgttaacttggagtcagttactatacctctctgaggcttcattccattatctgtcaaaggggatactatattacgcctcatgtacatcacatgactactgtaacgatggaaggagacatattgttttgaaattctttaagtaaacccctaatgtcctaaaaatgtaacaaaataaaaaatattacaaaagctgatgaattagaatcactagtaaatggttctagatcttagtaaaatacttttacttgatttaggggggaaattatttcaagaatacatgacattctaaatataattattaatagcaatgagcagaactatttcttttcagctaataatgcaagtggtgggatcctaatataaaatttcaccaatgtgatgcaaagagcacaagcttggatagccaaaaatttaagatcaaaatttaaaccctggctctgctcctaacatattattgtagtaacctaagtgaggtatttacttcatgagcctcagttctctaatatggggataagaacttacattttagtagaagtatgaagattggatcataataaatatgtacagtgcccagcagaacagttgatgcctagtggatgcttgaaaaaatgtccatttgctctcatcttctctgagatgcctcataaaatgggaatggggatccagcgtgttctgttccatgcctgtttctccaatgcaaacgcaatatgtgattggtaaatgggggagtgatgccagtattgtgtggaagtcccgcggttctcatatgatcttttctaggatatttatattttgaagcaaataggggcacgctttcttccaattaaagagaaagccttagcacaatgagaagaccttaagaaacaagttgaacactggagagggcctttctttcatgcaaatagtggccggcttcgtggtttccagagccactgtgtttttcactctgttttctgataaaacagggagtaaacatgaggaaatggaacacattttcctttgtgttaaattttaattttatgacaaaacagtctacacattggattggatttttaatttggatgaaactgatctctgtgagatgtgaatgccctcctggacctatgtctccaagaggaagcacaaaaatccagagtttaagcttgcaaaggatcagtgaaccaatacactgggtacaaatgcaaattataatttacctgtgctgctatttttatgaagattgctgtgttttttgttagatgttgaatggtctcctccaaatgcattttctccccataggctctgttattttattgtgcaatttcgcagagtatgaggttttactaaaatatgtatatgaaattatagcagaaatgcctgtattaggaaattacagtccagtcaatcacattcagaaatcatgtactacacttaggcataagaaatagttgaaacatcagtaagcctaatcatgtgagaccatttgacatcaaaattaagacacattagaacatatacttgaatcaaaggaaaggaaaaatgtaggctcacccattatatatgagtctgtccacatgggagatgtggccagtcctcttctctccacatcctagagttttataggaatgggccagggcactgctgggtactggggaaaccttgcagggctccagaccaccaccttgcttcaaccacagcagctcctctcttacctattttagatattatgcttttaccaaggtttcctttcaaacaagttttgccaacatgagttcagtatttgaaaagtataggccatcaaacctgatgataatgggttgtttaatgtggtcaacattcctgtccccaatcatactttttctaagcttagaagagagtttacaaaccatgtccaatactggcttttaaagaagagtgagagacactttattgtattttagaagttccaaagctaggagattgtccatattgcattttatttattatccgtatttgaagccatgatagagatgtcttggcgcactcctcattggcttctctataaaaacaacttcaaaaagaaatgtcattgtttggtcagataactcttttagatacctgatcaattaacaagaggatttttaaaaactttatttgaataaaatttcaaaaaattgtttgatgaataagtctacaccatggatcaaaatattaacattgttaaaaccaatccctactgaaataaatgccctctggaaccttcagtctaggatcaagtattgcatttagttgtcatgtctctttaatctcctttaatctaaaatatagttatgtgccatataatgatgttttggtcagcgacaaaccacatatacaatgctgctcccatattatattactgtatttttactataccttttctgtgtttagatatgttcagatacacaaatattattgtgttacaattaccaacagtattcttcatagtaccatgctatacaggtttgtagcctaggtgtgtagtgagctatcccatttaggttagagcacatacactctaagatatttgcacaacaacgaaatcatctaacaacacgtttctcagaatgtatctccattgttaagcaatgcatgactggatttccactgattttctttgccttttatgacattgacttgtttaagaatacaagtcaccttttttcattaataagacattcctcatttggcatattttctgatatttctcataattagattcagattctacattcttggctataatcctacataaatgttgtgtccttcctaggctattatattttgaaacacctgatgtccatctgttccttattggtattattacttttgatcacctggtcaaggttttgtccaatttctccaatgtatagttatgtacagtatatattacatatttttctcttgtgactaattagcaatctacaggaaaataatgttaggccatgcaaatatcctgctcctcataaaaattcacctcactgccccccaatttcagcatccattgatgagtcttatctgaactagtctttattatcacaacgggaaaataatgtttttcagctccagccaccatataccagtgagcacttgtcattgaaaagaagatattttggatggtagttccataatccagtcaaatgttcctttgttctgcttagaaacccaacctaatgacattttgaacattacattctctttgatttttacctgagaagctttggaatgacctttggccaagaacattaagattctcatgtgtttccaggccgctgctccctgttctagtctaaggcctttcagacctagcttattccatcactctctgctctgcctgcacctttgatttatatctgtctgggatttacttgaggggaggggagagcacgttgaggggggaagcagacaagctcctctctgctccactgatttgctggctgtttaatttctgtttctgtcttcacacctactctgctgcagagctaggatgccctgcccccacctccacctgtcctcgtttcacccaccctttgccacaggcagtaaaatacagccctgaagggcccagaaagatgcaaggcgtaatccaaaagatgtatctcccaatccttgggagatactaaaatattcctgtaggatgcagaacctccagggtcaacaaggcccgatgggaaggcttttgcttgccactgacagatgtcacagagcttaggcccttccctgggcttctcctgacttgtggttaaggattctcttctgagccatctgagttcctgtgatgccatcaaaatgagtaagttctctaaccttgggagaccatggcattagagaaaatggaaattgtttgcgaggctcgcagttcattagcctcatataaaatgaatttggaaccctctgaaaagaggagtttgggggcttcagctgaaggtactgctatgactctcaagattccataaaactctggaactgaagccccacagttcttggcagagctttcagactgtggcaagtttaggaaggccacacctcaggtgagtggggatgatgatagtggccaccaagagccacagggaaagggtccagtcccaggttggaggaggggaaactgaggtgactctgcctcccactctgacaagcccagctgcccttgggacagccatactgtaaaccgtaggcccaagcaggacaggcagggaagcaaagaccagggttctagacccaccaggctgggtgaaagttaggtctgggaatgtgggagcaactccaagggctggttttctaaggaatgggaaaatggaaagtaaatcttaaagtagatcaaacaataaagagattagtcagtggggaaagaacaggtaagatgcaagcagcatttgctaaagcctaaatctagctggggaaccccagcttacccccaagtggggtttctgtagtgcaggcctaggcaggccaacggcatcagtggcctcaagaatgaggattggggacagctgtgggcagcttggcccatggtccagcctacactacggcttgcatgctgctcttgcaacctgtgccctgtctcatggcagtttcctcccacatcctgctcagtagctcttcaaagcctttgccacactcctcatgtccctgccctaccgcggcactcttctgtcccagcagctggcctggcttcctcttttatcacagtacctctgagctttcatgtgctgctcagtaacagtttgtggaatgaattaagaaattcacgaacgagtgacagacatgcccctggagatctgagatatcaaggagaatggtcagtgtagaatggggcaggagcccgggtactcagggagcagtatggctgcccccaggcagctgggttcttcacagtaggaagagacctttcagtttctgctcttccaaccctgaattcgactctttccctgtggctctgcacggctgtgataaccagccccattcacctacttttggccttcaaaaccttctactttcttcccctacacctgggggaggaataatcccagaacatgcaggagaaggggcttattggtccaacttggaaggttgttggcctatctgaagaaagaaatctctagaatgccatattttttaaatgttattatggctttatttaaaaaccgatccatcattttcttaacacagtcattaagaaaaaaaaaaaagaaatcatgtcctttgcagcaacatagacggagctggatgatatagtcctaagtgaattaatgcaggaaaggaaaaccaaataccacctgttctcacttctaagtgggagcaaaacattgagcacacatgaacacaaagatgagaataatagacactgcagactactgaagggtgggggaccagggagacatggattgaaaaatccactattcagtaccatgctcactatttgggtccaatatacccatgtaataatcttacacatgtacacctaaaataaaatcatctaaaataaaatctgaaatttaaaaacaaatgaagtgcttcaaaacatcaaaaaataaaaatatgtttaaagtaaaaagtgagtcttacacatgtacccctaaaatgaaaccatctaaaataaaatctgcaatttaaaaataaacaaaatgcttcataacattaaaaaataaaaatgtgttcaaagtaaaaagtgaaactgactcccccttccaaattcccagaaattactatcattcatagtttggtgtgctttcttctcctctttactgtgtgtgtgtgtatgcatatgtgtattttttgtgtatacattttactctcaaaaaaatggtctcataccatacataatgatctactcataggctgcttgctttgttacttaatgacttatcctgaatattacctttccccttcagcgcctcacttcatgcctttggagacaagctctttttaaatggtcatctaggtggcttctgatgctatgttatttcaaacaacatttcagtgaaaattcttatatagacatgtctgtgcactcgtatgtatatttctataaaataaatttcaagaagataaatttctagatcaaagaatttgcacattaattttaaaaaaataatgtcaaacttaaagaaagttcccagaataagaataatacagacaacactcatataacatttgcccggattctttacctactgttatcatttgaccccatttctttattatttgctctcttcctttctctctttctctctctgtaaaatattttttctgaactcttggaagatacgttacatacatcatcgctctttattcttagactcttcgtgtgtatttccgtatttcctaagaatagggagggatattctcttacataactatagtacagttatcaactttagtaatttaacatggataaaatacttttaactagtctactatctatattctaattttgtcaattgacccaaaaagtatcttttttagcctttttttcgctctagtacaggatccagtctagcttctgagactgcatttagttatcatgttcatttaatatcttttaatcaggaaaattttcacaatactttttaaatttttaaaggatacctttcaaatattgtgtaatagactcttcctcattttgagtttgtctgatgtcccttcatgcttagattcgggttatttatgtgttgcctaagtgacagtgtgcccttcttagggtattgcttctggaggcacgtgatgttcgcctgtcctttgtgtgatgttaacttgtatattttaaattttggtagctgtttattcccccaaagccttttgccaatttatattcttgcatagcttacgagatttgcccattttcacatcctcttcctcacacagagagtcatcagtcttagtcccagtgtaaatgtgcttattcatgctttatttaaaaaacaaagcatcaatgttttttcccattttactctgaggcactttaatattcttaatattcttatctctcaaccaacgtttctcaaccatcaaagatgtagtaaactgacatgctcttttatatcccagagctcactgagagtcgggcagtctgaggggtgacagcgtgggtggggtgggacccttggctgacagttaggaactccatgctctgggaaagtaaaacacaagccaatccttttgtttttcctttgggagatttttatctgccctccatatgcaaggacacacttctccatgtatcttctttccttctttcctgtcatccaatatgaggaaaaggcagcatgggatctggaatgggaggtttcaagagcacccccccactttttaccaggtgtggacccctggtcaccctcctctcctgtccagttcccagtgcctgtaaaaagagactcagaatacttggtttcatccccagtatagaagatacacaggaaggagctgccctcccaatacagcctttgaagcagactctgcccctccttggccatccctcaccaccaccagaggagggcagacagcccagagagcagggctcatgcagggaggcaggtggagcagcgccgtcagcactggcacactctgccagcattagctaacagctcctcatacgcccctctgagataattaagtattattatccctattggcaggtggagacggtaagacagagtgtttaagtgacttagttgtaactgctgggattgtttgcgggagaaaccatgccaagaaggaagtgcagttcaggaggccagaattgcttaagctatttaatgtgactgattatttttaaatagctgttggagggcgggggcaggaagagagactagaagcatggccagtggacactggtaaggcattcaaacattgcaatgaaaagaaggaatatacctagtgtgtctcttaaaacgggttgccatagacagtctgtcagctgcttaccccacatgaagaggagaaaaaataattgaaggccatgataaggacaatagaaaacaccccacagccttcccacagagttgtacagaggtctccaagttggctaagcaggggccagtctccatctgagagccccaaccttctccagagacagagcatccactggaatcagcagccccaccagtagccactcgatgtcagaaggacttgccagctgtattgcctgccgtagcaagtgcagcttcacctcagagcagcaggaagcccatgtagcctccatgcacagggcagggacagaatgggagaagagtctgggtgaccaagggttgttggggagacacatgcgaaaggtggaatggcatcatggcctactgatggatggaaaccctggagacatggggaaaggcccaggggtcactggtgtggcaaacagactggctgacagagaggaagctgtggtctcttaggatgagcctggggctgagggtgggcagcagtgaggcatgggtgcagagaggctctgggaaaaagtacagttcctgccattgtcagagaagcaatggatgaaacactggacgtggcctggaaacagaaggggagatagtggggtggcctctgagcctcctcctgaacccttcttgccccctgttccatggtcctccatgccagcctgtcacccagagggcctagaggctcattgtcccctccccacctgccttggaggagggcatttttgtttcagcagcagggcaagtccagccctgcttactacattcctgatgggatgctggctctctctgttcattatcagtaccccaccatctaggagagcaaagtgtctagagaagctaaagccctttggggtgagtccagttgctctttctccagagcactcacttcaggaacactgatagcaggacccaggcttcagggactaaacaaggagagaacacacctgcaccattattttttatttttattagcaagatctaaattagggtaatttaatttaaatttttaaaataattttggcttttactttagatacacgaggtacatgtgtaggattgttacatgggtgtattggacccaagtagtgagcatagaacccagtaagtagtttttcaacccatgcctccctccctccctctcacctctagtagtctgcggtgtctgttgttcccatatttatgtctatgtgtgctccatgtttagctcccatttataagtgagaatgtgtgatatttggttttctgctcctgcactaattcatttaggattctggcctccagctccattcatgttaccacaaaggacatcatttctttcttttctatggctgcatagtattccatggtgtacatgtaccacattttctttattcgacccaccattgatgagcacctaatgttgattccatgtctttgctgtcatgaatagcgaggcgatgaacataggatctgcaccactaaagacctgactaccactgcgggattccctggacagtgtcctcctcagggcagaagggatgctgtttctttgccctttattgtccctggcctggctcagagaggggcctgcttgtcaaatgaatgaaggcagctagttaattatttagcccttgtctctccatcctttctttttaattgtaaactcaagaagcactggataataaaaagaaataataatgcctgtatcctggccatcagaggctgttttgggtgtggatagtaaaagagagctgtttgcccagtcagtatagtacagaaaaatgacgtctgtttggttgaagattttttttccagttgggaaatgtcaccaagtggcctttctgttcttcacacatgaaatacacactatcatccacatatttttagttaatttatgtccaaataagcctttttgtagctgctggaaaattatatttgggctgcaattacctttcgcagcattgcacagaagggtttcagcgctcacaaagctcaggggagaggcagcaaggaccccacccgattgtaaatctttccatttgtagttattcaaatcacatattttattactagtacgaaatacattctgccattcattttggaggagcagctaatgcttcaagaaaagctttgaaaaacattctatttagaaacaattttgtcagcagctaatgctatgtgtctttttgggttgtcttttctcccagctctcttctctgttatgtgtgccatttgcatgacaaacgagaccatcctctccaaaagctcacctgttcctgcagcctgcttcccacctcaagttttcattctctgtatgttgcatcataatccttagcacggtaataaattacagtgtcaccatcaagattgtggcttctggaaagaaataagcagcagggccagatgaactctttcagaagatgagagactgttttcatgcaaattcctggcatcctggggaactgggaacagcctctttattatatagactcagttgcaattcagcagccagaagccatttccactagctgttagaagctggtgacactcagagcaagataaccttttaggcaaaaacttcttttccttcttagttgttatgagtcttgtctggaaaaatatcactttactcattagattgaggaaaatgggtcagtgtactttcagagagcttttaagttgagacatttattctaaaatacctttctaatttgacacagaaacacttgcagctcactttagagcagtgcagtagacagtgactgtggaacaggagcaggggtgtgccacatggatgccccctgagggcaggcccatctgtgtgtgaacttgtctacaatggattgcacagaccctcactcgcaagcaggtgctgtacccaggctggtcaaccacacagtcaggagggtcactgctcgaaggcagagtgtccaacctgccaactccagggtgactcttgacatacaatgtaaactttatctcaatttgccctccatttcctttgggccacagatatacttgacagaaacattaatgaggccaatttgctgcttttttcctttttcatcattttaagatcttttgaggcttagtacaatgttgaaaaatatttgctgtattagtctgttctcatgctgctaatgaagacatactcaaggctgggtaatttataaagaaagaggtttaattgactcacagttcagcatggctggggaggcttcaggaaacttacaatcatggtggaaggggaagcaaacatgtctttcttcacatggcggcagcaagaagtgccaagcaaaaggggggaaaactccttataaaacaatcagatcttatgagaactcactcactagtacagtagaacagaagggtaactgcctccatgattaaattacctcccactgggtctctattacaacacacagggatcatgggaactacaattcaaggtgagatttgggtggggagatagccaaatcataccattccacttctgactcctcccaaatctcatgtcctcacatttcaaaacatagtcatgccattccggcagtcccccaaaatcttaactcgttccagcattaacccaaaaatccaagtccaaagtctcatctgtgacaaggcaggtctcttccacctatgagcctgtaaaatcaaaagcaaattagttacttcctagttacaatgggggtacaggcattgggtaaatacacccattccaaagggaagaaatgggccaaacaaaggggctacaggccccatgcaagtccaaaatccaatgggcagttattaaaccttaaagttccaaaatgatatcctttgattccatgtctcacatccaggtcatgctgatacaagaggtgggctcccacagccttgggcaagtctgcctctgaagctttgcagggtacagctcccctcctggctacttccacaggctggccttgagtgtctgcagctcttccaggtgtacagtgcaagctgttggcggatctaccattctagggtctggaggatgatggccctcttctcacagctccaccaggcaatgccccaatggggactctgtgtggggcttccaacctaacgtttcccttccacactgccctagcagaggttcttcatgagggctctacccctgcagcaaacttctgcctggacatgcaggcatttccatacatcctctgaaatctaggcagagatccccaaacctcaattcttgtcttccgcacactcacaggaccaacatcatgtggaagctgccaaggcttgggacttgcaccctctgaagcaatggcctgagctgtaccttgaccccttttggccatagctggagcagctgagatacagttctgcagttccaaggctccacacagtagggggaacctggacctggcccaggaaaccatttttccctcctaggcctccaggtctgtgatgggagagactgtggtgaaggtctctgacatgccctggagactcagctccttattagttatgaaaatttctacagccgcttaaatttctccccagaagatgggtttttctttcctatctcattgtcaggctgcaaattttccaaacttttatgttctcttcctcttgaatactttgccgcttagaaatttcttctgccagattccccaaataatctctctcaagttcaaatttccacagacctctagggcaggggcaaaaagctgccagtctccttgctaaagcacagcaaaagtcacctttgctctagttcccaacaagttcttcttctccatctgagaccaccttagcctggacttcgctgtccatattcctatcagcattttggtcaaagccattcaacaagtctctaggaagttccaaacttgcccacatttttgtatcttctcctgagtcctctaaactgttccaacctctgcctgttactcagttccaaagtcactaccacattttcaggtatccttatagcagcacctcattctactggtaccaatttactgtattagtctgttctcacactgctaataaagacatacccaagacagggtaatttataaaggaaagaggtttaattgactcacagttcagcatggctgaggagacctcaggaaacttacaatcatggtggaaggggaagcaaacttgtccttcttcacatggtggcaggaaggagaagtgctgagcaaaaggggaaaaagccccttacagaaccatcagatcttgtgagaactcactcactatcatgagaacagcatgagagtaatcaccctcatgattaaattacctcccactgggtccttcatacaataagtggggattaggggaactacaattcaagatgagatttgggtagtaacacagccaaaccatatcacttgccatgcaaacagctgcctacttcctcacccaaggaagacattgctcatcaacacaaatacccctcttctctccatacctggaaggtctagcccagtggttctcaggcttggttgctcattggagtcacctggggaaagttttattttttgttagtgccttgagtattctaatttagaatctctgggagtggtgcccgagcattgatgatttgaatgtgcttcaggtgattcttacatgtagtcattagtcaaaacctcttgttgagcccagtcatgaagcctcagaatccttcttaaaccaggcactaacaattatcagagtttgtatttaagacaattcctaaagcaatccatgacttatgtcggattgatctatgccagcagttctcaaagtgggagaaccacactgggaatttgttaggaatgcaaattctcaggccctaccccagaactagtaaattttaaagtctgggttagaaccagttttatgagccctccagtaggttctgatacacattcaaatttgagaaccacttctccagccagtagctgtgactaatggcctgacattcaaatcacctgaagcatcaccaaaaacctaccaatgcttgggcaccactccgagaaattcgaataaattaaaatattcatggctttaaaaacaagcaaacaaacaaactttccccaggtgattccagtaggtaaccaagcttgggaaccactgggctaggccttctgagtaatcaaagaaaatgtgtattggcctagctttcagccggtgttgttgtgcatttacctaggcctggagtggccgtctgagtctggggacactgatggtagagtgaggatagaattctccctcaggcaggatgacaaagggcagtgcttcaaggtatgaactgtggccgaggtctgatcaacagcagtgatgaaatgttagaggggccctgtggttaatcgaggggctttgatataaagtgttggagctatccctcactcccaagtcctcttgccccctaatagtagcccgtgatggttctgccacctaggaacttaacagtggtattgttaaactagtatctgataaaattgtatatactcaatgtattagtttctcatggcttctataacaaagtatcacaaactaaacagctttaaacagaaatttattctatcacagttctggaggctgaaagtctgagatcaaggtgttggcagggtcgttctccctttgaaggctctagggaggatctatcctatgcctctctcctagttgccatcaattcttgatataacttggtttgtagatgcatcaccccaatctctgcctccatcttcacatggtattctccctggtgtgttgctgtattttcattcggccttcttataaggatgccagcatgaaatgtagggctcatcctaatccagtatgatgtcattttaacttgattatatttgcaaaggccctgtttccaaagaagatcacattcacaggtctcacagttaggacttcaacatgtcttttgtggggatataactcaatacacaacattcaataatttattgtttaatgataataagaatatattgtgtggtttaaatttctatcgtgttggactttcacaacaacctcaatatactttatgtattataaaccttttggaatagcaggcattacgaaattcagagccatttcatgatacactcggccatgaacctatcacttccaaacttcaaggggatcctctcatgctgcacaacagaaatatttggtgaacaagtccatgaacacaatactcagtattcatgagtggctggatttctgccataatcccattgagattttgtctcacacaagatggtggagaaaagtgctgtagcaatgcccagacacatagaagtgctaccctctgggcttctcaacaataagcaattagcaaaaggaatcagtcatatgcctggactttggcctggaaaacttcatacttgggtgggctctagaaccaaagctatgtgttgtacttctgtaacctcaccgtggcaagacagtgtgctggctggatggtgttagggacatccattgcccattgagagtagggctgaggctcatcattaccatgtccccagcagggtactgaggacagaatgggtgctgcatagatgcttgctgcagactgtctgaagctgagggactaaagtgcctctacaccaagagcttctacctgttggcatcacacctgctggcaggtgtggatgtgggtcagcagatgaccttgaggatgacagggttaggattaattcgctgccagatatcttctcgtagttcaccaaattctacacacacacacacacacacacacacacacacacagacagacacaaaatcttaaatttatcgtatatctgagttaagacataatttttctgaagcagtggttttcaaacatttgaagaattcttggcaacacaactattcaatgcaaagctctgtgtggaaggtgtgtatgaagtcttgaagggaactcagacccctaatgacagtgagctgcctcttcctcttcttctcttctccctcccccatgctccaacagtgacccctgcggcagctctagggaaacccagtccctgcagaaagcagacccatacccttagcatcccccagggaagcaagtcatctggtaccttgtagaaacccctgccagggacagtgctctccccaagcccagtgtcagcacttctgtgtccgtatgaatgcagattcctttccagtgagccccatgcattcttcactgccctgagaatttttccctgatattcctcaccacccaatggagcaagcactcctctatgccccttcctcatacctgcactggggagctgggggctcttagggcactttaaagtcacatggctgtgttggccctggtgtctggtccaagctcctcatgcagcagcagcaggaccgcctggctggcagaaccctgcctgctgcagcagggttccacttccttttcttctgcttccctccacagggctggtcaccatcctctaaattaatagatttcctttcacataattgaagacaagttataatcatcacttgatgatattaattatgtcaataattgatattgatattgattatatcaataatcatcaccatgattacctctgagcaccagaaggcaacattgacaatgatgtttgaaaagatggaaggaaggtttaaaattcctaggaaacaaagtgcccactcttgtgctcccctgactttgcatttccttttgttctgcctcccaagtcagtgtcccccttctcttcagctgagcaggagagcctgccatgacaagctgtcacctgcctgtccaggggctcttctcaaaggctcagccacctgctgggatggaggggggcggcggtgacagcccaagctcagtgttcagtgaggcccaacagtgcaaggtggcaggagggctgtaggctccttgccgtgggccaggcactgccactttccaggcaggagggagcggctccacagctgtcactgacagcccctggggtttgctccagacttggcagaggaggacactctcagactcccaaatcacctctttgaaattcagaagagccacactgtcatctcccctcctctctctgacacaaacacacacaaaagataagcaagccctaactctcttttactcagagacctacactgccaagttttctctgtctcccactctcacacacagattgatacattctcacacacaatctggttctctgtctctgtctctctctctctcacacacacacacacagtatactaattaaactccaattctctcctacctcacttaacccaggtattttgagagaaccaaagcccctcttttctgggggagcccaggccatctcgaggtgtgacaacagcaccttccctaatggcaacacacaacttggggtctctgcactatcagacattgacctccaggtgtttggtagctgctgcttcactggatgaattcttcacctctcttcccagccgtggggaacatgttgataaaaccagtaaattcattcatgttctgggggatgatgagaacagagagtctggctgcagccacagcctaagcatgccctccaggcatttgtcgtgtagctggcatttgagctgaggacatctcccccaccacaaaagcctgccaccatcctcaggggaaattaggactgtcttctttgcagaaagtgggatgtgtgcctggggaggtccagcctggttgcctttattcctcccaggctccagataggaaaccagataaaaatacactttgctgtttgctccttttttttttctgcctagctcgggttaaccatttttacatttttacagtatttttgctaacgtcaaccatgtatctttggtgacttgagcagattgtaagaatgggcagtataaaaatatcctctttcagtggaggcatgaagtaaatgaggaggggagtgagggagctgccgtccctgctctgtgctgttactgctgcagccagtggcttcatgttccacgtagtatggagagagacagagcctaagcatggaaaaaagcatgaaagggtgaaatcctggcatttggcatgaaaaactgaaaaggggggtcatatttgctatagggagtgatgagcttttgaggacagccttggcaagaaccctgtttaacagctgtaattggcactgatgctggacagcacaggccatgccagctgtctgctctatgctcacctcccattacttctccttcaggaactccctgcttcagccattgtggattgcttgtatgtcccagcctctctcttatccctggccgttgagaaagctgctctctgcctggacttccctcctccagtcactttgcctggttaacttctacttgttctctagggctgagcatagtgaaaataatagttaacactgggctgtgtaggtgctgatgagaaactgaggcacagagaggtaggttacttgcccccgccgcacaggtagaaagaggcagtactggtatccaaacccagacaaaggctccaggagttcttaaccaccaccagaaactgcttctctaacagctcctgcctgccttccctgacccttccctgtgttggggagtctcctctggttttcagaacaccttgtacccactctcatcttcaccttccctcacttttcaatgtttttaacaatatattttaagtttctgttttcttgtctgtctccccactgtcctgttcagcttgagggcagggacactggcttatttctgggacatcagcttctcagcaggacctggcacaaagtggtgcttattgcctatttgttgatgggatggatgaatgagtggatagatgtgaatcccttaggtaaacaaaactggctaaggtctggcagacaagctgagggccaagcagagagccaatttagaaacttccagtgtgggattggaggcaagaaggagaaacaagcctaagagtggccctgtagaaaagagcatctctagactctggaatcttgacctccactgaagggctggcaggacagccagcatgtagaaagaccacagcactgggaccattcaaccctcatgaagctcagggctatctgcatgctacagagttagggaaacctgccccccagaggtggaatgcaacaaaaatggggcagagggcagcatagcatgaccttgtagtggcagggctctccaggaggcatgcttcatcactcttctttccttttgtaccattgcaattccttctgacccaaatgtgttagcttttacattgccagggagcaaagaaaaccataacttgtttctcatgtagccaatctcaggtagttccagtgagttttatgacagttacactctctcctcccacccacctcccctgcagcaacattggaacccacatagagggaaccagggcacatgtggcatatccacatgaggctagaagccagcacaggcatgctggtcaccttgagcttctctaactaggcacagcaacatagcttgtgcacgaagcaagaatagcctgtctgtcataattcacaagatatgggagtgagagtttggaagaatgtgcatgccaagttttttattgcctgccttcaatcagaaacctgattgttgggctgaccacggtttctccttctttcagggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtgagtgtcagcagcacttggtcaccacaaacccccattgaagggatcccaaaggcagtagcataccaattcctcctgttttcagctcacggcctcataatctgaacctgcagtgttcagggtaggggatacagggacacccttagcatggatgttggaactaatcaaagagcccagcatggaggtgtgaaaggccctataaccacaaagcctgtagaggtgccaaggccacagtctccaacccaagagacaatgggctgtttccaaatggctgaggaccatgaatagatcagccccaaattaagcagtaaagtctaccctgcttctaagcgttcaggttctgtgttttccttccctgtgaacgacagaggggaaggaggcactggactgggggccagggcctgggttcccatcctgctctgcctctgacggctatgctccattgagccagtcgcagtttctgtgtgggacttgtacctcttagctttaaagagagtaattggaaagggcccttcttccttgagaattcactcttctatgatcccatatcacctatcagtgaaggaagaggtggaaagctttccaaagctgggcagcttcagatgggccacaggagagggtccctgtctgtggggaggtcaacactcccccaggatgccctcaagggaaaagggtgagaaaggaagagatgggtcatctaacatgctttaaatagaggctttttggaatgttccacatgagaacctttgctccatacttactaaaaggtgaggaagcctttttcggatgatttgctttgataagtctccaatgaaaagtcctgcctgaatttcaacactgcctctcaccctctccagggaccaggcctcttttgtgttttgcatacataccctcccgttggagctgagaggattacaatttgcaaagctgcatacctatgttctctgcttgcccttcccatcactttgggagggggcagtttttatccttcccaactgacagctaaaagagaaagaatggtccccagttcagatctgagtccactggcagccagccacactgtaaccccctctgtgctagggtggacactgaggaacttgtcagctatggagtcagcaagccttctatcctgtgaaaggtttagtgccatggcagctgctcggaagattgagaaaggtggcaacttcccagagagactgtggaaagaggagctggggtacttctatgacagtactccctgttgctatgggcagagtggctccagcctggagtgggtgaaatggctgcaccattaaccgggtcctgaagtcaactatggctggtgtctaggtcctctattatctgggattagcaacaccttgcctctgctcctgaagcacatcaaatcagtaagcggtggagttagtgcaaagcctgcttttatgaaatcagctgcaccctggttctgtctataccagctgctaaataagtataacatgttagtagaaaaagcagacccagcagggcgcagtggctcatgcttgtagtcccagcaccttggaaggtggaggcaggtggattgcttgagaccaggactttgagaccagcatggtcaatgtggtacaactttgtctctgctaaaaatacaaattagccaggtatggtggcacatgcctgtaatctcagctactcgggagactgaggcacgaaaattgcttgagcttggaggcagaggttgcagtgagccaagatcgcgccactgcattccagcctgggtgacagagcgggaccctgtctcaaaaaaaaaaaaaaaaaaaagaaaagaaaagaaaagaaaaatcagacccatcttatcctgcccaagaccttaatctgactaagaacaattcagcacttacagaatgaattacaaaactgtctgacaagcaagatttcacattcaagatattttctgtcaatgctgaaaacaaaatttctgatattagacttccagaattcccaagttattcatttaacacacaatcagtgtatgctagttgtgactaaacactgtgcttgctgattctagaaggttttacagtccggtggcataaacatggggctttgagaacatttgagtggaggaggtaagggaagacttcctggatatttgacgtttgagatgggtctcagagggaataagaacatctgtagagtagcagtttattctaattttgcgtgctccttcaaaataaagcccctaagcattgtctcaagtgcagttttgctcctcgtgggaggcaagaggtgacttcatgcccattcagaaagcttcttacaacctggcctgggagagagccaggaggggctcccagctgccgggctgaagcctcactcatcagaaaccaccaagttggtggtggtaaaggattttacagatgacaattgaaaggttttaaggaagagaattgcagaggcaagttggagtgccggtaattaggcttccagagcacaggaaggtctttgaacatgtacagagagtttgtcagccagagagagcaacttggaagttctgctgcttggatctgattgacagagataatgagagtggcagtgtctgtggagaggagctgcagtcttattgaaacatcagagcttgacttaacccactctgccctggtttctccactgctctgagttcctccacttccctctccccagtgcaaggtcgactaggcactacccacagcctgactcactaatgggaaatacatgtctgggggcagccgggagcaggccctgaaaatacaagggcaacaggaggggctctgcccacttcccagaggcgttctagtcactccacccagtcccagagagcacctggggtcagactacctgcacctgatccctacagaacctgtgtacctaccatttctcagtacaggtgaataaaggcaacccctcaccacacctcctccctgcctctttaattagatcccaggacgtttgcttacactggcctttgcaatggccaaaagagttgttgctgaactttcaaaatgagacagcagagagctctgggtaacagttgcctagactggtctccttgcccccagagctttacttttacttctctctggaaatgccatctgatttcattctaatcttcaatcttctcaatagccacttatctcatcctcttgtggaccaatgaaaggagcccagaattcacttctgttttcaactctgctcagtaggacaccctatgcctccaaccttaggccatatctttccatacaattcaaacctggtcattgtcatttacagccatcatcacatggccagaatgaaggtgcttttccactcctccttcctgttccccatacctgctagtgaggcaagtgtgacagagaatgatttcaaagtcccattagaagaccaaagctattttttgatataatgatattgtaatttgactaaattttattgctcagaaatttagaaaacacgcatatcctaaagaagagaataaaaatctccaaaggcattgtacttcaaagacttgagtggataaatgctactcatataccaatgaatgatctcagtatttttttctttgggctgaagggtaaaggacacttttttccctatgtgcaagaagcattaatgctcccagattatcagctcaagtaataacaacaaaattatttacaagaagtaacaaatggagtaaagtcccattttctaaacacaaacatggtagtgggttcccatggctatgctctaccctgaaaagtgagaaaagtccttggtgcttttcaaatactatcttcctggacctccaaaatgagcagtagtaactcccttctttgctgggaagacatctactaaaatagacacagccgtaatgacaccttctgtgtgatgaggattcatcctactactcatctgcgctgtgctcaacacgcatcacttcggtgtcatttaatctttgtaacaatctcatctgtgaagtttcaggaagtcaggtgactctcccaaggttctataggtaataagaaatggaacttggatttgaaaccagccttccaaggtctatgcactatgtagtactatcaccaacacagccaaatggacctgtgttcctagctgacctgcccagaaaggaggaatcagtggctgtttgatgtcctcttaaaaagaaagtaaacacaccaaacaaagagcaaatacaaaaacaaataccagaacagtcttcaaaaaaaaaaaaaaaaaaaaaaaaaatcggcccgtgcctgtaatcccagcactttgggaggccgaggcgggaggatcacggggtcaagagattgagaccatcctggccaacgtgctgaaaccctgtctctactaaaaatacaaaagtttgcagggcataatggtgcatgcctgtagtcccagctactcgggaggctgaggcaggagaattgcttgaacccaggaggtggaggttgcagtgatctgagattgtgccactgcactccagcatgagcaagagagcgagacaccatctcaaaaaaaaaaaaaaaaaaaaaaaagccaatgagatgccatgatgccatgcagtggagacaataagggaaacagaattgagttacattcggtctagagctcacaggcagaagactcagcatgtgcatgggtccccattctcttgatcccttgccaaaagaggttgggtcagctggtcacatcatggagctgcgctctctcagaaaggccctgactccagtgctccttcttgttccaggacaggtggtaaagctgtcttgtcagtgaggaaaattagtatctggggctctagcatctaatgatctgagcagagatgccattagtttaggggaccaccaggaacattaactgccctgcactggaagactttggggacccctggcatcatgagaggttgagtttggactctagctcctcctgctggccctacctaacctgcccttatgcaacccagaaggagctctaggggccattcaatgggtaatcccacttggagattctgtgactgggaccctcaatctagttacttggaaggaactggaaaagggtgcggggtttgtgagccaggctgatgggaatgatgcacagctgctcattctcatagattacttagtttagccccatgcccttgttgcatgccaagaagacagccgacacctccaggggctgttctccaggctgagattactatggcagctcaacagaggcctaggaaatacggcttttgaagtattcaaaacttaaaatcaagcaccgctgtgatttattcccagccctatcttttgctagatgtgtgcccctgggcaaattatttcactgctcatgcctccattttctcatggggaaatggggttaaaatggttgtcctcagaggatagcaggggaatttgattgacaacagtttagaggagaaaaaagattgtcagtgcaacacagtgttcaaaagtgagtactcccagtcactggatttttaaatatagcgataaaattgatgtggtttgtatgcttgattttcaccctattgaatgaaagaactaatacactttgattatctccaatgacttggttatcattttatctcatgtcctatctcatgtcctacatactatgcatagaaactgtaaaaactaaactaactgaaaatactcactttttgaccaatttataaagtatataaaaaagaaagaataatcagttgaaatgaatctcattattttttaagtagaggcaaaaacaccaaaaacaccctgaactccaaattatttcctttgttgtttaaaatgctttaactgtttattttaatataaaattaatgcaggattattatagaaaataaaaaattcaaacaagcaaagagaaacacatgaaaaatattcaggtttctgcctatccagaggcaactgctattaacaccatgctgtatatccttccaaggtcttttctatgcatgtctataatagttggtttttgttttttacaaagcaagattatactatttctgaagttatgcagccagctcttttacctgttacagtatgagcatatttccatctcaatagatggatttttgtagtattactttaaggcctacattgtattttaggccttctgttgcattatgggtgtaccataataaattcatatgtttagcacttgcgtcacttacaattatttttttaatgtaaaaagcacagtgtaggcataattgatttaaatgcatttgaagttagttaagatgtactggatgaaaaaacacaaagatctgaaaaacagacaatgtacttaacgttcctaaaatctttacaaaattactctctggcgtttgtgaaaattaccaaaatctgattgacggtattcattttggaccaccttgttattttgactgttgtcattgatttgaaccaattatttgtttaaccaagcccattcatgttgctgcctcatgaggaatatggcaaataatgcagaggaggcatctagagggtctctagcgtggagtaagtgctccatcaatgctaatccctttcctccctttctcttctcttccaaatgaaagaatgagtccaccacaagttttgaggacatcctttataaatagtgggttcactgggtttcccatgtgtcattgtttcatcactcctagtgccaccagcttccagtaaggcagaattgggccctatgtcttcttaaagagcggagatgctcaagctgttcactggctcattcttcaacaaacatttacagaggtccatgtgtgtcaggccctgcaccaggagctggggacataaagaagtactacaatgtggcccctgctttctaggagcccaatgtctagggggataaaccaagtgcacagaaaatccattacagcggaaggtgtgcaagcacagagcaagggcatctgagacagcctggatcagggaggctccatataaaggggataatttgtgagtgactggctggtggcagtcactcaatcacacctgttccctgtatgtcactgcaggtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgtgagtctagtgaaacggtgatccctaaatatggctggtttcatggtcaggggcatagccagcagcctctgaccatgatcatgttcgaattttttaaagagtatctagttgcagtgtgggccttatgttgaggagagcaacatgcatgaagaaagacaggagaacattgcaatgatcatgatagagaaaatagtgtcttaaatcaggataatggttgtggaaaaaagtaaacgagttttggggatttgagagacaaaatctttatgacttggtgaaggattggacatggatattgagggtgagggagatgtcaagatagcacccggatttctggtttggatacctgggtgtctgctttgaaaatgtgccagagaaggtcggcaatgggtctcactgctccattttttttttcaaatagctaaggatgaaactaggaaaaacaatgttaccaatatatctggggaggttgtgataaaatatgcatatttttaaaaggactacgtctttgaatggtgaggctcctaaattttggtttacaaaggagttgggagccttccgttcccttcagactgaacgctatgtcaacctgtctgtctgggttaactgaactgtgacagtgcccagaggcagagacactggccacctggatgtagaagtcatgctgatttaggattccatgaggaagaaaggttcagcccagggctccactataatcctcattccatcagggatgctgccttccatgaagtcagctgtcaggccagactggggcactgtccatgcatctctgcaatgtgtggtcacctgcccatctctgtctcaccaggccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagagtaagtgatgagaatctctctgtccagaccacacctaggggtcagtgctccttccctgctattgcagatggtgtgagtcctatttctggcctcatccctggagctccgtctctgtatagaccaggcctggacggggagcaccttggaaagatgaagggggatgtgagggtgggatggggaggtggagatccactctgggacccaaatgagagttcttcaaagttatagccatatgtcatttgcctaatcacccagagtctcttccccatttaagtttttaaactcaactcatcaaagagagcatccagatggaaagaacacagccatctagtactttaaataacagcaggaaaagcattgcactgattcagcaacagtctgagatatgtggggagcttgtccttatacttagatagcagttgtcaacaagcatgcatttccatcccccacaattatttaccagtctgtggctccctcaggagtttggaggaatacacaaaataaaattattcaaataagacgagagccagaaagagttttaaagatccatgtggtccagcatttcccccaagaatgttctgagaagcaccagttgtgggaaatgttaataggttctccttggaaaaaaggtcccactgtcaaataaatttgggaaatattgtgtactttatcaccctcttggagattcactgctcatattagcattataaaggccatgagaaatcctgaaataaaggaacccatttaaaattattaaataccatagaaccatatttttgaggggcagggttttatagaactgtagtctgggaaatatttatctggttccaccccttccattcagcagattctgaaattacatgacattggtcctcacaggtggcaaagctgggacacaagcctgcttttctggctgccagttcaatattctgctacctgtccaccccagggcctcagtggttcccaggctttgctgcacactggaatcacctgagggcctttaaaaaatattgatgcctggttctcactcccataccttctgattagttgtggtaagatctgagcataagggttttttaaagctcctcaggtgattctaatgtgcagcaaagtttgggaaccactggattaaggttggtaagggtaaaatttcaccttctacactcacagaagctcagataatcctaccttggaaattaactctacccttcaaacacacacacatacacacacaccggggggacttcatgggctccgtgggctacaacatgtaccgatagcacatattgtgggatctggcagcctgtagtacacatttcttatggtagaagattcattcatccatcagtctgcgaacacgtattgatcacctgttatacaatgggcacagtgcaaggtgctgggattccctccttgcagctgggacaaaccggttgctgagtcccaggaaagagcagtagtgatccacccctatagctgagcccccagggacagcttcctgacattccaacagttttcctgccaatattcctggagtccagctctacctctctgaggtctattttttttttttcagaaatgatggagccaccactttctccagggagatggtttgaatgtgtgtctagctttcgatccactgaacatcagaatacatttcttaaaaactagattaatttcctggtgatgccaaaaaaagatggttccttccattaagaatgactgtcaaatagacagcaaaaataaataaatagaaaagaagcacttaccagtgggaaaccagcttcctcatcttttagagtgaaaaattgatgcccctagataatcagagggactgagttcagggatagaaatgggtgtttatgaagactggctactcccattttcccactgtgatttgactgcctatgggggccattgtcacgtaatcccccaggatctaaaagaattctcttagtctgagaataatcaatgacaaagataaggggaagaccaaaaggaaagtgaaactataaattaagggatttcattcaaagtaaaacatgtccacacactattagagcaatttgatttgtttcttgagaggtaaaagatggaaaaagaaactgagcaacttaataaaatagattgtgggacaatctgtgaattcaaaattcaagcatgcttccctaaagtatttgccaaaaagacatgaacactttgagcatctcaaccagcagcatcccttgggagactgactaccagctgaaaagggcatggtgtgggagagccaaggcattgtggacagagatccagccaagcgttcaccagggtgtgatgtgcagtgtacaaagcaatcagctgtgctgggttcagggggctttagaggaaatacagtcaggaccttggaagagttctgccagcatccctgcatgggtgctgagaaccaacttctcttgtatttgaacactagctccaccactgcttacctactgtgtgaccttgagcacattacttaatttctctgagccctacttgccttgtttataaataatttataaattattataaataataatgcccatctcattagtgtttgtgatgggaggttaatggaatggcacatgcaaagtacttgatccattatctacccatagcatgcacacaaaaaaattgttactgttaaatttttttttctgtccatagcttaattttattttatttttattttttaatattttttatttattttttattattatactttaagttttacggtacatgtgcacattgtgcaggttagttacatatgtatacatgtgccatgctggtgcgctgcacccactaactcgtcatctagcataaggtatatctcccaatgctatccctcccccctccccccaccccaccacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctcaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtgaaagatcagatagtcgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattacctggggcagtatggccattttcacaatattgattcttcctacccatgagcatggaatggtcttccatttgtttgtatccttttttatttccttgagcagtggtgtgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccacaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagcgtttttagcatgaagggttgttgaattttgtcaaaggccttttctgcatctattgagataatcatgtggtttttgtctttggctctgtttatatgctggattacatttattgatttgcgtatattgaaccagccttgcatcccaaggatgaagcccacttgatcatggtgaataagctttttgatgtgctgctggattcggtttgccagtattttattgaagattttagcatcaatgttcatcagggatattggtctaaaattctcttttttttgtgtgtgtctctgcctggctttggtatcagaatgatgctggcctcataaaatgagttagggaggattccctctttttctattgattggaatagtttcagaaggaatggtaccaattcctccttgtacctctgatagaattcggctgtgaatccatctggtcctggactctttttggttggtaagctattgattattgccacaatttcagatcctgttattggtctattcagagattcaacttcttcctggtttagtcttgggagagtgcatgtgtcaaggaatttatccatttcttcttgattttctagtttatttgcgtagaggtgtttgtagtattctctgatggtagtttgtatttctgtgggatcggtggtgatatcccctttatcattttttattgtgtctatttgattcctctctctttttttattagtcttgctagcggtctatcaattttgttgatcctttcaaaaaaccagctcctggattcattaattttttgaagggttttttatgtctctatttccttcagttctgctctgattttagttatttcttgccttctgctagcttttgaatgtgtttgctcttgcttttctagttcttttaattgtgatgtttgttagggtgtcaattttggatctttcctgctttctcttgtgggcatttagtgctataaatttccctctacacactgctttgaatgcatcccagagattctggtatgttgtgtctttgtttccgttggtttcaaagaacatctttatttctgcctacatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaagtgtttattctgttgacttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttcttttgttttccatttgcttggtagatcttcctccatccttttattttgagcctatgtgtgtctttgcacatgagatgggtttcctgaatacagcacactgatgggtcttgactctttatccaatttgccagtctgtgtcttttaattggagcatttagtccatttacgtttaaagttaatattgttatgtgtgaatttgattctgtcattatgatgttagctggttattttgcttgttagttgatgcagtttcttcctagtctcaatggtctttacattttggcatgattttgcagcagctggtactggttgttcctttccatatttagcgcttccttcaggagctcttgtagggcaggtctggtggtgacaaaatctctcagcatttgcttgtctgtaaagtattttatttctccttcccttatgaagcttagtttggctggatatgaaattctgggttgaaaattcttttctttaagaatgttgaatattggcccccactctcttctgacttgtagggtttctgccgagagatctgctgttagtctgatgggcttccctttgagggtaacccgacctttctctctggctgcccttaacattttttcctgcatttcaactttggtgaatctgacaattatgtcttggagttgctcttctcgaggagtatctttgtggcgttctctgtatttcctgaatctgaacgttggcctgccttgccagattggggaagttctcctggataatatcctgcagcgtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgattgcattggctcctgaggcttctgcattcttcacgtagttctcgagccttggttttcagctccatcagctcctttaagcacttctctgtattggttattctagttatacattcttctaaatttttttcaaaggtttcaacttctttgcctttggtttgaatgtcctcccgtagctcagagtaatttgatcgtctgaagccttcttctctcaactcgtcaaagtcattctccatccagctttgttccgttgctggtgaggaactgcgttcctttggaggaggagaggcgctctgctttttaaagtttccaccttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccatgtgaggtgtcagtgtgcccctgctggggggtgcctcccagttaggttgctgggggggtcaggggtcagggacccacctgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgggctccacccagttcgagcttcccggctgctttgtttacctaagcaagcctgggcaatggtgggcgcccctcccccagcctggctgctgccttgcagtttgatctcagactgctgtgctagcaatcagggagactccgtgggcataggaccctccgagccaggtgtgggatataatctcgtggtgcgccgtgttttaagcctgtcggaaaagtgcagtattcgggtgggagtgacccgattttccaggtgccgtccatcacccttttctttgactaggaaagggaactccctgaccccttgcgcttcccaagtgaggcaatgcctcaccctgcttcggctcgtgcacgcacccactgacctgcacccactgtctggcactccctagtgagatgaacccggtacctcagatggaaatgcagaaatcacccgtcttctgcgtcgctcacgctgggagctgtagactggagctgttcctattcggccatcttggctcctccaatcactgttaattaaatttttatcatcattgtgtttgcagtggtttctctatttttatgaaatgctttcacataggtttaaatgagatagtgtatggcacgtgggatgcattcaagcagtgttatgtattattattaacctaggaagaatgcatgggtctagcacaggtcaactataagccatgaacttgttcttattaatccaattcagtgctctatcctggacatattccttgggttcctgattgggcagatattttagttattttgagcccactcttcttaaaaatgcatacattaaaattcacatggaggcagcaaatggaaactcaggggaaaacatcagaagaccaggtgagccccacatcttttcagtctcagtgggtgatcactaatttaggcagaaaactccacagaataactgaagccccgtatagtgtgcacttggagtgttaaaaaatagcagaggaaaattccagtccatctgagggtcaggagacaatgaaggggctgccttagagcccgtacataaggaacacacccctggaacaaggcacagcactcccaggattgcctaagctggaggaagcattagagaagaaggagaaagtgagcaggaaaatctctaattggaagtttgccaaaaatttgggtaaacttaagctagttggatttttgtagcatggctacttcccaagaacatggctttagtgatgagttttgatctgcgaaaagctaacctaacactaaagtgacttcttttctggctctttcctcctagagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaatggtgtcagagtgtgtatccctggatcccagagggttgtccccaaatttcaggagaatccttaacaactgtccttcttctttctaatgtgggagggagggaacacatccttgaccccatgaatgccaagaagcagaatgtagtaaactctctggcactgacgtgatccaaaggaaaaactgaataaataaggcttaagaagtcgctggcaaataaacataaacaatcaccatgaatacactatcaaccctgattttagtttacgcactgcatttgagaagtccacatccaggccaattttgtaaatgtagactgcttgctgtggtttatctatgaacatgcagttgggagtgaagagatatgaggcagtgaaaggtgttatggttgccaagtagctcatttaatacatgcttacactgataatagccttttcccctagtcattgttaactttgatatggggtggttcttaccttctaaaatcaccggccaagattccccgaacaattaaccccttcaaagtggtccacaagcctgggggtacagcattaattcagtggagctcatcttaaatcaccatccatggctgaacccctggagaatggaagtggatggacagaactcctctcagcaagtttgcctgaggctgcaaaggaccccaatccaaccatgcaggtagaagagaaaatttccctttattaattgcttaccaattccatgcacaatttactaattaccccaaagaccccgatccatgagtatcatacaagtctaggcaatttggctaatctattctcaattttccacaggaatgaattttaatctgtcactaaagtcctctggcagaatctttaaccccgaattctcactaccgcctccaccaatgccaactcatcttctggttgtggacaaagcagggtcaaggtgaaagtcctgttaaaccctttggcttggtttcaccatagatcccagaatggagacagcaagaatccaaagtgcacaagaggaaagcatgaggggtcagcagagccaaggccagggtgcctcgaggcacagttttcagtgaggtgggcacgaccaagatctggacacccccaacccccacagatgccctgcacaaggccccacccctacacccgggatgaactacaggaacacatgaagcatgaagggaaggagatgtgtcactagtgagtgagacctcacacattacctctgcagcactgggccagtcatgaacctctctgagcctcagtttcctcatctgtgtaataggaaaataatacctaccttcaatgaagagtacctaacattcctgagtaggttctctatgccaggcacttatctaactgccttacatgcatgaaatctcttcctcaccataaccttgtgaaatagtagcaggtaatttattgttcccaattttggatgaggaaactgagagacaaaggaccttcccagaaaacacaatggtggagtcaggattttgattcaggcaatctgactccttgcttttaaccacttaccccagtgggtctcacacttgagtgtgcattggtatcacctagaggtattgttaaaacaaagatcacaggccccacctttgggctcctgattcagcaggtctagagtggaactggagaacatgcacttctcacaagtttccaggtgctgctgatgctgctggtccagggaccatgctttgagaaccactgtattaccccagcctaccttcctgagaattagtgataatagacataaagctcctgcttcaggaaataatagtgatcgaggttcttgagatacccagaaagaagggaacaaaccctcacacttttggcatgaagtgattgatgggaaaggctggttcgcatcttgtgtctcttccactggcacatttagctccagggggggctttcctaacaccttcaaagaagctctgtggggagaattatgtcagtgagaccccaatgctctaaatttcagctacatatgctgcctcatcatctcacagaagactaaatccaatttggacccttagttaaaaacacactttgcacaagggtcagtggcccatagccctgagaaccaggctaaagagatggaacctgcagccatgctgtgcagcccagggtgtggctcacagaaaggggactgctcagccagcacacctgcagccactgggagtccggtgggcggaagtcacacgggggcaagtgggagatgtttaattaatgttcccgggtcaagggtaatgggaaaggaggtgatttgtggagaatccttggagattatgccccacctttccacaccctctccctgccccttccagcactcaaagacatgaatgactggtagagaggtagataaatctacagactgtatgtttattgtatcacctgggtgtccaaatacattcacacactactgaaattatgtgcttcttcctgccttccacctctccatatgtctccttcccaccacgttacatgtggagccaggtcactggattcttgccgaggccacctgggataattgaaattaaatgagaacgtaaagttttccttgaccatgcacttaagaagagagcagagaaattagtgagggttgaggaataggactttaggaatatcggagggcaggaagactgagacatagagcaggaagaagagaatctacaaagtatcagttaaaatgaaaggttctaacagttccctcgcgttctaagaaggccttttcggggagcctgggaatttcatcatcttttcagaaatattagtggctctggcaccaactggctgggggcatggtgaggtcactgtcagtgaagcaagggggaaggcacagccatgacagggatcagccacaaacaggcaccatccagagcactccaaggacactcagtgctaaaagaggtcttaagattcctatcagcccgagttctgcattggctgagacttgcagtccgtgtagaagtcatagagccatttctgaaagtagtgagaggttttgtattgttcaagatatcattgggacagcaggcaggagcatagtagaagggaatccctgaggtcacagaaaggtggccaaaagaggaagggtgtgtctggatcacactggaaggtcactcgagttgactgaggtccaatggcaactatgttcaccactagggagtctcttgagaccagccatttccaaataagaacagttatacagaggtctgagaacaaattatcagtccctctcagagagtgcaagccctggtagggggtggaaggatgtgttctgcagacctgattaagagtggatgggatggatagacctccatcactcaccggggaaaaaggagagctctccctcctgcatccctcctgggctggccttgttatcactggtccttgaggggttctcatgccgctgtgagtcatgacttagcacatagtatcctaacagaagcttgtggtaattctccaaatgaaagtggccacagggcacatcctactcacctatgtactcagcactcagcacactgtctgacacacggaagatgctcaataaatgtgtggtgactaaaataagtttgaattgagaaagtttaacatgtcattatttcacctacaaaagtccatgaccttaaagagcatgctttaaaataatttaatccctgggtatttagttggaatctttctcaattactctaactgctatcaatcgtagcctattctaattttagttttgtgaagtttaaaatgctccttttaaaccctgtttgaatctttaaaataatgtcacagttttccccagagcccaagcctggggtgaggcagcctcccactgagtgtcagtcatcgtgcaaaggccttgagatgtaggaatgaatttgatgttgtccctggtacaatggcagcaaattcgacggacattgaagagcagaggtgaaggatggcccaaccctctgagagcagaaccagggctgtgtcctgctggaagatgtctggctgagcggagaggatgggcagcacttctctggccagtgaaacttcattggtgttttgtacaactacctctactctaaggctttcttccaagagttgtttgtcctttctaaagccactattactctaagaattcttgtggcctccctttcaccagaagaaaaaaaaatgttgaaataagaaaacaaaacaaaattatgggcaaatgagctacttctaagcagctgagaaatactgttaaatgagagaagttctctttaccccaagaaaactttggttttctcttctggtcttatttaaattcatatttgcatgtacatgagcaactgctatattctgaaaatggctttctgacagaatacaatgacaagtaaatttcaactacaatttttatggcagaactcaatgttgtaaataactccaatgggaaaatgaagagggctatgggagcatagaggcggcactaccattgtcccaggcagttaaagaaggcaaccccagggtggtctgctaaactggaacctgaggaatgcaaggagttatcaagttgagggggtgatgtcagtggtggaactcaaattgtaggtagaaggaacagcaagggccaaggttcagaagccagagagtacatgacgtgtttgtgggctcacacactgctggagaggctggagtatacagtgctccctctgagcagctggaggggtagcaggggctagagcatgataaggaatccaggtattactctgagtgtaagctgtggaaagtaggttgaagcaagggagttatattttatacaaatcattctggccacaaaatagaaaaccgaatggcaaaagttgattcagggagactagttgaaagcctggtgtaataatctcagcagatgatggcagccggggtgaaggcgtagaagtagcagtggggatggagaaaagtggattgattcaagaaataagaaggaggcaagagcagcagaagggaaagggggattggctttcaggggtgagggaaggaagagttgaggatgacactccaaatttctgatttgggaaaatgggtggatgttgataccattcactgacatagagaatacaaaaggaggaagaaattgtgggagagggggacaatacgaattcgagttgcctatgagccattggatatagggctgcataattcagcaaagagatttgggctgatgaaatagatttgggagccatcctttgtctagatggtaattaaagccacaggagtagaggagtttactgcatgagaatgtgagtggagagagaagtgagcccacatgggaccctgagaaacaactatatttaacaaatgtccaggcaaaggaaggctcacagaggagtctggacagagtcactacagagagagagaaaaatcaggaatgtgcagtgtccatggagccaatgggaaaaatctcagggagggaatggtggtcccgattcccagtgttgccaaaaagggttagtattaggtaaggattaaaaactgcccatgtgtttagccacaggaaggcctgggtgaccatagtaagagcagtttcagcagagaggtgttggtagaagatgctggctgagtcgaggaaagagagaacatcacagtctttcaaaaagagtgactttgaagaggagaagaaaagtaaggatgtagctggaggctcttttcggtggttgttattttgttattttttagtgggaaagacttgaacatgtttaaaagctaatgaaaaagattccacagagagagaaaaagagaaagaggataattgagagggtcagaccccaagaaggtagggagttcaggtggagggatggtatggcttaaagtgaagcaattccaatttggtttggaggatgaataaaggaagcatggcatgagttcctggcagagttcaacctcaacttccaatttcctcacagtctaatcacttagttcccacaacctcttgtgatgaagagccgtgattgaactcacagaccttgccatggcaatgtgagagtaatcaggcaagcacacccatttctaatgaaatgggagagtgggcaatgagaggatctagtgagaaaggaagatgaaaacatcacaggctcttctcctgctcagaagccctcagtggctacccaataccagtttctggtcatgcccacctctccaggaaatgaaggctgcagaaagtgtcccgtgtctaaaccgtatggctagaatgaactgcttccagttctgagcagcttgtcctccttttgctagattgttgtggctctgtgttgactcttggagatctccctcacccccaccctgaagcaattgccttcctcctccagcatacactaggaaaggtctggacccaggaggctgagcacacaagcacctaaccccaaatgccagtggagtatggcatgccaactggacttctgtgtgatcatagacacctcagggatctctgaccagagccaagatgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctgaaagtaaagggagtcttctcttcttagtggatcttacattcttcttagaatgtgaagggaatctttctaccagctaattagaggaggtgctcctgggttgggggctgaaattagggccacttgagaagttctcaaaaataataatcataaattaaataatataaatggtaatagcaattgccatttttttgagtgcttactacgagccaggcaaactaattacttatacaactgttattatacccattttgaaagtgaattaactaataaggttcagagaagttcaggcagcttgttctagatcacactgaaaagcaaggattggaactgagcctatttgcctgaagtgtgttctctgagttaccaagccatatccccacctgagctagatgccttctggaaattcctactggccacctgagtcctgccacacagtgcaggcaacatatgtacactctgaggctttgtgtctataaaatgggagtaatattcaacccacagcgttttgcaagggtgaaatgaggggccacacataaatcacatagtttaggtcctggttgttgggagtactcagtaaatggtggctagtatcagtttactttccttctagcgatttggaaacatgatataaaaatagaaaatgaatgggtccctgaggtttgttgtaaaaagtcgtcttgccttctgataaaggtcaatccttaacctccatggatgtgggggttttgtgaacttcatggttacgtgtaactgtcatcgtaatcatttctccccttcgccttgcatgtttgcagagattggagctgagctttgccttgctcctgggtggattcccaggctgcttgccatattggaccactggctagattctggaacttcaatatgttgtataggcacattgcttgctcattcacacaggcctatggcttttcatccctgctattaagtcaaatatcctcttccgattaaagcccaatttctgggcctattagtccacatgaagagatttcttcagttaaataactgttcagagattttcttgtgactgaaatgtcatcctcggggtcaatctattgggtttccaaaagtgtggtgagtgcaccatcagggggtgagagggtttcaggacacatgtacccacatcctttacacatttatgttagtgtacactacagaaaaatataggtagcacaaaaacatatacattatttcacactaattataatgttcctttaaaaataagtttatgaaagtaaaactggttcttggttttagggaaataatggtaactaaaagataatacaattaatgtgtggatatggtaaaacattgtggagggaactgaaaaattcaaatgtggaaacctatgaatccttatgacctctgtccccatttcccaacaccatccctcttgcacccatcaagtctgtcatggtccctggtggccactgctcaacccctgccctgtcccacctcctctcacctggctgcttcctggctctgcttcaagcctcagctctacttgaaggatcccagattcctcccacttgggttagctgcttcttctctttgcccactccattctctgtgctcctcaccatcacagcgttcagccctctgtactatcacggtctgttcatgcatctttatccctgggagctccgtcaagcaaaggagtgtgtcttattcgtggctgaatctgcaggcctggggcactgtcttctgcagtaaatctgcagaataaatgaactaataattgaatccaggcacctttgccatcagtcacttccaactgaggaagacaaaagaccaagcatgctcattgattacattgattcttcttgaagttacttcacctcaggctcaaggttgggccatgtatattacaactctctaggactccgtggacataaccctgctcacatgatttcatttgtgctctctctaaatgaaaatacagcagctgggcagggcacctggtggtgggtctccctgtagaatagagcagatggcaccaagcctttcatctattttgcccaggaaggggagagctcctctgcctattggtgacctctagccttactcacagtccggtattttccaaacacaaagtgcctactgcaattttgaaagatattctgacatccaatttaacaattaacaatttttttattgtttttttcccaccatggggctcagctcctgctgagctgtttcacagagagggcagtttgccaagcattaacttgtctggcccagggggcattactgtacagctgatttcatttgagtgaacatcattcctttggtcttatttgcaaactgtcatatgctgctgagatttagttaactgtttatggttctgaaactcatggctagccagagtgcaagaaaactgagcatctcttccagactcctgtgcaatagatctaacctattaggagatggcaaaatgtttccactgaaggtgagatagttattatattaggctttgtggaccatatggtctcttttgccactattcgtctctgctattgtccggtgaaagccgtcattgacaatatttaaattgatgggtgtggctgtgctcccataaagctttattgataaaaacaggtggagggttgcggtggtatatgtaccatagtttactgaatccttgtgtaacttaatgattaagaccttctgctctgtaattgggccaacctggacatgacctgcctaaggtggactggaggggtggtggctagagtcagagagcttggggcagacttcaggaacctaaaatatttgtaaaagcctcaccaactaaatcctgatcccagggactatctagtcagcctcattaggcagtccctaccaatgggtcttgcagtcattcttgaaagctggtttcaggagaatcttagtatactgtaacatggctaaccaccacagaaaggtataaacaaagcaagcctcccagaatataacatgagtggtgaaaagcagatggttcatgatcagtgttaaaaagccagtgttcctggactaaagcaccaggaaaaggaaccgtcagtaactgtggactctgatttcttggcaaatggtgagaccttctctggagagtcaatgggaaaagtagaaacatataagcaggtgactcaggagagggcggccgtagtgaaaggctggaggagagtctccaagaggaaacattacgtatttgtgtatttgtaaattatttatttgtatatttgttcatccattcattcataagtctttactagatccctataaatgccaggcacacctttactctaagggagctcacagtctaaaaggggagttaacggggaaattaaaaacaacatgagaagtgccgcaatagcggcaggaatcccgagggagggctgtggagctggtttgtgagggtttgggccttctggattagggatctgaaaggaggcaaggaggccgtttccagacaacacctagctgttcaccacatgcaggcagcaccaggtttgcccctaggagaggctggcttgagaagcttggccccaagctgccatcacccccttctcccccacaccagggcccatgttgctggctttgaaggaagtgccttgatgaccagaccctgcctggtccccactctggcccccaggctaccggcccacctctacgctctgagcccccagagtttccctgagcactggggagagatttaccgcactccatacacgatggggaagtcatcccttttccagcccatgatgcgaagcaagcataatcagctgccgcacacatgtaattagaagaaataagaccagtaagaggaaattggttaagtaagcccaaaatgacttttttataatgaagaaataaatctcagataaaagaagctaactgaagccagagcacacactatctttccttttgtcgcacaacctattttcagaagagaagccaagatcaccttacaaagcagggttccacctcattcagaccatggggttggtgattctgcttctggtgcgcaggtggagggggttttgggtgaatcccatgtgcactggtgcacttctgtagacccaggcagctgcttctctgatcccaggactcccgattgcatttttatctcagtcgtgttccctgtggcagaatctgcatccctgggctgggccctgtctcctcataccccttcctctaaatgtatttgatgtaacttcccattgggcagctgcccctcatgcatgctcaccgcccctcactcccctctcactccctcctcctttgctctgggaaattcttttcagctgtcagtcccacttctacatttctatggcaaccacaacccccagcctcattgcctttccccaccttgcatttatccccaccccccctcttccttttgcaagtaggattttctaggaaagctgctgatagactggggttccagtaattttcttcataaaataaacagttgagcagagggagttgggggcagcaggaccagctgagggggccactgggaaacagagagtcgagaaagcaagcagtacagtgcagtgcacatatgaaggaagagtcctgggtgcagcagttgacagcctcaaatccacctgggcccacagtactgagcgaggtgtggcagcctcccccgaggcatgcagggacagagtgccaagtgttagcactgactggttgccatcacagctgcacagccaggaaggggcaaggcgggtcaggccccagaggagacatgcctgccaggctgctctgacacagaccaaagggagcgaggacataagctgcagcccgcaggggaaattatcccaaatatcctcattacaaaggcaagtgcctctgaacccatcagtgcttaactgccggaagtgccctctccttggaagacagggccattttaccaactctaatggccatttacatccatcctagtccactgagagtcccaggctcctctgggtactgcaggccgccaagcaggtgtcagggagagggcaggtgcaggaaagcgatggccaacaggagggcacatggctgggggccaaggaggcaggccacttagctggagggagtaagcacgtaggagctcagagaagagggtaaatattattacgtgactttttataaatgaaagaaatatgtttttggctgctaatgaccttcaaattagcagctttttcagaaaacacttatgtatttttaattccaaacatagctgagtgtcagttgcagcagcaatgaaagcagcagggcagctggatagttttaaataagagggaaccgagatcattatttttgaaactgtcagcttttacgcctcttaatggattcactttctgtcatctcccccgaccctgctatggtctttgaagattcccaggcattctctgtgggatagaggaagagaggcacagccttgtcatgtggaaggacctgggctttagttcccaccttgtctataagggcatgacagtaactggcagggagacttagcacaaagtgtttccaaagagcatgggagagaaaagaatttcagcctgggatacagggactcagggtttctttctctagccttcttctgatttcatgttagaaaaagagatcagtgacctgagagcatctgaaggaggaatggagaggacaatgacaaagacaatgagggagagaaggagacagatagagaaatgccatgagaggttgagggatagggaggatgagcaagcaataggtcagcgcttcgcaatgtgtgggtctctggccagccacagcagcagcagcttcacctgagagcttagaaatgcaacttcccatgccccagcccagatgcactggatcaggaactcagggagaggacccacgatctgtgtttttataagcctttcaggtggttcttatgctcacaaaagtatgatgaccactgacctagagcagaggaatcatggcagagagaggaagagaggagtcaatggcaatggagaaggaggaaaacaagagagaagaaaaatgtggggatgagtcagtggggctccagacctctggccttccacaaatacactccacattgttttggaaccatcagccctcaggggactgttccactgacactgccacccagtctcaccacgtggagcctctctttaccagtggggttcctagcagagctgacctctaagtcgccagtgacccccagctataccaggcttcttccaacacagggagagggtgcaacatcatttcactggtctgaaaaaatggggtttctgctcctcttttgctcacgtggactcctgagcagcctttttcactgtgcacttcacttttattttcagctaccagaaagatcagctaccaggttaaattttagataaaagttgagctcttttccaagctgtgaggccagtggacaaacagaaaaaatattgcctatttgttcttggagcacctagcacttaaagcatgattggccctaagttaacaatgattgttcaaagttaacaaacgtatgctttctataaatctagccaatagacctttattaagtttctagtttgtgcagaggtaactctggcctgactgctgcctccttggtaaaaccgggggtaagaacccttgccaagaggccccgacgtcacccagacctcagactggtactcactttctccaaagactgtgatcttctcaggccccatgaccaaataggaaatattcttgctgtttgtccactggcctgtttgtccacagccactctggaaatgtgaaaacatcttaaggaggttcctgggactattctgatcttggcacagctaagtaaaaccattcatttgacaatatttacttattagagactctaagccacctggaaacaggcactattttcaggtatttgggattcgtcactaaacaaaacacagatctaggtccaccataggatttagcaagaagcaccaataactaacactaaacgtaattcataaattatctagtacctttgaagatgaaaagtacacagaaagaagaaaagttggagagtggggaaagagttgttttgaattaaattaaggtgatcaggacagaactcactgaaaacgtgggatttgagcaaatatttgaagtaaagggagtgagccatgatggaagagtctttcaggcagaagctgctggagctatcacctggtgtattcaaagaatagcaagttgactttccaattgctatataatttaagcctcatcatgccctaatgtactaggtattattactagcatttcacaaatgtaaaacctgaggcttaggaaggctgcatggattggcaaaggctgtcccaatagtgtgtggcagagctgttattccaatcctgactgaaccgatcctaaaacacatattattttttaaaatacaccttgcttcccagtgtgtgaagatgggtgtggggatgctgacaaaaaataagacacagaggccagccacagagacaagagagatgccacagtcagtaggcaccggcacacggcaagggagttccgaccatatatggtttgaccatcagacagtgaaggagacatctccgccaagaacaatggtctcacactggaaagcatgaaattcatgcccaagagaaggtacaagtcctacgccataacaaaaaaattaaagagaaggctgccatactaagagtatttaaacctcctgtcccaaatgactgatgtcacaagactctgccagaagttgtctgatgggaaggaattgaggcaatctgggtgaacattgctgggaaagtcaatagccaaaatgtggtggatgaacatcatgaagtcctatgtgttccagaaaatgggctactagactttcacataaccacctgcatagatttttaaattttattttaatttataatagacaataattgtacatattatgaatatgtatatagtgatgttttgatgcatgtaatatacaatgatcagatcaagataattcccatatcatctcaaacatttatcacttatttgtattgggaaccatggatgtccttcttttatctatttgaaactatataatacattattgttaactgtagtcatcctacagtgctatagaacactagaacttactcttcctatctagctgtaattttgtgtcctttaacaaatctctccccttcccttccttccccctacccttcccagcctctagtatcctctgttctaccttttacttctatgagaaccacttatttaaagatcataggtttgaatgggcaaaagaagagaaggatgggtatataatatgacaatacacattttataagaataaacacaaccaaaatatctgtactgaacacaatataatgactgtttatgcttcggaaggatgaagataatctaccccttcctcaattacttcatttgctgcatatatatacatatatgtatatatacacatatatacgtatatatatatacgtatatacatatatacgtatatatatatatctgttatgcatatataaacagatatgtatatatctgtttgtggatatccgaaatgcttcattagtctgtcaacttttattccaggcagcgctatcttaattaacacagcctcagtgcacattttaatgtataatgtgagtcatctatctttatccactttttataattctcatagctgttttcgtctgtacattttccaggtaaatcatgggataatttcgtaaaattccaaaacatcaatatgtttactgatacagctctaagtattaaattgatatgaagagaatggacatatttaccagatatatcttcttatttacaaatatggcatttctgtccatttcttcaagtagtctcttatagtcctcagcaaaattttgtacttttcatacatatgctgtatatttcttgctaaaattttatatagtttatattttgctgtagtcagggatctattcttttttattataatttctaattgttttaaaatatattttaataactgcccaacatattgagcattatttttgttaaatagttatttaagggattttattatttttgttctttttttatttaggcatataatagtacagtctataataaaagagagtattaattctaagtcatcaatttttaaatctaattttcctgccttatcacatagtctagaacttgtacaaaaatattcagtaacagtattggcaaacatagttatcttttttcttacttaaatgaaaatgtcttcattgtttcacagtgagatataattttggttgctgctattatacacatattgaaataagggcatttctatctttgttttactaataatttttatttagaatggatattgtattttttcaaatgcattttagcatttagaaagaagataatatattaaaccagaattgaattcataaagtaaactctactttatcttggcatattttgtttttaatttactagtggatctgatatattacaattttacataaaattcttgcttctgtattaataactatgattactggatagtttccttatttgtgtattcatgctagccttttcagcattttactatcaatggtcctaattgtcattttaattaaactataagggaaacaatgtcaaaatttgagtcaacagcttgataaattcaacatcttggtaaactcaagcaaattcactcatgtaactatcacccaaatcaggaaataaattcactggcattaagcatcctcccactaactatgcccccaaactgttttgcattcttttgaaccttatacaagtggagtagtatagtatatattattctgtgcttgatttgttctgctcaaatcatatttgtgaaattcatgtttttataatagtaattcattcattttgacagctgtatagtatttatttgtatgatcatataataatttgtttctttactccattattatacatttggactgttttcagttttctattattatgaataactgtactatgaatactctgacatgtgctctttggtgtacatgtttttgatacatgcatgcatgcacttctattactacatacctataagtaatattgccggatcataggacatatacatgtgctgctttagtaggcactttcaaatattttccaaagtggtgaaataagatgtaaagtttctcccaaagggacagctgccaattttttaatctaaatccaagaagctcttggggccaacttggctgagtccttgaatatactattttcatttgataagtgagacttgttgaacactttccaacttgttagtcactgagtctgagctgacccaccacaaaatgtgcagagagtaacaagcacctcatggatcaggtgttcacttttgacaagtgcaagctaatggatgcttttccaaaggggtgtaccttagaagaatgcaggagaagtcagaggggaagtcaatgtgatgatggaggccataactggaatgatgcaatttgaggatggaggaaggagtcagtaaccaaaggatacaggtgactattagaaataggcaagaaaatggattttccatgcaaagcctcagaaggaaacagccctaccaactccaatggcccaatgaaaatatctttagacttctgacctccagaaccataagagaatatatttgtgttgttttaagtcactaaattgtgacagcttgttatggtaacaataggaaactgggacaagtaataagccatattcaacctcctttaaaattaaagcctaggctacttaaaaatggaaaaaaaaaaaaaaggtgggggggggtggtgtacttgagtatcatgaatgtacccacatagtcccaagaagctttgcttggagagcagggtttgcaccctatggctggcttggacttagcttacacagtggtgaccctcgaggagcccacattaatctgtagcatcatttcccattaccaagataacacctcctaaattcccattcagtttccacataaggaataggggaattttccaaggtggcagggttgacagcaaacatttatcacaatttctttaggacagtttctcattctgcagtgcatcactttgatcattattgtaaacccaattcagggcagtaagactctgaatactagtcaatgtatcatttatggtttcccaaaggagtttgttttgaggacaattcccttattttagccagtacctatagcaaaaagctctgaccctgttactatagattcatctacaaatgaatctatggagggcctgacagactgcatgaggggtggaaccataatatgacctgctattcccactcttccttaacaaacattatgcatcccacgcccccttcatctcccaggtcaatcagccaacggtttatcagtcttcctggtttctgcacatagtggtcacaatttttctttcttttcatgctaagtataggtgtgtgtttttgcaaatattatttgatagaggtagatcttctggctccctgctcccaggaataatattcatattatttattacagtgtggtgaatttgaagctgaccaccagagtggtgaggaaatacccacaggagaggagagttgtaacatccaagtccctttttaggcagttttcttcgaatctatttcccagtacttgacctgcaaccacatccgcaattccttctcattaacccacaacaaaatggaggacaatttatgcctggttgaacatacactttgttcaatatgtttgctttccctaaatcccattagtcagttcactaggtcctcatccttcctcttccagaaagtcacacctctgtcagcatccatcttcactgccaaaagtgtcaaaactgtggagagtcggagattttactctacatgtaagctaaccagtcaccttgccaccatttcacgaatgccagtagaagacacaagactcctagtcagagatgaaggacaatttactactcataccaatagcagtaactaaagtgtcattatttgggggccagttccctgagcctcaattcccatagggtaacatgatgagagccagatgacacctgccacagtgtgctgcattacagaaaaggacccctgaacttactcaacagttagtgttccctttgctccagaaagagactttatctttattatactggatagtattaataattaggcctgcaatttgctccagagggtgacactatctccgtccaccagggcataatgcaaacattcttgagaaaatcatccagaacaaagggcaatcattgtgtggcccacaagacacgcagaaaaatctgtggagaattacctcttaacataaaatttgtgtaaagttcaccgttttgagatatacattcctgtgaaggtatacaaatactaaagtcatatgaccactaccagaatcaatgtagaatactttttaatcactgcacaaagtttctatgtgctcctttgtcaaaaaattatttcctccatcctcagctcctggaaaccaataatcagactttggtctctgtaattttgccttttccagaatgacatataaatgaactcacaaagaacacagccatgtgtgtctggattcttgtgcttagcacagtgtctttgaaattaatccatgtaatgtatgtgtcattagtttatttggtttttattcctaagtagcattctattgtatgcatataaaacaatttcttcatcatgcattcactggttgatggcatgattggattggatcatgattggattatttctagttttttactattttgaataaatatgctacaaacatctctgttcaggttttctctgtacagttctttgtgtgaacatatgttttcatttcttttaagtaattagtttggagtaaattcttgggcaatgtaagaagttcatgtttaactttataaaaaagcggacaaactgctttcctaagtggtggtaccatttttcttccctagtagcaatctatgaacattgtcagttacttcacattcttgtacttgatatggatttttcgtttttccggtttttaaaaatttcagtcattctaataggtatgcagtggtattccattgtggttttaatttgcattttcatattgattaatgatgtcaagcatcttttcatgtgcttacttaccattttgtgtgtcttcttggtgaagcaactgttcaattctttttcccattttttaattgggctgtgtttcttctcattattgagttttgagagttctttttttttttcagttttcaaaattacatatccttgtggctatcataaggagacagctcaagtgtagatcaatagcaccctggaaattcctgaactttttttaaaaagttgcatatatttaaggtatacagcatgatgttttgatatacatacacacagtgaaatgattatgacagtcaagcaaattgacatatctatcatctcacatagcttccactttttggtaggtaaaaatatctaaaacctactctcttatcaaatttccaggatacaatattattaactacagtactcaggctatactttagatcactggggttatttatactacataactgaaactttgtgccctttgacctccattgccccattttcccaccccctgacctctggtaaccatcttttttacctctatttctatgtattcaagttttgtttttgttttgtttgtttgttttgttagtttccacatgtaagtgagatcatgcagtatttttcctcttgtgtctggcttatttcacttaccataatgtcctttaggtcatcgaagctgttgcagcaatggcaggatctccttttttaaagttagaaaatatccataaatatacactacaatgtctttatccattcatcaactgatggacatttagggcgttttcatatcttgactattgtgaacaatgctataagaaccatggagcacagatatctttactatctttacaaggcggtgatttcatttcctttgcatatacacttagatgagaggttgctgggtcatatggtaactctgttctctaatttcttcagaaacctccatattgctttccatactggctgtaccattctacattcccactagcagtataccatgtttaccttttctccacaccattgctaatacttgttatctcttgtcttttttaaaaaaatagtataaagagaaaaggattaattggcatggttttgcaggatgtggagaaagcatggcactggcatctgcttctggtgaggcctcacataacttacaatcatggcacaaggtgaaggggaacagacacatcatagggtagaagaaggagcaaaagacagtgggtgggggtcagaggcaggtgctacacacttaaacaaccagatgttgcaagaactcactcagtgtctggaggacagcaccagtacatgagggatcctcccccatgacccaaacaccttccaccaggccccacctccaacactggggattacatttcagcatgagatttgagcagggatttggatatatcaccttgattctgcatgaaacctgtccacatggttagctcagacttccacacgtgacagttgggttttaagagattgtgaatggaagctgcaagctttcttgagggcatctttagaaattgcaaatcatctagtctattggtccaagtatgtcacaaggctggatcatatttaacagtcaacatttcaggctgagacaatggggttttctagatatacaatcatgttgtctgcaaacagggacaatttgacttcctcttttcctaattgaataccctttatttccttctcctgcctaattgccctggccacaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacatttattgatttgcatatattgaaccagccttgcatcccagggatgaagcccacttgattatggtggataagctttttgatgtgctgctgggattcgttttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacgtctggtagaattcggctgtgaatccatctggtcctggactctttttggttggtaagctattgattattgccacaatttcagatcctgttattggtctactcagagattcaacttcttcctggtttagtcttgggagagtgtatgtgtcgaggaatttatccatttcttctagattttctagtttatttgcgtagaggtctttgtagtattctctgatggtagtttgtatttctgtgggatcagtggtgatatcccctttatcattttttattgcatctatttgattctcctctctttttttctttattagtcttgctagtggtctatctattttgttgatcctttcaaaaaaccagctcctggattcattaattttttgaagggtttttcagcaacttcagcaaactctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaaaaggatacaaacaaatggaagaacattccctgctcatgggtaggaagaatcaatattgtgaaaatggccatactgccccaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcacaaatgataccacacatctacaaccaactgatctttgacaaacctgacaaaaacaagaaatggggaaaggattccttatttaataaatggtgctgggaaaactggctagccatatgtagaaagctgaaactggatcccttccttacaccttatacaaaaattaattcaagatggattaaagacttacatgttagacctaaaaccatcaaaaccctagaagaaaacctaagcaataccattcaggacataggcatgggcaaggacttcatgtctaaaacaccaaaagcaatggcaacaaaagccaaaattgacaaatggaatctaattaaactaaagagcttctgtacagcaaaagaaactaccatcagagtgaacaggcaacatacaaaatgggagaaaatttttgcaacctactcatctgacaaagggctaatatccagaatctacaatgaactcaaacaaatttacaagaaaaaaaacaaacaaccccatcaaaaagtgggcgaaggacatgaacagacacttctcagaagaagacatttatgcagccaaaaaacacatgaaaaaatgctcatcatcactggccatcagagaaatgcaaatcaaaaccacaatgacataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacacagatgtccaacaatgatagactgggttaagaaaatgtggcacatatacaccatggaatactatgcagccataaaaaatgatgagttcatgtcctttgtagggacatggatgaaattggaaatcatcattctcagtaaactatcgggagaacaaaaaaccaaacaccgcatattctcactcataggtgggaattgaacaatgagatcacatggacacaggaaggggaacatcacactctggggactgtggtggggtggggggaggggggagggatggcattgggagatatacgtaatgctagatgacgagttagtgggtgcagcgcaccagcgtggcacatgtttacatatgtaactaacctgcacaatgtgcacatgtaccctaaaacttaaagtataataataaaataaaaaaaataaattaaaaaaaaaacagtcaacatttcaaaaggtacagaaatatactctacctcttgctaggaaaatggtcagtgtcacattgcagaaaaggcactgagaatatatgctaaattatattagaattataggagttttacataatttcagaacatatacatatatacatatacaacatataccaataacatatagaccaaagaaatatagaccaaataaaatatagaccaaagaaagccagacatcatttcatatttgacagtgcttcctgtatgatttttgtaccaaataagccaaatgtcatctttgaactttagaggacctaatatctaaaatattaggtaagaaagagacagaatttataatttgattttggaaaatttgtcaaatatcaaaggtttaaaacactggatatcacaaaatagaatcccgggtcaccacaagtcatttatttggccaaaatgataactcccaaaaaaattttaaaaaagaaaatcctttactctgatagaggagacttagctttcaaacaagacccaatgaagatagcatgaggccaactgaatctgtctcttctctctctcctcctttcttttttctaccatttacccaaaggagaaaacaaaaccctttcattatcttttaacattacataaaaatcatcttcaaaagggaaaaataaattttatgcttgcattagtgcatctttaatgttaaagctagttttttaaataaaattttatgtctctacccagttttaattagtttgaccataaggtaagattttcatcaacttttcagaaccctttacaatattccatcaaacagcagatcagttttctaagaaaaccctgttagttggacacatgggcccagattctggcttcacatcgctatgactttaatgttttaacctaaggaaaaaagctaaataatttcttttaaatcttagccaacttgcttacacccacagaatttttacaagatcaaccctttacaaaccctttccactttgcttaaaccttcagttttgttccattgctcttttaggttaagacagtcattaaaaccctctgaactagacaaaattacattccctttaacaaaagccatattcccatgccttcttataatcttttaccaaaaacacactccctacacaccttgtatgtaaaactgtttctccagtggtctcaactacatgtaacaatgttaactcttagcaacttttatttttagtgaaaaatttgataagaaagagattttaattatgtactaggggtggagcctaggacatcagacagaaattaagataaggtctgactgcttttagcatagctagcgggcatggctttccatatgtccccagcccttacctataatctaatgctccaaagtaggtaaatcaaacaattttcagaagtcaaagaaacagtttgacctgaaagcatttcgcaaatctgatatctgaccttaatttagaccaaatgtctacgttttcaaggcgtttgattttaccaataatctttaaaactgtctttatttccaaaagattactaaagtcacacaaacaaaaaggcattaaagtttctatttttctgacaaaatatttgatttaagtgcttatttttctaagccaactaatcagagctcttttatatataaacatacagcacataaatacacagagacagacagaagattcagcacttgtaaagtttttcatttgtcagtttcttaattggatgactattctccatctgagaaacctcctcaaaatcttcctgattgagaagaagtctcctaaaccaggactcttcctactagttagaaggagccaaatgagacccaggagctgaacaaacactctacaatgaggctacagacacagacaccccatggtggagctacagatgccccacaacggggctacagacaccccaccataggactacagaaccagtagggagaaggaagaatgcattggcagagcctaggatgctcaccaatctagacacccaaccatggggctacagacagataccctgtgatagggctacagttaagggatgtctccccacgactatttctctattgcaatttaatctaagcacattgggctggcagtgccccaccagtagagagagtaccagagtcagcccccagtccaagagaactaggcaacctcttgggctggcttctggatccatcactggagggggtcactgaagcacagccaggtagccacaagggcaatcctggacaagccccgaatttgtacccacccaagaggttcaccttgcctactgcctagacagagccaattcatcaagacaggggaattgcaatagagaaagagtaattcatgcagagccagctgtgcaggagagcagagttttattattactcaaatcattctcctcttgtctttttaaaaatagccattctaacaggtctgaggtgatatctcattatggatttggtttgcatttctctgatgattagtgacattgggcacctttttttcacataaattttggatattttatttttttctctggagaaatgtctattcaaatcctttactcatttttttttaccagattacttgtctttttcctattgggttatgggagtttttaaatacattttcaatattaacttcttatgtaggaaaaactgaaagcttttcctgtaagatctgacataagacaagggtgcctactcttaccacttctatttaacacagtactagaagtactagcaagagcaatcagacaagaaaaaaattaaaagacattcaaatcagaaaggaagaagtaaaattatccctgtttgcagatgacacaactctagatgtagattccactaaaacactattggaactaataaactcagtagagttgcaggataaaatattaacatataataatcagttacatttctgtacactaataatgatctatctagaaaagaaatcaagaaaacaatcccattacaatggcatcagaaataataaaatacgaatcagtttagccaaggaagtgaaagatctctacactgtaaactataaaatgttgatgaaagaaattgaggaagatacaaataaatggaaagataccacatgttcacagattagaagaataaatattattaaaatgtttacaataactaaagcagtatacacattcaacacaatccctatcaaaaccccaatggaatttttcacagaaatagaaaaacaattttctgtattaacacaaaagaccctgaggagccaaaataatcttgggaaggaaaaacaacgccagaggcatcacacttcccaatttcaaattatattataaaataatagtaattaaaatagtataatactgacatatatagaccaatagaacagaatagagagcccataagtaaacccaagcatatatagatgttcctcaacttacaatggtgttgtgtaacaataaacccattgtaagttttaaaatatcgtaagtcgaaaatgcatttaatactcctaacctaccaaacatcataattcagcctaaccaatcttaagcatgctcagaacacttagattaacctgcagttgggcaaagtcatctaacataaagcctgtttttgtaatgaagtattgaatatccagtgtaatgttttgcatactgtactgaaagtgaaaaacaaaatggttggatgggtaccattataaagtcaaagaattgtaggttgaaacattataagtcaggaaccatctgcacagtcaatgaattttcaacaaggccaccaaaaagacacaatgggcaaaggatagtctcttaataaatagtgttgtaaaaactggatatccacattcaaaagaataacactggacccttatcttacatcatacatgaaagtcagctgaaaatggagtaaacgcctaaacctaagacctgaacccataaaactgctggcaaaaaagggaaaaaacagaggaaaaagctatttgatgttggctttggcaagaacttttttggatagctcaccaaaagcataggcaacaaaagcaaaaaataaacaagtgggactacatcaacctaaaaagtttctttaacttttaacttttcttttttgtttgtttgtttgtttgctttttgggttttttttttttttttttgagacagggccttactctgttgcccaaactcaagtgcagtggtacaaccatagctcactgcagccttgaactcctgggctcaagcaatcctcctgcctcagcctcctaagtagctaggactacaggtgcatgccaccatgctcagctgttttttaaaaaaatttttgtatagaaggggtcttgctattttgcccaggccattctaaaactcctgacctcaaacaatcctcccactttagcctcccaaagtgttgggattacaagtgtgagccaccatcctgggcccaaactaaaaatttctgcaaaacagagttctttgtgtattccggagagatgtattttatcagactttttttcttgcagacattttcttccagtctatagcttctctttttattttgttaacattcaaagagcctaaattttaaattttgattaaatcaatttcagtttttaaaatttttattttatactttgtgctttcatgttctagtaaatctttgcctaacttaaggtgaaagcatttccttttattattttctttgataagttttatagttttgtgctttatatttcttttttttttttttttttgagatggagtctcgctgtgtcgcccaggctggagtgcaatggcgcaatctcagctcactgcaagctccacctcccaggttcacgccattctcctgcctcagcctcccaaatagctgggactacaggcactcgccaccacgcccagctaattttttgtatttttagtagagacagggtttcactgtgttagccaggatggtctcgatctcctgacctcgtgatccacctgcctcggcctcccaaagtgctgggattacaggcgtgagccaccacgcccggcctatatttaggtttttaatctattttgaatttttttcacatatgatacaaggtatagtttgaggtttatttgtgtgtgtgtgtgtgtgtgtgtgtgtgtgtgtgtttgtgtatccaactgtgccatcaatatttgctgaaaagactgttctttatccattgaactacattggcaccttctcacaaagtcaactgaataaatatttggatctacttcgctatctctattctgttctatttattagtatatctaaccttttacacatattatactgtcttaattattgttgccttatggtaagtcttgaaatgaggaagaaatattcctcatttcataaggaatattatcttctttaaagaaaaatgtttaactgttctaagtcctttacctttccatatagattttagaatcagctttctgacttctacaaaggcctgctggtattttcaatgggttgcaatgaatttatagatttatagatatatcacttcatttatttagggcttatttgttacccttcattaatgttttataactacatcttacaaatattagaatatattttgttagtactttgtatttataatgctttcataagtggaatttttaaatttgtattttcaagtgttcatctctaacatacagaaatataatttattttatattgacattgctaaatttacttataaattctagtagccattttatacatcctttgaaatttctacatagacactcatatatgtgcaaattaagacagttttattccttcttttccaatctagacgcctttcctctttttgttgatttctttttattcttcctctctctctttttttctctttctttcatcctttttctttttcaccttatttccctggctggaacttccagtaaaatgtatcaaaatattcagcaactataaaacttacaaaagataatacatgataaaatctacatgaccttggacttcgtgatgaatttttaaatacaacatcgaaagcatgatccataaaaaaattgatatattggacttcattaacattaaaaattctgatctgctgaaaccactgttaagagaatgaagagacaagttacagactgggagagcatatttgcaaacacatatctgatataaggcaagtatccaagttatacaaagaactcttaaaatttaacaataaaaaaattcaacctaattttaaaatgggccaaagatctgaacagacactttacccaaaagatatacagatggcaaataagcaattgagaagatggtaatcatcatttgtcgttagagaaatttgttaaagtacacaaaattacaggtagataagaataataagttttagtcttctataccactataggatgactataattaacaataatagattacatagtttcaaatagctacacggaggatattgataaggatgtggaggaacagaagctctcatttattgctggtggaaatgtgaaatagtacaaccactttggaaaacagtttggcagtttcttacaaagccaaacatacttgtattaaatgatccaacaatcacacttctaggtatttacctacctgttttgaaaacttattaatatgtgcacaaaacctgcatgtgaatatttatagccatttcattcataattaccccaaaatagaagcaaccaaggtgtcctttgataagtgaatggataaacaaactgtggcacatccatataatggaataccacttaataataaagaggaatgaaccatcaagctacactaaaacatgaattaattttaaatgtatattgctaagtaaaataagccagtctgaaaaggctacaatactgtattattccatttatatgacattttgcaaagaacaaaattatagaaatggtaaatagatcggtgactgctaggggtttaggtcaggaagagagagctgaacaggtgaaacagggatttttagaatggtgacattattctgtatgatactgtgacagtggatacatgacactataaattcgtcaaaacccatagaactttacatcacaaacagtaaaccttaatgtatgcaaattgtaaaagatcatttaggaggttaaggatcccagggtggaaattagaatgtgacaaaagaataaactatattacaaatgcatggaacaaccacactgaaggagataggacaaaaggtgctgatctaacctttggaaatgaatagaagctataagactgaaaacaaaaagacttgaccttaagcactgtactgtagttggtaaaattgcttcccatgaaggtacaggtcaataattctgaaagcactatatatatatactggaattgaacaattaggtaaatggatggcagatggtaggacacagatttctcactgttggtgtaggattttgcagatgagcatggaaggaggataaaacaattcatgtggtactgaattatagttgaaaatgtcaatatgagttcatgtctagcttaatatacattcaaatgttaaatacaggaatatttatagacatgtatatattcattggttagcatacacatatctattccctgctctgtcagttgagaaggcctagaagtgatgtcatttcgatagcaacaagcataccaaaaactccagctttggttttcataccattctccagtaaaaagaacagggctatttattttatttcatttgtatttttatttgtttggagaaatagctgattctagggctggagcaagaaatatacaagatgagcttggagcatcactcaatgccataaagaaatgtttaaagaacaaaaaacgcataatgatgaggatatgacaaagggacaaaggagccaactgaaagaattgtcagtggccaaagctggaacaatttgagcaacaaaataaagtggtattagattataagccaaggtacaaaataaatattcaggagctcacactgacataaataaatcattgaataaacaagcaaatacatcagtacataaatgggggaggaggagaggagaacagacaaatcagccatgcaaaattcccagcaattcaagaagatactctgcttaaaggaagtgaaatgtaagtcccaactccttaggtgtgggtcacacatactgacttcctttcagagtcaagtatggaaaggggggaaaagggaggagctttatggtggagaggcctgactccctcacccaggtcatcagggttaacaccaacagtgataagtcatggttataatgtgtttactttacatgacttgatgaaaatggcactttacctctgatcttcctcccagtccaatcatgagaaaagcatcagacacacaccaactaaaggacattctacaaaatacctgatcattattgctcaaattgtcaaagtcatcaaaaatacggaaagtctgagaaactgtcataggcaagcagagtctaaggaaacatgatgactagatgcaatgtgacaagatcctagaaaagaaaaagacatttggtaaaaactaagggaatcaggataaagaatggatttaattaataataatgcacaaatattggttcatggactgttgcaatttaaccatactaatgttgataataggagaaactggggtggggtatatgggaactctgtactgtcttcccatttttctttaaaactaaaactattctaaatttcacaagtttattgaaaatttaggatgataaaatttcataagttgtgtcaaaagaaatgcttttagcacatatgacaacaaaagactaatttctttaacacataaagaattcctataaaaccttcaagatatcaataacttaatagaaaggtggtccaggtttaactagatagttaacaaaaatgaaattgcaaaagacttttcagaatatagaaatttgatcaatattactcataataagaaaaatgcaaagtagactacactgagataccattttcactgatcagatgggtcaagtctgataatatactttgttgggagggagaaagaatgatcttcactctttgtaagaacataaatacgtacaaactcaatggatggggacttgacaatacatatcaaaatgagcaatacatacacactttgaccagctcttttagctcttttgacatctaggaatatattctcttgaaatactaatctatgtgtacaaagatatttatacaaggagaatcattgtagtattgtttgtataacatcaattacttttttttttttttttttttttggagacctagtctcgctctgtccctaggctggagttgcagtggcgcaatctgggctcattgcaacctctgcctcctgggttcaagtgattctcctgcctcagcctcctgagtagctgggactacaggcgcgcaccaccacagccagttaattttttttctatttttcatagagatggggtttcaccacgatggccaacatggtctcaatctgttgaccttgtgatccgcccgcctcagcctcccaaagtgctgggattacaggcgtgagccaccatgcccggccacatcaattactttttaaaagccagaaatctatcattagtggacttgtcaaaaaattacacgtatgtaaaatagagagtgaaatacaatgtagctattaagaagaattgaagttcctctacgggtactgacatgtaacaattgcgaagatacaatgagagaagaaaaacagcaaagttcagaatattgtgcacctaaaattaactcttattaatatacaaaaacagcaatttaaaagaaaattgcatccgtagaaaactggacaatttaaagactgcaatcagaaagcaaaatgtgtttttagtaatcaaatatgattgcaaaaataaaaaaaatattgcatcttgaataataagagcccagctgaaaacaaagttggttccctggcaaataaagttatgatagtgtctcaaaacatagagcaaaattaaaagtattattgaaaggtactcgcgagactgaggcaggagaatggcgtgaacccgggaggcggagcttgcagtgagccgagattgtgccactgcactccagcctgggcggcagagcgagactccgtctcaaaaaaaaaaaaaaaaaaaaaagaaggaagttaaggagctgtcagacagatacagcagcttcaacaccctcatagaagagatttaaaaggagtaaactgaaaaaagaaaatggttagtggcaaattttcaaggaaatgttagaagaaaacactctggagctaaagaaagagactcttttgactgaaaggtcccaccaaatgccaatagagattaatgcataaaagcttttgacaaattatagatttttaatgttttaataagaccactcataatgaatatctggcttaaaaaataattgatgttatacaaacaatactacaatgattctccttgtataaatatctttgcacacatagattagtatttcaagataatatattcctaaatgtcaaaagtgctggttaaagtgtatacatactgctcatttttatatgtattgttaaatctgcatccattgagtttgtataatttttattcccaccaagagtgaggagaattcagtgtctttctccctgtccaacaaaatatattatcagactcaactcacctgatcagtgagaacgatatctcagtgttgtctacttggctttttccttatgtgagtgatatcaaaagttctgaactccaaagaataaaagatcctacaacttcctagagagaagaaaacaaggttaccttaaaagaagaaaaatcaaatggatgcagacttttcaggtccaacaacaaattctagaagacaaaggtggaatgctttcaaattctgagggacaaattatttgaaccaagaattctatgccagtctaaatgatcaatcaaacgtgagggtgaaatgacaatttagaaaggttaaattccattgatgtacattttctgaaacagaaatgctcaaggatatattcccagatagccaaaaaggaaattaaagaaagaagaaaacatggactttcacaatgaggtaactgctgtgcaacatttatagggcatagtcccataaaaacaggaggatagaggacttccacaaagaaagaacgtttttgaagaaataagaggatttcattcaatccatagtataaagagaacacataaaggtcttctattagtcaaatgtgaaaataatctccggatgtttagggaaaatgaaaagctgcccaaaagaaacatggtcctgtcattaaaaacaaattaaaaatgaggcatggccatgagctggaaggaatgagctgagaggggtgtgagaaaagtgcaaagtatttggctttactttctaagcagtcttccttagtaacaaaggagaatgtgtatttttgaaggaaaaaaaaacagaggcttgggaagtgcaatgagttttgtttgtttgtttgttttgaggcagggtctcactctatcacccaggctggagtgcagtggtgccatcacggctcagtgcagacttgacctcccaggctcaagcaatactctcatctcagcctcctgagtagctgggactgcaggcaagcaccaccaaacccagctaatttttttgtattttttgtagagacaagatttctccgtgtttctcaggctggtctcaaactcctgggctcatgcaatccacctgccttggtctcccaaaatgctggcatgagccactgcacccagcctgcaatgaataatatttacatagtcataatatttacaatgctatttttttggaattaacttatgggtaggttatggctaaaataactaaactatagttacagaataaaaataaatgttacaaacttcgaccacataaaaggtgcaagggagagacaaatgtttatttcctccccatatattgtggggagtagataatgtctaaaatgttaaaaaacagaagtttgattatgttatttaaaaagataatcatttagaaaactagaattaatgctgtctgaagcttgaacataaaagaagatgagcatattatttaatggtacccatcagaaatgccaaagacaagaggcgttataagtggttacagcggagaggaacttctgtgtttgggctgaagtggaaaaactagggtaacattttccgtagtggtctctactgtacactgtaaaattgtataataatatgcatgtttgcttctataattaaaaaacaaaaaatatttgcttatataataaaaaataaaatgaaatagattactaaaccaatgatcagggaacaattagaaaataaagcagtgattaattaaagccataataaattccaaaaaaagaccttgttaatgtgatcttatgaaaaccgagcggaacacttgtattctggtcttggctttgccaagaactcactttggccaagtcatttcctcccttgcgcctcaggttccttatcagtaaaatggaggtatgagcttcacaatctctaaattctcagctatagctttctaatattctaatttgaactttccttcacattttgataaaattactagcccagcaaattaagtgtacccccacagatatctgtgtttcacactatcacggtgttttcacatggttagtctttttatgattacccatgtggttagatgcaatgatgcgggttggagggcagaccagctcctgagcgatcagtcacttctaatgagtagggttataggcttatggcaatgtggaaggcagcgtagtatgtagctcagtctttgttgacagggccatcaacatatctacatgggacctgcagagaggtacttaggattcctactgcagaaagtcagccaccagaagcacaatgatgggatttgtgggaatagaccccagaccccaggcttgagctccttggatggcaggcataaggtggggtggatacaacattctctgtgaggaaaggactcattctgaaggagaaggagaagaaaggaatatgtcacttgatcactcaacctcaacagaagtgggtccagcttctggagggagggagttgtagtgacagaattgttcttccaagggcactgaaaggaacagagaggatagctgtgctgtttggtggacacccgcattagtttcctggggctgctgtaacaaagtgccaaaactaggtggcttaaacaacagaaatttattgtctcccagttctgaaggctggaagtctgaaggcaaggtgttggcagggttgcttctttgtgaggctaagaaagaatatattctgtctctcctctagcttctagaggctttctggcaatctttggctttccttggcttgtagaaacatcacctaatctctgctttcacgttcacatggtgttctcccagtttgtgtgtccctgtatccaaatttccactttcatagaatgataccagtcatattggattagggtcccacctactccactaagacctcatcctaactaattacatctgcaatgcctctatttccaaatatggtcacagtctgagaaacaggtgggggtggttaggacatcaacaaatgaatcttggagggcacatgattcaatcgatagcacttcttaattaggtaaatcctagagctcttcttgttccacagtacaggaacttttggcgaaaagaatattaggaccagccaggaagaatggcttccacctcatgaactactgtgcaagtgatggtaggaggtaggtgacctaagggcagcatgattaggcacagctggcatggctggtgatgggggctcaaagcaagaagaggggagctgcaacacctgcaagaggtggcaactacttacgacataccagttggcttgggggtagttgactccccattctagtcaactattactctaatgatgctgtacaaaaacaaaatcaaacttcccaagttacatgattttttgcattcagcattctgtgggttgatggggagatggggctttattcctcaggctaagggccaacttcaaatcttctcctagggctcccaattccaggaccactagctacccagagcttactcttcccaaggtaggtggtgtgcagcagaagcataagtcaccaagccaaattgcaccaacaagttcagacctctgttcatatcaccctggctaacatcctattggccagagcaagtcacctggcccaaacccagcatcagtggattaggtgtgtatgcactgactactccactgagagatgctacagtcttgcagcaaagggaatggaggtatgaaatcttccaggaaggtagtgaacaggcagaaacaatatctactgtccaaaactccagctttcatttctttttcaaatgatgaaattaacccatttggaaaatagtcaaaagcaaaatgtaaaaataaaagtcccaccatctggagacagccactgctaatatgtttttttcttttgcttcactattatagtgatcctcataaaccactctgttcccctccctgcagttattccctctaggcatgaaaaatcagggcatgcttattagaactgtgaaggaaagagcttctatgcttaagaatcaaagtaaaaaaataaaataaaataaaaagatttaattcactggaatactagaacacagccagctacatgaaactcaataagaagacataaaatatactacatttagatgagaaaaaaaactgttcaagatggagagatgaaaacttaataacacttcatgtgagaaagatctgggtgttccaatttatcataaataaaacaggaaccaatcacaaagctgctttaacagatgtatccaagctaagagtagaaagtgtgtgtataatgttatgtatgtatctgtgtgtgtgtgtgcgtgcatgttcattatttgaaatgcagaacacattttttgagagatatacaagaaactactaacatggttatctcaaagtggaggaggagtactggggagggagttctttacttttcattttatttcctttcatgtatatgaaattttttaccgtaagtgtatattatttttatattgtaaacgttgtttaaattgaaagaaaatgtaacagagatgatagaaatactgttggggctggataaacttattcagtttggcatgctggcttttattatttttattacaatgacataatatgacagcacaagagattgttcaatatatatcctcatagtttcagtcatagcacatacacaattctgtaactgtgattttatcatttgactgtagcagtctttaggcacataagttctggaattagtctgcctgggcttttgctgtgtgatcgtgagcaagttacccaccctgtccaggcctcttttaccacttttaaaatgagaataccattgctatctactttgtggggttattgtgatgactcaaggaggcaatcactattatgcttcgaacaaagcccagggtgtagtcagtgctctctttaaatgctagttatcagctaactaacatttggtttattatgagtgcttccccagctgtctatgtaatttctatatattttctatgcataatgcataatatctcatagcctggatatgtcataatttaattaatcattctattgtttggcatagaggttacatgtaaacatatgtgcatgtgtgtatgtgaattgctatgaagatgctataaaacaacacttctccagctttaatgtgtgtataaatcacctatggatcctattaaaatgcagattctaattcaggagaaccaggacatagcctgagattccgcatttctagcaagcttccaggtgatgctaaaactgtaggtccgtggaccacactttgagtagcaagttataaacatctaatgaaaataggaggattaagagggacttagaaacagttactggagaaacaaggggtgatttgcctggctacgatgagatgttgtgtctcttgaataccttcaaatacttggaagcctgtcacataaaaaagaatcctgattctctggaacttcagaatacagactaatgggtagaagttctagggaggcaaaatttctgtcaatataagaaagaactttgttacaggtcctgtttatctctacagctttaggagtctgtgaagtaacatcattggcttggccagttaccacagtgacaaagctaacacccttcagcaaagctagggcaatgtggaatcaaatgtccccaacatgcagtggcagcttgcagggaagggactcttctaagaaagtgcatcaagtggaagaccttctgaatgttgtcaaggaggaaccctggagttcccatgatattcttcatgcccctgtggagacttgcagggtcctcttctgccctgaggggatgtactgagactttgtcacattgctggaccattctgcctctgagttcttcacagagccagactcttcaagtctgcctgcagtcacactactttctaactccagtttcctggctctaggtttctccatgaacttgcagtctatagattgccaaggcagcagacttcagtgacagatttttgctcaccacgtggccaggaaggatctgggcatgtccttcaatgggttgtagacatcccgtcctcctgctagcagaaatcaatggcacctaaattctctcttctccttaagtggaaagcctggcttgctctccacccactgagcaggaacagctgtggatctgtgggaaaggaagagcaccagatttcccatcccagttttgcttggaaactgagtattgccagggtccttaggtgacttctgaagggcaaaggaaagaggggaatcactcaggaagtgagttggatatcttcaaggacagtccaggctctgagtggagcagtgcccatggagccagcaggggaagaggtatcctagagcaagacagtatggcctgggggccgatgagtgagacacaggagagaccctctcaccagtgatatcctacagcaggaccactcttgtcctgagtgacagctctctcccaattccagaaccatcttcctccttctcaacccagcacaaaacctaccaggcagagccttttcctctcctgtcagtcatttctgctacaaaagaaactaggtacaagattgaactgtttttttctcacaactcttctgacactacatgtcaagggtggggttatcacaccaaccaattctccaactctctggacaccaactgagtgtcctacaattcaattcaattatgacgctctctactcagagttaacactgaccccataggtaagggctcagtcccacaagactttccctacttcagatgtcagtcttaagtcttaggttgccatgtgtacttctggctataaatgggggaggagcatcccacaaccccatgtgcagacacgataattttctaaaatagctcacagaattcccgaaggcactttatttactattgtggtttattataaaggttacaactcggagaaacagtcaaatggaagagatgcatggggcaaggtattgaagggggcatagcattttcatgccctctctccaggcacaccaccctctcagcaccttgatatgttgttcaccaaccctgaggctcttcaaaccccattgtctatggcttgaatggaggttacattaagggttgattaaatcattggccattagtaattgactcattctccagcccctgttccctgcctggaggtcagggaggtggggctgaaacttccaatcctcttattatgcctaaagctatctaggggctcccagccagcagccatttcatcagcatacgaaagacactctgatcactccaaagattccaaggttaggagctttgtgccaagaaatggagacaaagatcaaatatttgttttgtattatatcacataggttagtgagatactttgcaaaattaaaacttggccagacatggtggctcatgcatgaaatcccagcactttgggaggccaaggcaggctgatcacaaggtcagaagttcgagaccagcctggccaatatggtgaaacctcatctctactaaagatacaaaaaattagccgggcgtggtggtgtgcacctataatcccaactactcaggaggctgaggcaggagaatcgcttgaacccaggaggtggaggttgcaatgagccaagatcgcatcactgcactccagacagggtgagactccatctcaaaaaaaaaaaaaaaaaagtaattaaaactcaagactaacatcctctctgtgttatctaaggtgctataataagacagacagcgttagaaaagtgaaagaccacactattagtcgctcacagacactgctgtgaaggatggagaaaacccagaaggcaggaagcacctccaacattcggccggggtggggtcagatggtctttctcacatgtccatctcctgaccagatgatgagtctccaagggtcgatactgtccatttgtcttgtatcccctgtgccagccttcatgtaccacacagagctggttcttgataaacacatgctgaattactgtgtctttggatgagaggaaaggtccaagaaaggacagaaaggagataggagagtagcagcaaggaactctccagcacaagttctggcacatcataaagatccaccccacaagacagtaaaccagcttaccaggtgcactgcctttttcattaccatctgagaaatggttatcatttctctccaggtcaaagaatagggacattaaatgaatcaactgaaggtatttcttgagcgcacattatcactgttcttccctatgccagcatggtcaaaagttatgtaaccctaagctccaagctactcaccttgacatacccaatatcttggaacagagaatgtacctgacaaaaattgtctggtgaatgaatgtgaagcatgagaaaacaatgggacataacatgaataccttctcttcagtttatttctacaaggggcaggaagaagatgtgaagaaaaaagaaaaaaaggaaggagtgatccccagttgacacctaattattcagtctggaggaattctgagctaagtttgtgttgagtgtgactgatgctggcaggtggaactttagcctgagttgtgctggtggacacactgttcgctgatggtggtgaggggggctcatcaacagcttactgtacatcacacttgttaggttctgagtccctcctctgccctccctggccttacactgatctctctccatttgattatcttacaaacatttttactaggcaattaaatgcttaatttggataaaagaagagagagtgcaaaaacaatagttcacatgcacatataattagcattgagtggattaaatcacataagacccaaactggaagtatggagaaaatgaagctggagatgtaaagttgaactttttgttaagaatggggaggaagacaggtgtcagcttgatcttaccagtgtcttactgaaactgtattttattatatctccccactccgtcttgacacaaaacactcacttaaaattatttgtttcttaacagtaagtttacaaagccctttggatcacatgactgctatggtaggtttaaatgcattatcaagacatcttcaagggatagaaagtataaaaggaggggttttacatgctttgtgtgaatggcttggtttgcagcatctttcagagctggggaccagtggatgagggagaaggccttatgcaacctaactgatccactatttggtgggttggccaggatccaaagattgaccagtcctaaggccctagggaaaagtacgtgtccaagcattaggcaactgaagattgaccaagcagggtagcaagagggaatagtctccttccagaataaaaacaaagcccagtcacccatgtttggaagtaggttaaatttaatagataccatttactcagaatttactatgttctaagcactgttctgttttgcatatattatctcaattattaggttgctgtaataatcttgtgatagaagtattacagattttattttgcagtgagaaaactaaggaatagagatatttaactaatttacccaagtcataaacctagtaagtgatggagacagttctgtaacttagatccgtctgcatccaaagcctatgcttgtaactactccaccactaccaacctactgaggagggtgggtttccaagtggggagaaatagtagaaccagtcagctcagattctcactgccaaggttctgcttccctttggatctcattaatagccactgccacctcctctgggttactctcggtggtcaaactttctctttcgcattctgcccaaacagaatcctgaacatacctcttatggctacaaccaagccataaggctggaaaagactttacttgatactcagggtaccaccacaccccctcataccatcaggattgtcttgtttgtttttaatagagtaggttgtccataaatgtttgtaacatggctgctatagtttgcttttgtttgtcctctccaaatctcatgttgaaatttgagctctagttttgcatgtggagctaatgggaggtgtttggatcataaaggtgagtccctcatgactggcttgatgccgggctaatgataaatgagtgagtttttgctttatttgttttcatgaaagtcggttgttaaaaaagagcctggcacgtccctgctcatgctctcgctctctctctctctcatttcctctctcatcatgtgatctctgcacacactgtctccactttaccttccattataagtagaagcagcctgaagccctcaccagaagcagatgcttgtgccatgctttttatatagcctgtagaactggaagccaaataaacctcttttctttataaatcacccagtctacagtattcctttatagcaacgcaaatggacttagataatggcatgaggtaaccaattacaaaataggaacagctttctagagctcatctctgtagccctttttactggctgccctgtacccttctgggggacatcatcaaaataccctttacaaccctggagtacatgcttaggtctcttggcataaaacagagttcctcatgagaactccagagaggcaagtggcctcctatacccaactggccttcataaagtcagcatccaggtgactgtccagagggatacccttacacttcagaggagacagacgcaaggcacagtccaagcacagcagatcatggggtcagtgcaggcagcagtgggtaggaggagatcttgccaatttctcctggcaggtaggacaacaggaaaaggcaaagaggtagcactgaacccacccattagcagttgggagcctagggcatgagggtagggaagataagcccatgtccagtggttacaacatcccaagatatagtctgggaagacatttactatgaggttatggcacaggattcaaatccgaagcagcaaaggaccctggcaggtgtgcatagcattgagagggcatcagtagctgggtccagggatgggatggaaactgcaggtggagatcagaagggaggaggtgacaaagactgagaacaagacaaaatctgaaaggtatcaggaccacaacacagactcaggggaagggcaaatatctgggaggcttgaggtcaaccaggccctgccacagatcaggaggagctggaacccaaagatgaggttttaccaaagtgaatgaagcaagtttccacagggtcaaatgaagattaaggcagagggctgatcccagaaaagggtaagcaccttggttctgtaattcagaacacttgagatggaacccacagtgagactgatggaacccaaaccaacatgtcacaggccccaagctccttacagagctcctgcctggagctggacatggtccctgaacctggcagggctgtgcctgcatgcaagggttaaatagtccagctacaggggagggcagcaagagccagtatctgagcaggcagctcatcccatcactctccttccatctagtgtgatatcaactgaagatcagccatctgtggaaatccaatagacatataacatggatatgtcaagtaaatcaatctccaattgacctggaccagccatttctgtttctcaccctgagcaagtgccacacaggagctggctgacagtgcactccacaatgtcatgaccttctagcaggctgtcccaggttccagttcactgtgccaggctcttctccctggggtgccagagcagctttggggtatgtgcatggcctgacggcagtctgagtgtcaccaagggaaacttcatgccaaaagctatgctaagttatgtcagtgtccttagcaggctcaggggacactaacctcactgccaagagcaagcaactcagcacttgcccatgaggggttgagccacagatctagaaatctctggtcttttctcaggggtctctaatcccctgggcaggaagcttaaagcctgagttctcagcactggtattaaggctgcccttccccagctgcctggctctgggttaatcccaacccaaccaccaagagacaagaacttcatttcccccatgataggctgtgagtccttgccaggacatgagtccttattcctgtcagtctcttctcagggctggatcctgctataacaacccaaaggaactgtgattctggaaggcaaggcctacccacatcatctccgtgtagtgaggttctggtactgaggaggggtgtgtcaggttgaggaatgaattaatgaatgaagaaatgaagacagacacaaatgagaatcatctctatccacgagagcttttgttaaggagatgtgtccagaggaggaggcaatttctattcttttgctgccagtatccagaccttggtagaatatgggtgtgctctgatgacagaaaggcaggtatctgtaaaccactattaccaaagcattaatcaggtatttatgtcctgctttcagaatcagctaacaagagagctctgcctctctcagggcttgaggccttttttttccttgcagaggttagggtgagacaactgcttttgcaccatcatcgcaattccccctgttcctccttttccttcttcctaacaaccctcagtctatacataaagatatatgcccacactcacacacagagctgcccacagcagccttaattccacctgttccagcattaagcatctctcatctgtcatttctgtattttcagatgccactggaatgaagctctccattcattatttggataatgaaccagtggtggcctaaggctggcaaactagaggctaatcaatggtcttgggacccaacacattttgatatttctctgctcccatccccgcataccacacaatggcacggtgggctgtgagggtgctgaagtgatatgtgtcctttgggtagagttttgggagggtctgtgggctccagcagctccatctttgggtatagctcagggaaggcaatgcccttgagacactggtagtgacagatttcacagactcaatagctgtagaggaggccaggccctttgtcttaccacagtgagcagagtgggtcctgagccagcagcctgtagactccccttcctgcctgaggctctgccatcttctcaaaggaagatgaggctcagctctcagttccagcctttcctgaccacagctgtctctgagaacatagtcagttcctttttcctttctccattctcatcccagacacacagagcccattcccatatttttgtccattaccacacccttcccaccagtccctcagagaagagaactacagatgaactgccttcattatttcttaggtgtttggtttcttgctggatgacaggccttgtaaatgtagcacttattcagactgaccacagcatgagcacaaaagggatcaccatcacaggcctaggtcagccaaagaaccattattacattctctggtggaaatatccctcctttgaacaagaaaacatctagtagagcaaaggggcagcatggggaaatttgagatggcagaaatattctgcatcatggtcatggggtggataaatgaccatgcatttgttaaaacccatggaatgatgtgtatgtgtatacatacatatgtaagtatacacgtgtgtgtgtgtatatatatgtatgtaagtatattgtgtgtgtgtgtgtgtgtatgtgcatgtgtgtatggagagagagaaaaagagagggagagagggcactttgaatcatgaggataagaagcacaactaggggattataaggagtgccatcctttcgattcctagacctgtatgtttggaatctaagagatacggcatatgaaacacattgtgggataatgcccacctcttgcagggtgccatttcctagctggtgtcaagatggactcttcaacaagccattcctgctctctattcttctgctagattatggagggcataatccagggccttctggatcaatttcctaggagtgtaggtatttccaggctctggacccaggtagtgttcatccatccctatgtcacaagtttctcgtcttgctccttcgcagattctaactatgcattcaatctggcagtcatggctcagaattcatacagatcctcacctcagctcatctgtccttccaggtaaaattggcctgttaggaagatttcctttcccctgtggcgtttcaggctatctctaagtggggacataactcccagcattcgcttcttggtggtactgacataggctattggagccgcctgaaagccaaactctgaatcttcccattgttatttatttatttatttatttatttatttatttatttattta

SEQ ID NO: 12374 - DNA, 40147 bp, Human
aaatggggaggaaagtctttgaagaggaacctctactttactttttataccgtcatggctggaaactaagtttttaagatttttctggggttcccttggccgaggtggggagtgggagggctgtccagtggtagggacttaggatttttagtttacagtagtaggggaaacactctgtaatctaatacataagtaaatgatgtattagaatatggtaaatataggcaagtagacccccactgggattagcagtggtggaaatgtgagagagggcaaacaggtgggtctagatgaggtgtgagcagactcgaggggcacaggagttagtcaagccagtatctgggggatagtgcaggaatagtgaacagctagacaaaaagtcctagggccagagaaagcaaaagcataagagatggaggccagagaggtaatctgggtggaaggctgcagcctctcaggatccctataggtgctttggcttttgttggagagacactgaacagctttgggcagtgaacgtacctgacaggtttcctgtttgtttttgagatgaagtctcgctcttgtcccccaggctggagtgcaatagcgcgatctcagctcactgcaacctctgcctcctgtgttcaagcgattctcctgcctcagcctcccaggtagctgggattataggcgcctgccaccatgcctggctaatttttgtatttttagtagagacgcagtttcagcatgttggccaggctggtcttgaactccagacctcaggtgatccgcccgccttggcctcccaaagtgctgggattacaggcgtgagccaccgcgctcggctagacctgacaggttttaaaaggattactggttgctgtgttaaaacagactgcaggatggcttaggtagccagtaggtttttttttttttttggagacgtagtcttgctctgttggcctggctggagtgcagcggtgtcatcttggctcactgcaaactccgcttcccgggttcaagtgattctcctgcctcagcctccggagtagttgggactacaggcgcccaccaccacactcggcttttttgtatttttagtagagacgggtttcaccatgttggccaggatggtctcgatctcttgacctcgtgatccacccgccttggcctcccaaagtgttgcgattacaggcgtgagccaccacgcctggacgggtagccagtagtttctagggctggagagatctaggatgagagaagtttccacattcctgttacaggctctctaaggcttcagctcctttttctaggactaagctggatctcaagtaaacactagagagggggcagctgaagctccaggagtgtgtggggctccctggggctggatggcggtggcgggcaggcgagctgggctgtgctcgggtgtgttacagtaaagacgcccagcttggcgctggcccggccttttcacggttttaggctctacagagagcggctgcagagctcacccggctggcaggagccaccgaggccggacacgtgggcgacttattgaccaagtggggaggaagcagccccgcactgctctcccgactgcggaccaccgttgggctcctgcgcatcctaagccccaccgcctcacctccagtccccacagcgttcgcgctcccagccggggtaagcggaagaaaacaaaggcccggctccatcagggcaccaatcccgctcgtcggcctctttctcggcctccaatgagcttctagggtgttatcacgccagtctccttccgcgactgattggccggggtcttcctagtgtgagcggccctggccaatcagcgcccgtcagcccaccccacgaggccgcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggtgggccgagcctccctgcttgcccggggcggggaaggagctcgctgggccggcctcagggcctgagcggccgggcccggatctggggcaaggggcgcggcgagcagggccgacgcctgggtgttcccgtccccctttcctcgagccttccccctgtagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggccaacaggacagtagcaaatgtgactcaggccgaggcttgataggtgcctgaacatcggagtctttctttcagtgtccatgtgcttcagtaaacacactagaaaataaatttctggtttttgtccccagtagactacaccctcatttggtgttatttttcacgtgctatctttaatacaggtacatccttcagtctatttgtagaacattcagttttcttcatcttttctttgccggtgctacattatttgaattattttgctacagaataacttctattatttgatatggcagatgtcactttttatatttagatatagcattcatttatttaacaaatatttgacgaccagttgtatatcagatagtgttctaggtgctggaggtacaacagtgaacaagctaggtgaagaccttgattttataaaacttactttttagtggaagagagacaatttaaaaaagcgaatgtacagtttttcacgtggagaaaagcactgcagaggaagatactagcagggcaagggatctgagtgcagtcagacctcatttgggtccagacttcattcctctatgtctctttcctttctacagaaagactgttagagaaaatggtagcattggtttcctgttgggagggaaagtgggtggtcatggtaagtgggtagagaaagacttcacagtatactgtttttgtacattttgagtttttttaaaagcgagacttgagctattctagctctgataatatggtgcagtatttgttatgttagttgtagtctttctgggcagtttttacatccccatgagccgttaaaaaaatacctgaacctttaattaggggaaataaattggaaaaatacatttcccttcacttaacattatcttagtttctctttttttttttttttttttttgagatggagtcttgctctgttacccaggctggagtgcagtggtggcgggacctcagctagatgcagcctccgcctcctgggttcaagcaattctcctgcctcagcctgctgagtagctgggattacaggcacctgccactacgcccggctgattttttggtatttttagtagagacggggtttcaccatgttggtgaggctggttttgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatcccgagtagctgggactccaggcacgtgtcaccaatgcatggctaatttttaaatttttttgtagacacaatgtctcgctgcattgcccaggctggtcttgaactcctgagctcaagcgattttcccacctcagccttcaaagtgctgggattacaggtgtgagccactgcacccaaccagtttctctctgcaaactagggaaaaaatttacgcttagcagatattgagggctgattatttctatcacagaagcatttggctatagaatttcagggtttagtaaacttgatttacactgaatttttaggtgcatatcagtaaatctacgggcatatgccgcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaaccacagttacttcatctgtaaaatagggatgtatgtatggtaacgattttttaaccacaacttcccaactctaagatggtctgaaaagaattttttgagtgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctgtgagaccttaaagggttgattgagtaaggatcacaggtgatgtccgcattgtgcttggcatggagttaagtgcttgataaatggtggttatcaatctgattatgtaaatttatgtaaattcagttctcaagtttgtggtttttttcccctcctggagaaatctattctattttaaagtgaggaaggctccgtggagggctggtagctggtagctgttcacttgtggaactttcagcctgaggctggagccccttcctgggagtctggtcttgtcgtcttcctgaccacccccacacccttcctctaaattccctccatccctgtttttctcccgcttgcgagcttttgggagtgtgctgaatctcagactgcaatagataaacccaagagggacaggcaccagtagcctgagcttgctttctcccctggctcatgggaatcaagcagtagaaatttttagtgagtgttgttttccatagtatgcttactagttgtgtcttcctgttttgttcttggtgatttgaagaaacctgtttacaaggtaagggactgaaacaaataggtgacaggaaaaagagcagcaggggtacgagctggaggagtaagtggcttggcttgctctctttcagaatggagggctgtatggaaaggaggggtagtgttcttgaagagtgttggggtttaaatctagggggaccgtgtcttggcattgattgaaactcctggcttaacatcaccccgaaactgttagttggactgaacatgacatttggcagtgcagttaaaaacacttcctgctgtagcctggtaatggtcaggctatgtgaagagctgctctggagctcagtccagagcgggtattctgtttctttcactctgaaatcctgcctctcgatattttgagaaggaaggagttggtgaattgttttaaaatcctcgatgaatgtcttcatttattcatgacaccacttctgaatatatttatgtgccagacgctgaagtttactaatattatggtgcccagtaaatacttgtttttactaatattttttatggcaataaaatgactttttcaggattatgtgatttaaaagattgacccttttggcaaaatacgtattcatgataggaaatatatacaacatagttcacttaaacctcccaccagagcccagggttcactgttaccattctgaagtgactggaatttcctagaagtggatatgccatatttttttaaccactcctattggatatttgttttttatttttttgagatggggtcccactctgcagtgtacaatatcatagttcactgtaacgtgtatctcctgggctcaagcgatcctcccacctcagcctcctgagtagctagtcttcagtagctagactataggtgggcgccaccacagctggctttttaaaaaattttttatgaacacgaggtctcactatgttgcccaggctgccctcaaattcctgggctcaagtgattctcccaccttggccttccgaagtgcagggattataggcgtgcgccactgcacccggccctgttggataaatgattccagtctctcccaaaaagaactgttgtaagactgtggggtgaggggagggaagggacaaataggaacccgccgtattttccactccctgtgggcctaaaactgctctaaaaaatagtccatgaaaaaatacatagtacaaacagcaactctttctgatatgcttgcatttaaaatcaggctttttctcccttttggaaaaacacagtccttgtttgctttagggaagagtaaaggtcagtgcgctgcattgcattaatttcgaagggaaagatgagaagacatcttgaaaggaatggctggctttctagagaatagtagaggcttaataggtgtcatagaaaaaccagggttggacagtggtagtaaaacggcaaaacagattttattcagaaaaactactgcagtaagaggagagagacctcggtacagaactgctccactgcgaatacaaagaaaagtaggaattgatggcgggggagccggatgtcagtggatggaaaattattacgaggaaacacaggggtgtgcattcttgctgaaggcaggccagagttatcagacatcacctgagggatggagggggatgtggaacctaatcggctgtctagggtgatcagatactgaagttgggggattctggtcaaatcaatttagcaggattcttggtaaaactgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttctcttagcggccagtgggttctggtgagaagggcaacagcgggaggaggcgccggtgcggagcgggaggccgggggcggggctgcggggctgcggggcgggcccgttgtgggtcggcccagcgcgtattcgagtagagggcgagcccgtcccgcctctcgtcgggcgcttcccagatctgcttgagtctatggaggaaaaactccgcggggtccgcgattcccatggccgcagccgcctgcggcaccaaggccatggccctcttcaagcgcaccttggtgctgagtcccgccgcggcgcccaggggcccgggcgcaggcaccgccccgcggggctgctgcttgcctcctgccgcctggccctgcaaggactggcctcggggagagggcggcaggctgtggagccgcctgccccagtcccactcccactcccactcccactcccactcctgctcctcgacgtctcccaccgccgtgtgtgttgtctgcccgcaggactcgctcagcagcagcctgaaaacttgctacaagtatctcaatcagaccagtcgcagtttcgcagctgttatccaggcgctggatggggaaatgcggtgagtgatggaggcagcgcctctggcttggaggaaagcttgtccgggacttttgagtgtgttggaagctaccttttgatatagcgctcagcgttgcagcctcgttgctgtggcttatccagaacatagcccggccctacgtgtttactttagaaagcccttccaggctctttgccatctagtagagtccctgcgggcccagcctttcagagaagaggggggagggggtgatgtttattaactttttttagtcttggcagctgaacctgcctgtgagcaggtcgtgtatttctcggcttcccttatccaactttgcatttctatttctagcatattgggttgattcttttgaagctgcctctgtgcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttagagttaagggtgagatgggtttagaaagtggccaggcacaagttattttaaaataaaaaatctttggctgtttgttccaatatattaatagttttcccttttttacagcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacggtgagtggggttacgcatcttgtctacggactgttgtgttcataattgctaacgtggttgtccggtagcctccatacatgtggagaaaggttaaataagcattctgagggcagcataatgtgagggttaaaaactccggtagccaagactctgaagccaggctgcctgggttggaatctcaaatctcccacttactaaactgttggttacttacaaagactctctgtgcctcagtttcttcatctgtaaaataggggtaataataacacctacctcatggtattctgaggattcaaagaattaacgtaggtaatgctcttagaatgttagctactgctgttattatcagtattggaagtccagtgtttcttcctgtgggaagacgcagtcaaattttagtgttgtgaaagattctcaggctagctcacaaaagcctgccgactgtatgatgcagcctacctgtaacactgctggcctcttgactacccggagcctggtagcatgggactgctgctcacgatgggcagcagcctggcatgggggcggtgtctgttggcagctagggcgagcctctgccacttcacctgtgatcctgggcaagttccttatctgctttgtgtctccgtctcctcgtttgtaaagttagagctgagaggattaatttcgcacatataaagtacttagtgcctggtacagggtaagtattctgtaagtattagctatttggtctattttgttggagtaaagtgggttatagttaaaatcctaagatttttaaagtccctcaagttcatgtggacatctgcctaggtcctactatcctagaattcgcatgtcttatcacacaaataactgattcttccatatcttataaataaaggtttgatttagcaaagtcacatgttgtgtaatagctcgaagaagccctttttgtccacagttgccagagcttttggagaacagtccttatgttattgaaacaaacctaatctgtagctgagttgggagggagctaagtggacagagagtcctccacccaaacaaaagaatctttgattcttgggcataatgggagcaatatttaaaaaaaaaaaaaaaaaaaaaaaaaggaatgtttggggaagactcttgcggtgcaaaggctgtttcagattgctgagatcagaccttaagtaccaaagcccaaatatagtacaacataatacaaatgagaagaaaatagctgaagaataattcgagtttatacagtacaattcaagagaagaaagaaaatttatgacgactagctgggtgagaattagaactgtaaccctgggaaggtcctggtgatttgactctcacaggacacctgatgaccagaggatgggtttcctttgatgggaaatctgtggcgattcattgatgggcctctgaattctgctgaagcagaggaagtagtaataccccatttataatggaagtgcattctcacttaaaaacaactaatattattctagctggacctagcctctagaaacagccaaattacatttgacttgagtggattcataataattaaaaaatttctggggcatgggataaatgtgttaggtattgctaagtcaaggcagccctatcccctcagcagaagtgagggaatatgaaagtgtgtgaatgctaacataattttggggaatatcgccgtcagatttccagatgatattccaacatgtttgtgaaacttcagtgtcttcctgtgttcatacagtgttccagtggaaaaataatgcttagttctggaaggtttcagatgtgaacactgaactcatcgttttcttttttgggtagtagagttagagattccatcctcttgaaagcacagttgccccgggaagagtaaaagggagcagaaggcgtaagccaggcacggctgttttcactgttgttcaccttttgtatccttacgaatatgaagatgtactaagttgtgtgttttgcgtgcatatataattttaagctacttgagttgtaggtccctccagtctgtgattcagtttgagatgggactgtatgggaattaacagtgccttgtcttcttaagcagtgatttgtgtatgtgctgatatagctcagtatgtctttgaaaccagttgtctggggctaggcctgcaatcagcttttggctaagaggtcccaggatggaacaagtagtgtgaaagaggactgataccttggcctcacacacagtactgctcttagactggggcaagtgaaactcctcacttcagagtgccccattctaggccccctcactcccaaaggggtgagggatcactggggccatgggaatgtgcttgttcagctctcgtgggctctccttctgtaccacgttctggacatctggagttccttgccccaaatccctgagcccacgtctgcgtccgcacagtctatttcctaaggtcagtccatctcctccaggtgggaacgtgccaccattgactgtgcccttgggcctgagtgatggccaagggctgtgttggggagtgttgtggatggatcctggcaccgagggctgggatatcctctcaaatgaatgtgaggtgcctcccagtgctggagagagcgggattcaggaagcagtggaagggaagagcctgggatatggggatcagctgtctgtgccctgctgcattctggaataaaactctgagggactaagaattctaaattcaaacctgaatcaaccaggttgttacaaagataagtttgtcagtgcaggaggatacaatatattttacttaagttactagctcgattgatcatttttaaatttttagctacatatagtatgtgggcctccatttgtcctcttatcccaggccttgcagaatttaggaataagcctcaatacagtgttctaacccagtgacttccgcctcgatgtacagtagattgaacctgatcctttatactttagtgatcattagttgataccagttcaagtcaggctttctagaaatctcattgtatgttaggggttcgattagagtacagtcatgcatcacttaatgaatggccacaggatacattctgagaaacgcattgatagatgatttcatcattctgtgaacatcatagagtgtacttacacataccaagatggcatagctactacagacgtaggctctgtggtacaggccattgctccaaggctgcacatctctacaggatggtactgtactgaatactgtaggcaattggagcacagtggtaagtatttgtgtatttaaacatagaaaaggtatagtaaaaacagggtgttacagtcttaagggcccaccattgtatttccagtctccgttgactgaaacatcattatacagtacatgagcacgtatctttctcacctggtactagtggaaagctagaaggcttagaagtctacctgtaaacatagcttaagtaataatacagccttatttttaaatgataatagcaataatagtgttcacttattgagcattttactatgagttacttactaaatatatttcatcgttaatttactctttgtgttatttgatctataacatcgtttaacagggaaattacctagtacataatgtactgttatctacattttatctagatgaggaaactgaggcacagagaaattaagtactttgcctaggattacccgtgaagttaagtgacagaatcaatgaatctggaaggtctggcttcagatctcttgtgctgagtcactcgcatactttactacctctaaggtttctaatcagaggaatttgtatctgtattccctgctactcttaccctctatgtgggatttggcctttctccattatccctgtgaactcgctctgggaccttccttcttgtacttggaaccatcagaaagtgatctgagaacatagaaatctactgtgttgtgaaacagaattacctggaagcggaaaaagccctcctggctcaattcacatgtcacggcttatggtcgtatccggggaacatatgaaactgggcactgagtgcggagtcaggaaagccctgtccatcctctgggtttctggggaaaacgtggaccccttcattgtcactttctcctgtatatttttgtttttacttttagaactgtacaattacgtaataaataataaaaagtcgttggaaggataggtgaagttcagaagtgaaagtgttttggaggagtctaagctccttcccaccctcattgacctttcctctctaataaatagaactggtctaaccaaggatctgtggaatgagcagagtccaacggagattcagggattctaataacctcttgtagaatcactggtttgtttcagccacaagaaggaattaccttttgacattggcttgaacagctgttgtgcaaagaaaaactttttggaaagttctggaagtaccagattgattttataggtttttttttttttttttggagggacatgggggtattgacagttgatgttaatcagaaatcctaaattatgtgtattcctggtatgttgcaatcagccggccacctggttttcctctgggctcttaattttaggtgtattccgaggaagtttttctaacttttctgtaaacacagaccaggtatattgcatactttcaatgtttaaccaaatctcttcactgtttgcagtattatctgtaggctctcatgttttaagacttcccatggtgtttttgtattgtattttgctaacctataaacaattctttgaacttaaaacaagatatttgggcagtaacaataaattttaaaaacatcaattcaacttttttacattagggcttggactatggaaaaagtattgggcagcatgcctcatactgagttgtttaatgaatttaaaagtatagccttaatagtgagagaaactctatagcttcataatataaattgggtaactaatgagataaaatggttggcagatctgctcactagaatctaagctcttcaagggtctgagtttttttttttctttttcttttattatactttaagttctagggtacatgtgcacaacgtgcaggtttgttacataggtatacatgtgccatgttggtttgctacacccatcaactcgtcatttacattaggtatttctcgtaatgctatccctcccttggccccccaccccacaacaggccccggtatgtgatgttcccctccttgtgtccatgtgttctcattgttcaactcccacttaggagtgagaacatgtagtgtttggttttctgtcgttgtgatactttgctcagaatgatgatttccagcttcatccatgtccctgcaaaggacatgaactcatcctttttttatggctgtgtagtattccatggtgtatatgtgccacattttctttattcagtctattattgatggacatttgggttggttccaggtctttgctattgtgaatagtgccacagtaaacatacatgtgcttgtgtcttcatagttggacgagttataatcctttgggtatatgcccagtaatgggattgctgggtcaaatggtatttctagttctagatccttggggaatcaccatactgtcttccacaatggttgaactaatttacactcccaccaacagtgtaaatttagtcctgtttctccacatcctctccagcatctgttgtttcctgactttttaaatgatcgccattgtaactggcttgagatggtatctcattgtggttttgatttgcatttctctgatgaccagtggtgatgagcatttcttcatatgtctgttggctgcataaatgtcttcctttgagaagtgtctgttcatatcctttgcccacttattgatggggttgttgattttcttgtaaattttttttaagttctttgtagattctggatactaccctttgttggatggataaattacaaaaattttctcctattctgtaggttgccttttactctgatgatagtttcttttgctgtgcagaagctctttagttgaattagatcccatttgtctagtttggcttttgttgccattgcttttggtgttttagtcatgaagtctttgcccatgcctatgtcctgaatggtattgactgcattttcttctagggtttttacggttttaggccttatatttaagccttcagtccatcttgagttaatttttgtataagatgtaaggaagggatccagtttcagctttctacatatggcaagccaggtttcccagcagcatttattaaatagggaatcctttctccattgcttgtttttgtcaggtttgtcaaagatcagatggctgtagatgtgtagtgttatttctgaggcctctgttccgttccattggtgtacatatctgttttggtaccagtaccatgctgttttggttactgtagccttgtagtatagtttgaagtcaggtagcgtgatgcctccagctttgttcttttggcttaggattgtcttggctatgcaggctcttttttgcttccatgtgaaatttaaagtagttttttccaattctgtgaagaaagtcattggtagcttgatggggatagcattgaatctgtaaattaccttgggcagtatagccattttcaccatactgattcttcctatccatgagcatggaatgttcttccatttgtttatggcctcttttatttcattgagcagtggtttgtagttctctttgaagaggtccttcatatcccttgtaagttggattcctaggtgttgtattctctttgtagctattgtgaatgggagttcactcatgatttggctccttgtttgtctgttattggtgtataggaatgcttgagattttttgcacattgattttgtatcctgagactttgctgaagttgcttatcagcttaaggagatttagggctgagacgatggggttttctaaatatacaatcatgtcatttgcaaacaggcaattttacttcctcttttcctaattgaataccctttatttctttctcttgcctgattatcctggccagaactaccaatactgtgttgaataggagtggtgagaggacggcatccttgtcttgtgcaggttttcaaagggaatgcttccagtttttgcccattcagtatgatattggctttgggtttgtcataaatagctccttattattttgagatgcgttccatcaatatctagtttactgagagtttttagcatgaaagactgttgaattttgtcaaaggcctttcgtgcatctattgagataatcatgtggtttttgtcataggttctgtttatgtgatggatgatgtttattgatttgtgtatgttgaacagccttgcatcccagggatgaagccgacttgatcgtggtggataagctttttgatgtgctgctggattcaatttgccattattttatagaggattttcgcatcaacgttcatcagggatattggcctaaaattctctttttttattgtttgtctgccaggctttggtatcaggatgatgctggcctcataaaatgagttagggaggattccctctttttctattggaatagtttcagaaggaatggtaccagctcctctttgtacctctggtagaattcggctgtgaatctgtctgttcctggactttctttggttggtaggctattaattattgcctcaatttcagagcctgctattggtcatttcagaggttcaacttcttcctggtttagtcttgggagagtgtatgtgtcgaggaatgtatccatttcttctggattttctagcttatttgcatagaggtgttgatagtattctccagtggtagtttgtatttctgtgggattggtggtgatatcccctttatcattttttattacgtctttttgattcttctgtcttttcttcttgctagcggtctatcaattttgttgatcttttcaaaaaaccagctcctggattcattaattttttttttttgaagggttttttgtgtgtctgtctctttcagttctgctctgatcttagttatttcttgccttttactagcttttcaatttgtttgctcttgcttttctagttcttttaattgtgatgttaaggtgttgtttttagatctttcctgctttctcttgtgagcatttagtgctataaatttccctctacactctgctttaaatgtgtcccagagattctggtatgttgtgtctttgttctcattggtttcaaagaacatctttatttctgctttcatttcgttatgtacccagtagtcattcaggagcaggttgttcagtttccatgtagatgtgtggttttgagtgagtttattaatcctgagttctaatttgatttcactgtggtctgagagaaagtttgttgtaatttctgttcttttacatttgctgagcagtgtttttcttccaattctgtggtcaattttagaataagtgcgatgtggtgctgagaagaatgtatattctgttgatttggggtggagagttctgtagatgtctgttaggtctgcttggtccagagctgagttcaagtcctggatatccttgttaaccttttgtcttgttgatctatctaatattgacagtgggatgttagactcgcacacaataataatgagagactttaagtctttttctaggtctctaaggacttgctttatgaatctgggtgctcctgtattgggtacatatatgtttaagatagttagctcttcttgttgaattgatccctttaccattatgtagtggccttctttgtctcttttgatcttagttggtttaaagtctgttttattagagactaggattgcattccctgcttttttttttcgcttggtagatcttcctccagctgtttattttgagcctatgtgcatctctgcacgtgagacgggtctcctgaatacagcacagtgacgggccttgactgtttatccaatttgccagtctgcgtcttttaactggggcatttagcccacttatatttaaggttaatattgttatgtttgaatttgatctgtcattatgatgtttgctggttattttgcccattaattgatgcagtttcttcctagcctcgatggtctttacaatttggcatgtttttgcagtggctggtaccagttgttcctttccatttttactgcttccttcaggagctcttttagggcaggcctggtggtgacaaaatctctgagcatttgcttgtctgtaaaggattttatttctccttcacttgtgaaacttagtttggctggttatgagattctgggttgaaaattctttaagaatgctgaatattggcccccactctcttctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttgaatgttgacctgccttgctaggttggggaagttctcctggataatatactgaagagtgttttgtaacttggttccattctgtctatcactttcaggtacaacaatcatagcattggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagcttgtttatgctttgtgaaattcttgtactttggttttcagctccatcaggtcatttaagctcttctctacactggttattctagttagccatttgtccaaccttttctcaaggttttaagtttccttgcgatgggtcagaacgtgctgctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcctttctgctgtggtttctccccatctttgtggttttatctacctttggtctttgattttggtgacgtacagatgggttttggtgtgggtgtcctttttgttgatattgatcctattcctttgtttgttagttttccttctaacagaggcccgtcagctgcaggtctgttggagttgctggaggtccactctagaccctgtttacctgggtatcaccagtggaggctgcagaacagcaaatatcgcggcctgatccttcctctggaagcttcgtccaagaaggacacccacctatatgaggtgtctgtcggcccctactgggaggtgtctcctcccagtcaggctacatggggctcagggacccacttgaggaggcagtctgtccgttactggagttcaaatgccgagctgggagaaccactgctctcttcagagctgtcaggcagggatgtttaaatctgcagaagccgtctgctgccttttgtttagatatgccctgcccccagagatgcaatctagagaggcagtaggccttgctgagctgcggtgggctccacccagttcaagcttccttgctgctttgtttacactgtgagcatagaagtgcgtactgaagcctcagcaatggcggggaggcgcttcccctcaccaagctccagcatcccagcttgatctcagactgcttggctagcagcaagcaaggttccatgggcatgggaccccccgagccaggcactggaggcaatcacctgctctgccagttgcgaagactgggaaaagcacagtatttgggcagagtatactgttcctccaggtacagtcactcacgcctttccttggctaggaaagggaaatcccctgaccccttgcacttcctggatgaggtgacgtcctgccctgctttggctcaccctccatgggctgcacccactgtccaaccagtgccagtgagatgaaccaggtacctcagttggaaatgcagaaatcacccatcttctgcatcgatcttgctgggagctgtagaccagagctgttcctactgggacatcttggaagcaactctgggtctgagtttctgtttgttgccctgatgtatatccccagtgcctagaatgatacttgttacataggaagtgcttgatccatgtttgcacaaatgaatctttctcataatgaggtttctctaaacaagctgttctcccaaaaacttaaacccagctttatgttgaagcatctcattatacattggaaagatgaaatgtgtagtgagactttgaatcttcttttgaatctagaaacattagcatttttagaccattctattttaatatttatgaaatttatgaaataataagaaacatgaggccgggctcagtggcttatgcctgtaatcccagcagtttgggaggccagggctagtggatcatgaggtcaggaatttgagaccagcttggccaacatggtgaaaccccacttctactaaaaatataaaaattagctgggcgtggtggtgcatgcctgtaatgccagctcctggagaggctgaggcaggagaatcatttgaacctgggaggcggagtttgcagtgagctgagatcgtgccattgcactccagcctgggcaacattgcgagactccatctcaaaaacaaaaacaaaaacaaaaaaaatgtgtgacctaaattaggcttatagatgaaccattgcagtcatgattaattccgccattgtttgccttgtgatctttggtgccatgtctgtacatatttcatgatttctgtgtttttacggtttccatttcagatctcccttgagtttagaaatctggctgagaaataccaaacagtgattgccgacatttgccggagaatgggcattgggatggcagagtttttggataagcatgtgacctctgaacaggagtgggacaaggttagtctcataaaacagtgtctgtgtgtgatgtattagacagagctggcagtcctcatagtgaagctcagaacaagaaaagttgtccagtattttcagcccctctggttttacaattcatctgtttaggttgaatgtctcatcataaacagtttattccagagttaattccaaaccagcagctatgtaggatatcagccaggctaggagtagggtactggagagaagtgcttatctagacaaagggatgtaattgaccatgaagattaaaactacacatcaaaacataaggtagggttaggagtcttgcctatttttcataggaatggtgtttgtgagacttactcatcacttctgtggaagtaaagacattttatttatttattttaaagccagtcagatttagcaggcagagacatttcagacatctaaagtgttgatgtatttcatacctttaactgtgcttaaattaggatctccgaaaagatgctgctacatggtcactacgttagtgtaggtccaaggtcttgggcctcttaatttttcaaacctcaaaacttgacagcagttatctttggaactgctgatttgtgcttcctaagttaacagcatacaatgactgctagaaatcaatttctgcatttaaggtgaagttagccgggtactatggtttacctgtaatctcagcactttgggaggctgaggtgggaggatcatttgagcccaggagttagacacaagcctaagcaacatagcgagaccccgtctttcaaaaaattaaaaaatgagcagggaattggtggcatgtgcctgtggtcccagctactctggaggctgaggtgtgggaggattgcttgagcccaagagttgaaggttgcagtgagccatgattgtgccactgcactccaacgtgggtgacagagcaagacaccatctgaaagaaaataaagttgaagttaaaacttctggccaagaaccagcactggttatgatagtaactcattttctgttgtgcagatttattcaggaaacttaattttaggttgttgaatagaagttttgatcagataaaattgaattaaaaaaaattttttttgagacagggtcttgctgttatccaggctggtgtgtagtggtgtgatcacggctccccgcagcctcaacctcctgggctcaggtgatcctcccacctcagcctaccgagtagctgtaactacagtgcatgacaccataccaggctcatttttgtacattttttgtagagagagggttttgccatgttgcccaggctagtctcaaactcctggcatcaaacagtcctcccactctggcctctcaaatgttgggattacaggcatgaccagccaattatttcaaggagttattttttttcttctactttgggggaagatgaattatataagtctccattttaggagtatttctaccaaaagaactattatcttcaaatatatttttggatagtactatagatatactaatttttttttaaatttctagtaattcttttgaagattttgtatagctgtccaaagccaatttctgtctacctaatttcagcaagatttcactcttttcatgttacttttgtcccagaacaaatttcaagtgctttctcttcacctgtgcattcttccccctgattagtctctggctttgtattactttcagtcagagacgactttttttttttgagacagggtctcactctgtcacccagactggaatgcagtggcacagacaaggcagccttgaccttctgggctcaagcaatcttccttgccctcagcctcctgagtaactgggaccacaggcacgttgccaccatgcctggctaatttattttaatttttattatttttgagacagggtattgctctgtcacccaggctggagtgtagtggcatgatcaaggctcactgcagccttcacctcctgtgctcaagcagtcctctcacctcagcctccccattagctgggactataggtccacaccactacaccaggctaatttttgtaattttttggtagagacagggtttcatcgtgttgcctaggctggtcttgagctcctgggctcaagcgattcacctgccttagcctcccaggtgtgagccactacactcagccttttaaaattttttacagagatgaggtcttgctttgttggccaggctggtctaaaactcttgggctcaagcagtcccctctccacagcctcccaaaattccgggattacaggcgtgaacttcggtcatttcctaacttttacccttcctaatgacactccagagcttaccttctttacttttgcttcttaagttaactaatagacaattattgtatgtggatattgcattaagttgtcttaggatacccttttcagaggaggacagcttttgacaaattgctgtcgcggaaaaaaaaagtatttggcaattaagagttgcatttactgaaatctctgttgagagaggggaagttacgttgtctctaaaagaaaaactaaaaagaaaaggggaagttttagcaaagttgttaaagcctgacacttaagtcatactacctagttttgaactcttagcccctgccacagacacggcagccccttgaaccttcctgggttcaagcgagcctcctacttcagccccctgagtaactgggaccactggcctgtgtcactgtgcctggctaattttttttttttcctcacatgggcaatgttgggcaagttaaatcgacttctttgtgcctcagtttcctcatctgaaatggagatcatactgctatgtacctgatacaatgtttgtgaggattgaatgtgcagagttctttttttctgttgttgttgttttgagacggagtctcactctgtcgcccaggctggagtgcagtggcgcgatctcggctccctgcaagctccacctcctgggttcacgccattctcctgccttagccttctgagtagctgggactacaggcacccgccaccaggccagctaatttttttgtatttttagtagagacggggtttcaccgtgttagccaggatggtcttgatctcctgacctcgtgatccgcccgtctcagcttcccaaagtgctgggattacaggcatgagccatcgtgcccggctgaatgtgcagagttcttaaaacagtgtcaagaacataaaatagttatttgttctttcatataatgatgattttgagggcctgcggatcttgacatgttatcagattggtcaaaaaaagattaaaccatagttggtattgtcctagttcctgttaccagaatattccatctttcatcgttgccttctctcatagttttatgtatcaaaaagtttattgtaaagctaggccgggcacggtgtcttgggctggtaatcccagcactttgggaggccaaggctggcagatcagttgaggtcaggagttcgagaccagcgtggccaacatggtgaaaccccgtctctactaaaaataaaaaattagctggatgtggtggtgggtgctttaattccagctactcaggaagctgaggcaggagaatcacttgaacccaagaggcagaggttgcagtgagttgagattgtgccactgcactccagcccaggggacaaagtgagacttgatctcaaaaaaaaaaaaaaaaaaaagttattgtaaagctagacacggtggtatttgcctacaatcccagctgttcgggaagctgaggcagaaagattgcttgggtccagtagtttgagtctaacgtgggcaaatatatgagactccatctcaaaaaaaaaaataaaaaataaaaataaaaaaatgtttactagtttttttcagtagccttttattatagtagcagtacatgtgtattgtagaaatttggaaaatacaagtgaaaaataaaaacatcaaattcccgtcagccagagactgctgtgaaatgttttgagcacatccttcttgaatgttttttaaatcctggtatgtatatttgtattttaaaatcaaaatgcattcttacccattctcttttgaacctgcttttttgtagctaatgatctctagtgtgtccatttcagtaaaaattccattattaaagtgctttaaaaatcgtctcttacagtactgccactatgttgctgggctggtcggaattggcctttcccgtcttttctcagcctcagagtttgaagaccccttagttggtgaagatacagaacgtgccaactctatgggcctgtttctgcagaaaacaaacatcatccgtgactatctggaagaccagcaaggaggaagagagttctggcctcaagaggtaacagattcagggtattttgggggaaaataactttagacattctctgaaaaatcctttaactcttgtggttgcgggtgacagaaaaacaagtcaggcctcccccaggcagcataaggggatgtggaaaataggatagattgacatgagtttgcttcaggtagactggctgactcccaggattcacaccacgtaatcagtatattcaagccttgctgtccttgatttctttcagacggtctttctccaagtggtggatatggtaacaacccatgtgcactagcttaacaaaaagttcttaggaatggctttgttcggcctggcgcagtggctcatgcctgtaatcccaacagtttgagaggccaaggtgggcggatcacctgaggccaggagttcgagaccagcctggccaacatagtgaaaccccgtgtttactaaaaaatacaaaaattagccgggcgtggtggcaagggcttgtaatcccagctacctgggaggctgaggcaggagaatcgcttgaacccaggaagcagagattgcggtgagctcagattgtgccactgcactccagcctgggcgacagagtgagactccctctcaaaagaagaggaagggcttggttcttctgctcagccctgaatcagttactgttgctacacagctgagttctctggcctcacctggattacgtctacacagtacacacagaatggatttcccccaaagaaagaattctgcggcaggaaggggaaagggatggcaggtagacaaaaactccaggtgtctgtaataagggacagggtcgatctttaattaaaacatggacagggaacagaaagcttttgatactgattttgttcagaaggaaagtagaaaattttatgactgttccctgaatttattccagcatttaccttttgctttccataaaagtgtttcctgcagccaagtactttaaagttttaaaaagacgggtgaggctaagtgtggtgtctcatacttataatcccagtgctgaggccaggagttcaagaccagcctgagcaacacagcaagataccatctctataaaaaattgttagaaaatgattctgctgaaagagcaaaaataaaaattaaagaaagtagaaaaaataaaactaaatttaaaagattaactgggcatgttggcatgcacctgtattcctaggtattcgggaggctaaggcacaaggatcccttgagcgcaggagctcaaggttggattgagttgtaatcacaccactgcactccagcctcggtggcagaatgaaactgtctcaagaaaaaaaaaaagtgacagagggaaacaatatttgcaattcatagagcagatacagggttcatattcctaatattaaaaaaaacttctaaaagttaagaaaaaggccaactgccccacagaaaaatgggcaaggagataagaacaagattgttcacaggaagagacacacagatgattattaaaaatctgaaaagatgctgagtcttactcctaagaaaaattcacatttaaactactctgggggctgggcaaggtggctcacgcctgtaatctcaacactgggagaccaaggcaggaagatcactgaagccagggtatcgagaccagcctggacaacgtagtgagaccttatctcttaaaacaaaacaaaacaaaacaaaacaaaaaaaacagtaaaaattggccgggcacagtgactcctgcctataatcccagcactttgggaagcccaggtgagtggatcacttgaggtcaggtgtttgagaacagcctggccaacatggcaaaactccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggcagtggctgccttggaagtggagtctcagtctcccggctcctaggccagcccctgaccactgttccattgtctcccagacagaacatcagccacgggcatgtgatgcatgagcgtgagccacaccatcttgcacacacaggagcagagccctgctcttctcattcacttactttatctgtaaaatagcatcatttctaccacacggtggtggtgtgaataaaatgagatgaacttctagcatagagtgcttagtaaaggttctggacatttcgtagtagttgaatcatgccaaatgtggtcctaggtgattggcttcttttgctagcatgttttcagggctcctccatgctggggcattgcatcactgctttattcctttttatcgcctagtattattccactgtgtggatagaccacatttatccattcatcagttggaggatatttgggttcttcccattttttttggctatggtgaatagtactgtgtacatttgcatataaggttttgtgtagatgtgtgttttcctttttcttgggtctatgctgagaagtggaattgctggttcatacagcagctcgaaccttgtgaggagctgccagacgcttttccaaggtcgctccaccattttacattcccgtcagcagtgtgagagtcccagtttcaccagcacttgttgttatctctttttaactgtatgtatatatacttaacattttatttataataaatgtacataatagagaatttgccattttaactatttttaagtctattattcagtggcattaagtacattaatgatgttatataaccatcaacactatgtttccagaactttcgctagcttcagagaatcctctaaataatatcattaaaaatcatcaagccgaatcccactgttagaattaaaggttttatttcactttcaagttatcaggatccagggaggtgtaatacacttagaggatagactcagctcatttcccagctatgcctttcagcagcattcttaccagagtaggaatataatgttagtcattatttagaggcctggccatcttgagaaggtttactgtttagtctgcagtacaattataactgtttttgtatattgggttatttttttcagaagtaggccagtagctctaacaggagcctctttagcctgaattcgtccaagtagtgcagtgttgcactagttgtccctcgggacatgctccccaatacgtaactcacttccaggttgcaactggacacttactggtagtcagaaatagctattgcatggagcttaaaatgaacttgatcttcgtgaaagatgagtctgcagctaagagactttactgtatatcatagtgtttttttttgttttgttttgtttttgtttttgtgacggagtctcactctttcacccaggctggagtgcaatggcgagatcttgactcactgcaacctccgccccctaggttcaagcaattcttctgtctcaccctcctgagtagctgggattacaggcgcctgccaccgtacccggctagtttttgtatttttagtagacacagggtttcaccaccttggccaggctggtcttgaactcctgacctcgtgatccaccctcctcggcctcccaaagtgctgggattacaggcgtgagccacggcgcccagcctgtatcatagttcttatgcacaaagaccctttaatattgtttgtaaattctcccctatgcacacgctgacctgttccttaatcttcttatctgtctaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtagggaacggggctcctctgggtggatacggggctaaagggagtggggtaggagtaagggtggattttgctgtgctatattcaaggatatgattccttaaaaagacgatgactccagtttattacgctgggagtttcatagcacccgcctttgcttccagccaccaaactcagctcagccttgaggttaagcctgctccttttcagaaccttctttctggatttactattttctacagctatcctaaactagttaggttcttttcctcacagttaagtcaaggtctttggcttagatttatggggagtgctgggtaaaacctgggtgaagctgttatcattaaaaagtcttcattaagcacctaattactgctgtccttttcctagacccggcataaaaagaacctggtccggtagacctagcctctcagtatgctaggaacttacactttttagttgcctttaccaagtattgcagatactactgcaaataagtgaagaaagtaacagcatttaactgatttgggaacttggtttgatcttgttctaatgacccacttcgaatggtggttgaaagtaaaatctgtatcgccgtcttatgtttccatttacctagaaatactttacctttgagcacaggaaattaatccccttctggttgttctccccctggcattggttttaaatatataatgattatgtttgttgtaggaaaaatagaaaaacaactacaatagaaaattcttcccatatattattttgaaatacatatttccgatccgataatccattgctctagcatggaaaatgttggatttacttgtgtttgctttttccaaataaaatggaacttttgtggctacattatagaattgttttagactgcttaattctgtgtgttgttgagaaagggaggagtggggaaggtaaaaatcttgacatactttcttcgtgggtattttttcttgagcgattccatcttagttgattagcagttagcaattgcccattcaacagaaggttttcttacctttttgtgataatgatagctaacgacatcatttcttcttttttccctctcttcttgttgtctctaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagaggtgggtttttatttaactacttggataatttgtagctacttttatgatttagtaatgtcactgtttaaccaggtttggatattagatgatcctaacaattcactatcctgtggcctaaagagacaggaattgatatcctttataaggaaaaaagtctattcacaggagccgagcagattgctcactgctgtgtagtaccctggtgagaggagataaatggagcaaggctgtaggttggagcccctcagtagaatcatagattttgagctgcaagatgatgcaggaggccaaccaagcttcttgttgctggtgaggaatgtgaggttgaagcttgtctgtgctgatgcagtgcgtgattgagtggatctctggctcccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactaggttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctagcctgggtgatagagtgagactttgtctcaaaaaaaaaaaaaaaaaaaaaaaaagtcttagagaccagaagtctctgtaatctctaataatctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctattacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattaagcactatttattcattttatataaactagaaacattttatgtagtaagtagttgagagtgttttggttttgcagtttgatcactagttttagaaaccagtttttaaacactttgtggccaattccattactatattaaaattcagatttatttggtttttccttaactattgggattaaatcctggttgtaattcatagtttgagggcgagggtgggcagtctacagttggctgagccctgtttttgtgaataaatgttatcagaacacagccacacccatttgcttctatgtcttctgtggctgcttttgcaatgtgacggccgagttgaggagctgcaacaggcgatgacttgtaaagctgaaaatattttttggcccttgaataagaggttggctgacttctgacttagggcatcagttgttctgttatcccagtaaaactcaaggcattaggggagaaatgttaatattaatacttaagttgatttgatttagggaaatctttgaagatttctaagtcttaagcagtagaacctgttaatggttttagtttcagcagtaaggacattttacaagtaaagttttaaatgaaaacattttgtatgaagccacaagtcgtctggcctcttgctggtgtccagatattaacactgatcctatttctccttgctgaccaagtctgtcctttgtagtaagaaaggaagaaacgttgactctgtccgatctctggacttagtgttgtagcgagcatgcacctggaagggacttgccagaggacctcctcatgcttctccagtgcttagtgggggcttggagtgcagccccaggtcttcacgagcagttggccacactgcagggccctcaccccactctggagcagcctctgcttcaaaccagcctggatgcttgtcagctggggagaagatcaacctgctattttgggatagaaataaatgctcagccaaacggccagaaacccccattcccctctctgccaaagtgaattccttggcagggagaagcttgttcgtgtctctgcacacttcctgtgccctcctgtggttaagtcagagaatcatccggctctttgagccccaggtgcctagctgctcaaggatggtccccagccagcagctgccaggaatcacctgggagcccattaagacatccagcccccacccaaacctatcgaatcagaatctgcctttttttcccaaatgatgtttttgctttaatggaagtttagatgttcatagacaagagttttaaatgatgatcaagctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatgagcatcgcttgaactcgggaggtggaggttgtagtgagctgagatggcaccactgcactccagcctgggcaacagggtgaaggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgcttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagttcgaaaccagcctgacttatgtgatgaaaccctgtctctactaaaaaaaaaaaaaaaaaaaaaaaaaaaaaatcaaaagttagttgggcatggtggcaggtgcctgtaatcccagctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtgagggccacctctctgctcctcagggccacctttcataaggctccttgaaggtccctcaagatcaagccaactcaacacatccttgataggccttcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatattttactttatggatgcttgtattgaaaagtcttggctgggtggagtggctcacgcctgtaatcccagccctttgggaggccgaggtgggtggatcacttgaggtctggagtttgagaccagcctgaccaacactggtaaaaccttgtctctattaaaaatgcaaaaattagccagggatgcacgcttgctgtgtgccagcacagggctaggctggagataaaaaggtgagtaagtaggtgcggtgtagtcagggtgaaaactacagatggtccatttccacgtaagtggaaaggtaaaggtatgtacaatagggtggctcctggctgaacctggagctgcagacaggttttctagaaggcataatcctgaagttgagacttgggggcctaggtaggagccagttgaagggacgtgggaggcgcattccagagagaaggagtggtatgagactggaacagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacgtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagatagctcatctgagaggcactcagggcctaatctcaggcagtaattttagggatgtaggggaagagatggattctgcacatacttgggaggcttgtggaggagtggggagggaggcacagggaggactccagggtggttcatacggctccctgcttctgttcctgtccccctttgtcaagctgtggtctgtactgcgtgttccatcttgtttctaagctgcttttgcccagtctttccagcatttccctttcgtcatgttagtctgtgcctgtctacgtgaactatggtgacgtttattgggcctggcactgtgaggtgctggggatgtgaagatcattgtggctcagccgctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttatcattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagtacagttcgcttgaaagcctgcctgactgtggaaaagatggagctcaagaatggagttgatggcccagcgtggtggctcatgcctgtaatcccagcactttgggaggctgaggcggtcggatcacgacattaggggatcgagaccatcctggctaacacggtgaaaccccgtctctactaaaaaaaaaaaaaattagccaggcgtggtggcgggtgcctgtagttccagctactcgggaggctgaggcaggagaatggcttaaacccgggaggcggagcttgcagtgagctcagatcgcgccactgcactccagtctgggcaacagagcgagactccatctcaaaaaaaggaaaaaattgtaaaaaaaaaaaaaaaaaaatttcccccagcagtttttgttttctaaagttatcagtttatatattcaggtcttaagaaaggcaaaagctgtcttcaggtgattggcttgggggcagaacagtacttctgctcggggtttcaccttcctctctactccagtgcagcagagcttgtgatgtgctctcactgaggtgctcagtgcagcaaggaggcctgtggaccctcgagttgagaattggtgtactagggcattcggtactttctagaagccattaatgctacaggtactcataaagtctactcttctgcagcccatcgtggatggtggcttaatcattgaatttgagttgtttcgagctgcaacgttggatttgcattgttgtaagcacactttcttgctgtgaccactgacaccaaaattagtttgggcccagggagacttcagttaattggttcatttgaggcttagccctggactcatttgtcaccagccaagataacttgccacatggaatacagccagaccaggggtccccgacccccaggcctaggaccggcactaaaccttctgttacgtggcctgttaggaaccgggcatcacagcaggaggtgagcggcgggtgagtgaacattatcacgtgagctccactcggcgttagattctcataggtgcgattgcgcgtgtgagggatctgggttgcatgctccttgtgagaatctagtccctgatgatctgaggtggcagtttcatcccaaaaccattttcctccctctgtccttgggaaaattgtctttatgaaaccggtccctggtgccaaaaagcttggggaccactgagctagactcgacagtattttccaaggaattaaagcctcaaaacttggtttgagatttcagggtaggttgttaaaaatctgtgtgttgaaatctaagatttaattctgccaaagttcacgttaagacagaacaacctgctggaaagagatttggtctgagtggggcctgcggaaatcttctttcctgacttggtcattacctgtgggaccacttcctgagctgtgtggtttgggtgatctcagattttttctatctataaagctatgtgcttttttctactcactgagttgtagaaaggtattcgctctcattccattctgaagctctttgaaagcttgttttccttctaagtatcttctctactaaggttgccagatataataggggatgctgggcatggcggctcacacctgtggtctcagctactcggagggtgttggggctgaggcaggagg

SEQ ID NO: 12375 - DNA, 7460 bp, Human
cagtatcttaatacataggtttttagactttgactagaagcttaagtcaaaggaatataagcatagtcaaagttagactcccagtcttggaatcttagaattacagggtcgcaggatcgcaggatcgcattctttagatttatggaatcacgttaggacaaccgtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacaggacgaaatctgggttttttgcttctccattacttgggaagaaggaaaccaggagttttgtttagcgagtgtaaagcccctctcccttcgttcgaccaaccctctgccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttaccggccagaactctcgtcttgggatctcccacactcacctggcaccaccctccgcgcggctctgcacccacagccccggcccgcccccccccccccaccccggaaagctgcgtccgggctggagccactggaacccgcgccaaggcccggaatcctatgcgtagcaggggcctcggagatcagcacacgccctccagctgctatttaacagagtagaacactgaggccctgcgaggggacaaggacaggccctggatctcccagtgaatggccagggaacgaacccgggccagaggggccgcgccgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccattacccacagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcgaaagatggggggactggagtgccgagtggctgtggcagccacgattggggtttggaaaccatcctgaaaggcccggggagccagtctcctggaacttctccctccctattcccacaaaaaccaagcgccctctcggccaattctcaccctctcaggacaaaaaagtgagatgagcccgtcctttcacctgcgagtccaagcccttggcagaggcctgaaaagtccgaaaactccgagttcgggcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccagcgcgcgccagcctgggccgctgggctctcggggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaatggtgggccacccagggcctctgagtagccacccaaagcctagccgctgttctagggaacggaaaagagttcatggccaagcgtctaacctaaagtcccaggattggctccaggcagcaattatatcataacttattgaacttttgagcaggacgtgctggtaatttcatggctgttactgcccagtcataaatctgcttttccattataaggcagagagaagtacattcgttcatttgtccactgtttcttgtcatcacgcagccctggacccaaagggtgaactaaagtttaaggagatgagaggattcaaggagcccgttggtgacgcctttcagtagctggggagggctcttccatccccagcaccccctgctacacctcagcagcctcccccatgcaaaaaggaaagagaaaaattaagttagggcagtcagtaaagtgagctttagaaagaaactggaattttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaatatggtgcaagccacatatgtaattttaaatattctagtagccacattaataaagtaaaaagaaacaggtgaggttaatttgaatgatatacttaacccaacatatcaaaaatattatgatttcaacatataatcaatgtaaaaattgagatgttttgctcttttacatgaagggtttacaatttggagtgtgttttacacttacagcttctctaaatgtggactagtcacctgctaggtgttcagtagcaacactgtgttgtgcagtgcaggtctaggtgctggcccttcctggctttggtggtggtacctggaagcacttgagcgctgaccctgccacccgtcggcccaaattccagacccagccttgtgaccttgaagagtgcaggtattgggccgccctcctctccctaagaatctttgcaggtatggagttcaagggttctccttcattcagctagacaagctggctgtcccaggtgcagaggtcaggatgacttgcctggttgagaagaatgggaaagtaagagttctccacccaggagttttgttctgggctgcagaagagcccaggcgtgggactggggctggagaaggctggtttttgcccttagtgccagagttgagcctttctctgtttcctaatgagcaagtccagtgctttgacagcaccactaatcttaagccagtcccttctcctctcgggtcgtcatttgtgaaatgggaatttgtgactgctacctcagataattttcctgaagttaaacgagaggagaggtgaaaagtgctttgtaaactgtaaagcgcagagcatagcagggctgaaaggctttaaataagcgctgccttgtaacaaagcctcctggagtgtcatgataaagccccgggaaggagaaagacagggtgggaaagagcggacattttcgtcccccattctacttgtcaacttgcgggacaggtaagattgtgccaaaggcgagggtcagcatcaggagagagaggacgctgcggggagggacctggttgtgtgcttcaggtgccccaagggacacggagacgcgcgagggttgggatcaaggcgttgaagacagagcgacagcccttctcggcctcccaccggccgacgacaccaagagctcgcgcaccggccggccgggccaggtgggaatgggcgccgcgcaggggagcgagtacctcggagacagtgcgcgccgcccggggcctcatccacagcggggtcgcgggcggcccccttagcccgcgtgactgtgggatcctgagaacattccgctgtatgtcttggaaccttctaaccctaggaatttgcaaacccctcccagtccctcatctgggggctcagagactggaggtgccttttttatttttttcttcttcattttatgaacacagaaaaatcgtttgtccctctccgggccctgcacccgccagcgtcgtgtgcaggcgtccccgggctgtggataactagacacgttcttccctcattgcccaaggctcgttagaattcgccctagagctgtatcatgtattttctttcaaattaactttgcttgcaattaagcttagggaaccagcaacaaaagcaaacttggcccgaggtcgttcaccgcgaaaatggattagagaaacttcttccccgatttaaggggaaagattcctgcggccagcgctttggggaaagtgccccgaccgcagaggcgacgacaggggagcaggaagctgctcacggtagtcggcgttggcggcagcggtggccttcctcatctgggcgatgtgggctcctagaagagtaaggataacatcctggaaatgacttctgtacggtttgagcccaactgcacactcatgacttggagctgccctgtggagttacagtttaccaaacacattcatgaacataatctcatttactaaaaactttgtgagaattttcttttactaaaattttttcttattacaaaatcagtagtgttcattgttttaaaagaaataacaggtaagaaaaataaagagggagggaaataacagcaaaaaaaaaaaaaaaaaaa

SEQ ID NO: 12376 - DNA, 22123 bp, Human
  misc_feature (1)...(22123): n = A,T,C or G
tttactctgagtgagataattggggatccagagcaacactttgtcttatggaagaggttataccaggataacaagatctgtcatattcatattaccatactgcattttagatagtcactgcctaaggctcattagtaattataatagcgatgatcacaattagcctttattaagtctttattacactccatatcactaatgtccaaaatagtggctggtatactgcaagtacttaataaatgctggttaaacaaggaacaggacttgagctagaagaaaagatggagagagactgagaattgtttcagacatgggacacagcatgaacaaaatctgggatgtggggtgaacaagcagtctggatggaagcgaagaggcttcatgcaggaaatgagtgaagtcacctcgcagaagccccgaatgcctggtaaatactatcctggttcccttgaaaccagattctgtccctgttcttctagctctgttctattttttttgttgttgtttttttttttaaagagacagagcttgactatgttgcccagtctggtctcaaactcctgggctcaagtgatcctcctgctccgcctcccgagtagctgtgactgtaaatacacaccactgtgcctagcccaactcctttctttcttcctgcctacagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcaggtgagggggcggcgaggaaggtgggagctgtggagggtgctcggggtgggtgcagggctggggagtgcacggggaagagctgggcctgagtccaccgcgcggcgcagggcgctggcccccgggccgcacctgaggccccttccaagagagatctcgtgctcacgctttccttgctgcgcaccctcgggcacccaccaggggctccccctcccgctgtgggttttcctgtgtttatttgcttctcctccccctccctaggcgggcctccccgccgctctactgtgaggttgggggtcccgaactgaagccgcggggttccaggagggagggaactggtggttccgggaacgcagaggtttggctggattccagcgcccgggatggggggcgggtcgcgcagccctggagggcaggtgcctgtatggggaggggccctgaaacagaggtcgtttctcggcacagtcagacccgttaattccaagcaggctggggcttgttggggattaccggcactgcccgcccaggagacgcggatgcggcctctacaggttgggaaacccggttctgggcagtgcagtttgggattgcaaaatgctgcaagttccagaatttctatctaggtggggcatggggactgcggtactggggaaaaggaactgctattgagattttatatttggggcgctttgagaagcggctgacaccttgcaagccaccgggttgtgcagctccttgctctcaggagctgggggacgggggtcctggtgcctgacagcttggaggcctggagctggaggaatttctcttctctatcttcccactatcagtgctgattttttcagcctgcgtgcagatttggtagaactggttactgaagagatagaaggggatagaagccctgagccaggcctcacagctgccaacccttggagaggggtgataaatccactgggaattttcattccaaaacatggcttcaggctcactttggatctcaaaatcaatctctccactgggacatccccagtgtgtgggagataagtaccctacccccctgaagaccagaaatagccttgaggacagaagggagactcccagagaacactaaatgcagacttgctcctccataagacctaaacctgtctcccagtccccacccttagagaaggcttttagagaccagaatctgcactgcactttgtttttcttgtggaatttccttcaggaagcccagactctgagctgagaagacaaaagctccagttccatccttgtggaaagtcttgggactgaggggcaagaagagccccagagatgggttgctctgtgccttccagttactgagaacctggtcttcagaacagaagtcaatgcactgttagcttcaacgctattttaggggtgggaagaggagatcttgctgagaactgaggatgctggagtcagggaagcagagaaggttggcgggggtgacagataatgcctggcacaatgataccttgggatttgagatgatcaagctgagatccagctccctcttgtgtgtggactcctgagagagcagagcaactgcccccacccctgcccccacctgtctgccttgctccttggacctgtgtctaagaccagaggcatctcacccagcccagtttcagaaggaggatgctaatacatctcatggtcatcttttccatcctttcttattatctaacttccctccttcagtttgtaacataaaaccttttttctctctacttttgaaaattttaaaggggaatccttttcatttggatggggttgggggatggggataaggggggagaaaagcataattttattttcactcaccctaactgaaatttagtgttttctgtgattatgaatgttggcaacaattcatgatagtattagcaaaaagtttcctactacactacagttatttctggtaccttgaaaatctattggccgggcacggtggctcatgcctgtaattccagcactttgggaggccgagatgggaggatcaactgaggtcaggagttggagaccgttctggctaacatggtgaaatcccgtttctgttaaaaatacaaaaaattagccgggcatagtgatgcacgcttgtaagcatctcaaaaaaaaaggaaataattcatctgtattttggcattaagctaataattagatttaccactagatcttactatttaatgtattaataaagaatgacatattactaatattgcacacttggttttaaattttgataactttcaatataatttcttatgtatttattttatgaatttataagtattcttggccagactaatgcctgtaattccagcaatttgagaggctgaggcagatggatcactcgaggccaggagtttgagaccagcttgggcaatatggcaaaactctgtctctaccaaaaaaaaaaaaaattagccaggagtggtggcacatacctgtggtcccagctactaccggaggctgaggtgggaggatcgcttgagcccaggaggcagaggatgcattgagccaagatcacaccactgcactgccagcctgggcaacagagtgagaccctgtttcaataaataaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctcccacctcagcctcccagtagctgacactataagtggacgccaccacactcagtatttaaaaaaaaaaaaaaaaaaaaaaaaaaaggtcttgctctgttgcccaggctggagtgcagtggtatgacttcagctcactgcagcctccacctaccaggttcaagccattctcatgtctcagcctcccaagtagctgggattacaggtgcacgccacagtgcccagctaatttttatatttttagtagagacagggtttcaccatgttggccaggctgttctcaaactcctggcctcaagtgatccgcccacctcggcctcccaaagtgctgggattacaggtgttagccaccatgcctggctgctaatttttaattttttgtagagacagggtctccctgtgttgcccagactgttctcaaactcctgggctcaagcaatcctcccacctcagcctcccaaagtgctggaattacagtcatgagccatcatgcccagccaggatatggacttcttgactagtaggaagaaagtgggctggacacactggctcacacttgtaatcccagcactttaggagaccgaggtgggaggagaacttgaggcccagagtttgagaccggcttgtgcaacatagtgatgtaacaggacgagctgcagacaaaacttctcagatactgagttgtagaaggaagggctttattcagctgggagcatcggcaagctactgccttaaaatccgagctcctcgagtgcccaatttctgtcccttttaagggctcacaacactaaagatttcacatgaaagggtcgtgattgatagagcaatctaggggatacgtaacaggggtttcatgcactggtagtcagagtgaaacagaataggacagggagtttcacaatgttcttctataaaatgtctgcaatctatgaataacatcggtttctaagttatgagttgatttttaactactaggtttaggccaggcaggcccaggcctggtttcgggcctggcgctgggctgcctgtctttgatttcacttccttgtttttttcttaaaacaggtactgagtataaaacaatatgagagggtctctctcttccctcagcgagaccctgtctctacaaaaacaattctttttaattagacaggcattgcgatgtatggaaggctgaggctggaggatcgcttgagcccgtgagttcaaagctgcagtgagctgtgattacaccactgcattcagcctgggtgacagagcacaatactgtctcaaaaaaaaaaaaaaaaaaagaaggtggaggaaggccaggaagggcaggggatgctcctgagagggcagagtggtgggctgtgtcctggggaagggctaagggagtggaacagaggttatcgtggggtattttgtggttcttcagctcaattgtggaaagggaaagcaagttgggttagaaagaatagagtgaggtacagttaggagaaacttccaggtcttgagacgagtaagagttagggaaatcaaggaagaggcacctaactggcctcttgggaggggtgctcaggctgagtgaccaggaagctggcaggaagttgccttccaggggaggatgctggtaggggcgggtaatctggcagtttcagcttcctgttgttgctacccttgggaacctggcaatgttgcccttggccaaggcccagcttgagctgtggcagcctgctccccaagccaaagaataagttaaaggtaaagggtgggctgggtgcggtggctcatgcctgtaatcccagcactttgggcacctaaggcaggcagatcacctgaggtcaggagttcgagaccagcccggccaacatggcgaaaccccatctctactaacaatttaaaaattagccagacgtggtggtggttgcctgtaatcccagccacttgggaggctgaggcaggagaatcacttgaatctgggaggcggaagttgcattgagctgatattgtggcactgcactccaacctgggcaacagagcaagagtctgtctcaaaaaaaaaagataaagagtggccatctagggccgggcacggtggctcccacctgtaatcccagcactttgggaagccgagccgggcagatcacgaggtcaggagatcgagatcatcctggctgacaaggtgaaacccggctctattaaaatacaaaaaaaagctgggcatggtggcaggcgcctgtagtcccagctgcttgggaggctgaggcaggagaatggcgtgaacccaggaggcggagcttgcgccagtgcactccagcctgggcgacagagcgagactctatctcaaaaaaaaaaaaaaaaaaaagagtggccatctaccctgtccatcccccaccccactcccacatcctacccccaccactaccaccttcccactgcacattgagaagtcccatggggctagcccaaggcagccatgccccagcccccaccaggccagaagatgtagaataagctgtgatttttggtccccttccagtttcacttgatcctgagatggtttgggtttcagattgagtgcttgtcctcagaggcctccccaccccacttcccaggtcagagaagcccggaatggcttaccttgaacagcagccctgttaacaggtagttctaccccagagaaacagacagagacccaggaccccgtcttactgttccctgcccacactgctctttgatccctggacctctggttctgctgctggaacttcacgcatggcagcagacccagaaaactgggttacctacctggtaagcagtattagatgccagctctccaacctttcaagccctccccactgggggtgaggtggagcggttctttatttctttgcctccacccaccgaaaatttgtccccagtttcccattctctccattgtgtctgtttctattattgtcctcaacacccacccaaacccagactctacagctgcactgtccaatgtggacaggagccacaggtggccatttaaattaattaaaaaattcagttccccagtcataccagcctcatttgaagtgcacaacagtcatatgttgctagaggctgctgtactgcacagcataaacacagaagaagatatagaacattcctaccctcacagaaagttgtcatggataagactgctctagaagttgtctgccagtatcagccaccatgccttgcctggattactgcaagagaccagtctccctgatcccagtgtcttcctcctcatgcaaagtggtgtgtgtttctcaagggtaaccttgctccctgtcactcacatacacagcttcttggcctgacacacaagacactgtgtgatctgccctctgcccctccacttgccttattccctgccgtgagtcctcagagacactaacccagctgcatgaaactcccccagacccttgaccttgggagtcagtcaaccttttgaggttctttgaagctttcatgaaaacctaactttgtgaacatggaaatgataatgctcggccaggcgcggcggctcatgcctgtaatcccagcactttgagaggccaacgcatgtggatcgcttgagcccaggaattcgagaacagcctgggcaacatggtgaaaccttgtctccacaaaaaatacaaaaattagctgggcatgggggcacacacctgcggttccagctactcgagaagctaaggtgggaggatggattgagcccaagaggtggaggctgcagtgagccgtgtactccagcagtgctgtactcgtgtacagtgtactccagcctgggcaacagaatgagaccctgtctcaaaaaaaaaaaaaaaaagaaatgataacactctctggtttttcccagatcacatatttcctttgaatactgtttcctgtacatttttttgcactgcaagttaactgcctgtccagttttatgaaggtttccttgaacttgatgaggaattttggcattaacaagagagttcactacaagaatctcaggaattgccgggcgcagtggctcacgcctgtaatcccagcactttgggaagctgaggcgggcagatcatgaggttaggagatcgtgaccatcctggctaacacggtgaaaccccgtctctactaaaaatacaaaaaattagctgggcgtggtggcgggcacctgtagtcccagctattcgggaggctgaggcaggagaatcgcgtgaacccgggaggtggagcttgcagtgagctgagatcgcaccactgcactccagcctgggcgacagagcgagactccgtctcaaaaaaaaaaaaaaagaaatctcaggaattgatttttctcgtttctgtatagggaacatatagaacatgtctacagcatggatctgggttgtggctgaattagatgttctgtgtagctgacacactgtttccaagaaccacttcctttttaggcctttttgctttctccacttctcccattggtaccacaagttagcctttgttttgaggccttgccttccccacccgttcccatgagaggaacaaagtcattctgaatgttttggaagtagagaaccagcctcactgagatgtgtctgccaggcagaagagcaaaccctctcgccttggttgggagactctttcttccctcccagccccccagtgttgtccctgtctgcgttccctctctgtctacaccccccgtgataacaggtgaactccagggcatacttgtttattgaattaattaattaaaaatggaagctggaccaggcgcggtggctcatgcctgtaatcccagcattttgggaggctgaggcaggtggatcacaaggtcaagagttcgagaccagcctggccaacatggtgaaaccccgtctctactaagaatacaaaaattagacgggcatgatgatgcatgcctgtaatcccagctactcgggaggctgaggcaggagaattgcttgaacctgggaggcagaggttgcagtgagccaagatcacgccactgcactccagcctgggcaacagagcaaaactccatctccagaaaaaccaaaaaaaaaggaagctggcctggcgaggtggctcacacctgtaatgccagcactttgggaggccaaggcaggcagattgcctaaggccaagagtttgagaccagcctggccaacatgatgaaactctgtctgtactaaaaatacaaaaattagccaggtatgctgtggcgggcacctgtgatcccagcaactcaggaggctgaggcaggagaaccacttgaacccaggaggcagaggttgcagtgagccgagactgcgccactgtagtctagcctgggcaacagagtgacattctgtctgaaaaaaaaaaaaagctttttcagatcacctctgcccattgtcctgttctgttcttcttttctctggaagcacttacattctaaactattcattggctatccttctctttatgtaaattgcctgtctaccaatctagactttaactcccataagggtagggagaacttctctctcattgatgtgtaacctcagcactaggcacccaacagtaggcgttgtcaagtatcagagcaggtaaaggacaaaagttgctatcagtgggctggagggtagacagacccaagaaccgactgacttgcggtggtttgctttgctccccagggggctgttgtggttccgactataaacagtacgtgtttggcggctgggcctgggcctggtggtgtatctccgacactcagaggtaagcacctgggggctctaggacctgtcatggagtgggccagggagagaggggcttccagcattgttctgcttcactctgagggtcagctagagcatctaccatttccacattccattctggcggtggaggggtggggttgggggggacttcctaagaagcatgtaagatgggttgcacaggggtgcaggagacatgcatcaggaaggtctgtcatgggcaccccctccttagtgggtgttcttttttccactggaggtggcattacttctgtcccagagaattcagggtcataacccaggcagaatcttgatttcctgattataactcaaagttatttaagaagtctttattatacgcccagtttggagtgggcatatgaagggaggaaaggctggagggaccccatgcacacccttacccatgcaggccctggggtaatccaggcagggactatgtggcagagaatggacatatagtcaaaagtggttctgtgacagtggtaagttagacagggagggggacctaacgaattagtgctggggctgagcaagacaggtctggacctcctaaatcagtctggaaagacttactagaggaagtgagatttcagctccccagagggcccaccatccagctctacctgccgctgcctgcagagcctagggcagggccagacctggcctctcctgccaccctcactgcccacccgggagatgaggcacgccagctacctttccacgatcgcccccttcctcattatgggagatggggcggtggggaggggaggagcagatccttcccaaccaggacccaggcaacaagggcagcagagctgtgggcatgttgcaaggtggtcggtcaccccacaggggaaatcatggagattccagtggaaaccccctctgccccatcccccacccgtcagcagctcacgtctgcaccaagctgctagtgcttgaggctcctgggagtctgagggcatctgctagggtcggggggaatgggaagcatggcacaatggattaacttcactggttctcagtaaccgctgcactctcccacctctcccctcactttacccgaccagaggtgagcgatgctggggactcttctggtccaaggctcaaagtgtcagagtaatcagtagtggccacagcctccactcgagaggatcctggccacacctgagtgggccagtggcctgtcagaagccgtggggagccctctccagacatactgccaccccacacactgtgcattcccagcacaacagagtatcttgtccagacacctgccctgcgtgggcagccactgctaggccaattcccctgcagtcctttctccagattcttggtcccctgctctcccttcctgctccagggagcagagccaggacagaagggccaagcctttctgacagcaagtttggaagttaaaggtgaagggccttgtatctcttcccaggacaccgacctcacacccaggctctacatcctccctctggtctcacttgctgggtagtctgagccagtaatccttctccttcttacaccttttctggggggcagcctcttccctagtccctagcctgcttgggggacgcctccacaggctggggctttatttccctaggctggcaggagcctctcgggtcagagtagaggcttctaactcagcctggatactcagcctccctctcaaggtcctttctgcagctgtctatatgtcacgtgcccttggggtcagccattcttcttccaggctcagtgacccctcctgctgcattttgctgccacatcctatactatcccgaggccctgatatgggcggctctctccctcttacctgagcaattcttccacctttggcatctgagctgcagcctcccttcttccctccccactacccttcctccctccctccctctcccctatttccctctctccttccccagaagagagcttggtgggttcctgtctgagctgggtcaagaatcctctcaggcccaaggatgctagtgttaggggctcgaatgaaggcaacttttgcacatctgcatggccagtgccccagggctggcactgtgggggtggcccctcctgggattgagatgggggctgcacatcgactgctgctccttatcaccccctccacctgcttctgccccttcaccctcggcctctgtcctctcttccttcctctgatttagggaaaccttccacactgtccacagcctggcctctgcctagacaatcaccctgcacacagactgcctagggaggcccagccaggatgggccagggagcttcgaggcaccttgttttctttgccaataatcttctctctgcccctggccaactttggaaattcccaattaaatgcctcccttatctcccggttatccctgagtattctggcaggagcacactctcccccagccttccttggccccacatcagaacatttgggcttttctggcctcaccttgccttagtgatagatagtgcagacctggcggattcggcatttgctaaagctcaggagtccccagaatagcctcccactcccgatttctggaaacacaggtttacctgtgtgaagacggggggctaagcctcagtctcccagattgcgacaggatccctgggaaagtgaggtggcgggcaacccaggtgccctgtgcacaagcctcctgacctcaggccgcaggcccagggtggcagcaggcatcttccccagcctagcaggtcctcactaaaagggtttgggggctagagaagagacccagaggcctcggatcagcacaggaggtcgctgctgtcctgcagccctcggctgagctggcagttggggggttggattactgacagcatgcccccccccgcccccaggcgtcaggcatcggtgcttgtctggtaactactgtgtgtgtttgctgtgtcccctccttcccttcctgtccctacctctccccaccccctggctgctcctcagactgtctctggaggttatgaccatcctgtgtcgctgtgagaatattgagacgtcggagggggttccactattcgtaacaggggttgcacaggtaataacccacctgcttcctcctccgtgtctaaccttctctcttcctgccctgcggggcctggcagacaggagccgatggactcccctcctgagaccgtgccttcctccctctcctcttttctctcctccactgctctgggtgccaggatggatccctgtacatccccaggtcccttgcccttgcctattggactgcaagtggggaaacagcaagggattctggaagctctgccaagtctgccagtgagtgtccctggatgccaggccttcgttaccatgcagccatagctggtgaaatctattcttgggcttgggtgttaattagctccaaatgcttactctgtcatgtgtgggttcccctcttcattgcttcattcaccagctctctactgagcaccttctcagtttgaggcatgtggactgcaggagcgaacaataaaaagcccctgccccctcagagcctgtgtgccagcgggttcccagcctggaagaggcctgaaccacatctttctcaccccctccctctgcattcagttgcccttcagcctctgcttaggcaaaaacactacaccaccactcccttcttcacccatcctgccatctctaatggggaaggggaccatccccatccccttagcccttgtagccatgggaggtgcagaggcctgggaggcttggagcaccttgtgtggaaggggtagggtccaggcctccttcaatactctatttgatgcagtcctctctccttccatacccacacctacacttgaaacacctgcaaagcccagatcccttttaaagtgggtgactgtggaccctggaggagtcagattgcatggccagaacaactctttccagggttaacactccttggccaagaagctctagtgtgacttcagtctaaattccccatgtgacccacctgggcctaataccagacatgggtttcaagtcaaaggctgcagccaccaggtagggcttctctggcaaggggcaggtacagaatcacttccatcttagcccagcagtaggcatactccaggatgccaggcaatcaggcagagctttccaagcaacttcctggggcaccctggggtgctgggtagaccaaggaatgggcaagggcccctgtgggaggctcagttgacatccacggatggcctgcacagcagggccgggaggaccagcactgacttgctatcctagaacatacacacagctacacctggattctcccctgaccaacagcccccgaccacccacaaccacttctttctacttccttttcctcagctgacttgagcagagggtgtgtgcacatatgcagcccacttccactccttcccctggggccacctgcacccaccctgccctcgtgcccacctccttctcagacactcccatctcagccccgtggagagtcctccctccaccttcctcaccaggacccagccggagcagtgaggtactggcctctttcccaacaccaccaggccctgcgcccccagacccatgcccctgttttgcgtttcttggcaggatttccctagagattatgacgttgcagccccgctgcgaggacgtagagacggccgagggggtagctttaactgtgacgggtgtcgcccaggtatagtaactcagcagccctgcgcatgtccgttgagctgcctggtcccgtactcgggttcggggggaggaggagaggacagcagccaggggcagtctctctccagcaccccagcccccgcaagtcccacaagagagggctagtcaggtcgtcgccactggaacatgctcaccgggccattttggccacccagcaggactaacagacaccccttctctcctcagcgggcccacgagggacagaaccagtgctgagggctcctggctcactaaccccacccccattctttgcaggtgttggaaatgtcaagccccagaatccaggccttccttgttccctgggtactgcgtgggaggggtggggcccagagggagaggccatgtgaggcagaggagctctggactctgggagtcggaggctgcatcatatcccctgctgagggcctaggtgagggcttcctgccccgatccacctcttggcttcacagggcagtgaggttcagccatgctgtaggcctcggcgaggggttggctgagtaactcaagaaggagaggcaccctcggttgcatcccccaaccctctcctgccctgtccaggctctttccttctctgtctgtgtccctattgctcattctgcttctcatactctctgcccctcagcctgagggtctcccacgtgtaggaagcctgcaagggaggaattagctggtgaggggacagtaggctggaggggtggggagacaagccccgaatgcccaggagaggccgtggcagggcctggggctgtcagtgcaggagaagtttcatagtgagagaagcccttgtgctgctgtctccccactagaggcttcagacagattccagccccccagggcctccaggtctgaaaaaaggaagggaggaggcacagccaccatcctgcctacctctgggtctggggcctttgtctgcctcgctccagcctagctgaagcgcctttgtcgtcactgacaggtgaagatcatgacggagaaggaactcctggccgtggcttgtgagcagtttctgggtaagaatgtgcaggacatcaaaaacgtcgtcctgcagaccctggagggacatctgcgctccatcctcggtgaggccctgttcagcctttgaggagcctcacggggcccctaagccaaggcagggaggtgtgcagggctgggcagggggcctgtttcacaggagtttcaagctaaaacacttttcctcaaatatttaatttcaaaacttcaggtgacttgagttaaggagagggtatgagtgaaggggtgggatgggggctgtcggtctgctcaggaacctagtgctgcttgggacacttttcctcattcagcctggactgtgcagcaggaagctcggtgttaagtgctgttgagaagataccccaggaagacccagctcagagtgcagcaccccgcatgcacccctacctctacatgcatgcctcctcccttccccagctggctgggtccctggggagccagcccttgatccctctgcccccagggaccctgacagtggagcagatttatcaggaccgggaccagtttgccaagctggtgcgggaggtggcagcccctgatgttggccgcatgggcattgagatcctcagcttcaccatcaaggtacgacgtgatgggaagctgtatctcctggcgtccatctgggagatggtggctttgttagaggggcacctttgtgcctctggctgctcctttgagcctctgatacccccttccctccccaggacgtgtatgacaaagtggactatctgagctccctgggcaagacgcagactgccgtggtgcagagagatgctgacattggcgtggccgaggctgaacgggacgcaggcatccgggtatgtgggttcaaggatgggaagctcaggggtgatgggaccatgatgactcaggacctctactcactcaccttccccttctgccccttttgtccccaggaagctgagtgcaagaaggagatgctggatgtgaagttcatggcagacaccaagattgctgactctaagcgagccttcgagctgcaaaagtcagccttcagtgaggaggttaacatcaaggtgagcagcctgaggacatcctgggatggggctcagggatcaggacttggtgaccagcctctaatgtgccacacaccctcttgccacagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaagtgagagccgcccaggtgccggggtcagggcttagtcaggctcctctgccttcagtgcactccctctactctcctgaccacagcttggaagccacttctccccctccactgtgtcttcttactcactgtgaagtgaggataaccccatgtcccctgtgggactgctgttgggaagactaaatagataaaggaggctccagtgcctggtgtagtgcttgggcatagacggcatcctggtttgttccctcccacttacagatgggagccggtggcctttccctggccagagccggaaggtcaggccaccccactccgttccaatgtctcccaccccgacagcccccagagcagagggtttgaaggtttgctggcccccaggcaaggcttgagaggaccctggtacgtcccactgatcctaactggcctgggctcccccagggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccaggtgaggcttccacccaagcgggtcctagggttcaagtgtccttgcttgacaagctgggcaagtgccagaacttctctgggccttgcgagtaacacagggacagatggctagaagggttaaatgaggagcatcctcagcagggggcaggaaccctacaaaggcctaagccatccctggcccacagggcgtctcttaccatggctcgagactaagggccacccaggctgctttggggttggagtgagttaaggaagggagggagagatgctggaccgggctgagaacagagtcagcgccaaccaggctgtcctcccactcttacctcctagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaaggtatgtgcctgcctagctgcggtggggttgcccaggtagcccgtcggactggcccaggcaaagtggtcctgggctctggagccaaggtctcatggcatctcccatccttgcagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacccctgcattgtgtcttctgtgaggagagagactgcgaaccgagaaccaaccaggtcccctacctctcttcagcttcaaggcagcttttagcctgttcttccgcattctagccactggggagcaacagcacactggccttgcccccagttgcgccttggacatgactgattggctaagatgcttaggccaaaccccagccctggaacacctggctccatcacaggcagaaggtggaggggactagcagggtgcagttgcacatgcctgtagtcccagctactcaggaggctgaggtgagagaattgcttgagcccaggagtttgagtccagcctgggcaacataggaagactccatctcttaaaaaaaaaaaagaagaaaaggtggaggaaactgccaggttcactgcacctctgtaccggtatactgagccctactcagtaatggagcccatctctcaggcttaagagcttagactctgaagtaaggcaatgtaggtttagattttagctttattgttcattacctgtgtaatcttaggtgagtaacttcatctttctgggcctcaatattcttattcatttaatgaatttatcaaatgcttgcaatgtactaagcattgtcttagatgccagagcaatgagtcaacaaaataaatgcacagccattcaagcttacattcagatagaaacaagaaaaattaaacgtacagtatgttagataatggtaagtcataaggaaaagaagtcaaagaaattataggaagtgtgggagtccgctgaaattttagggtatccaaaaaaggcctcattaagaaggtagccctgaagaaagtaaaggattgagccattcagatatctgaaggaagagttttccatccaaaggccctgaggcaggagagtgtctggcatgatgaaagaatagcaaggtcaggatgtttggagcaagggagtaagtcagggtatcaggagatgagtcaggatctcatctttccagatcatgtagaaccttaatgaggcatattgtggtctttactctgaggtgggaaaccactgaaaggctttgaaaaaggagtgatatcatttgatacaccttaaaaggtatttctaggcaccaagacaattcaaggcagaaaggaacagatggtgctagaacaactgggtctgtattggggaaaaaaattgaattgcagctgagcgtggtggttcatgcctgtaatccaagcactttgggaggcctagttgggtggaccacaaggtcaggagttcaagaccagcctggccaagatggtgaaaccctgtctctattaaaaactacaaaaatgggctgggcacagtggctcacgcctgtaatcctggcgctttgggaggccgaggcgtgcagatcacgaggtcaggagatcgagaccatcctggctaatgcagtgaaaccctgtctctactaaaaatacaaaaaattagccaggcatggtggcaggcgcctgtagtcccagctacttgggaggctgaggcaggagaatggcatgaacccaggaggcagagcttgcagtgagccgagatccgcaccactgcactccagcctaggtgacagagcaagactccgtctcaaaaaaataaaactacaaaaattagccaggtgcagtgtcaggcacctgtaatcccagctactcgggaggctgaggcagaagaatcacttgaacccaggcagcagaggttgcagtgagccgagatcatgccactgcacacagagtgagactctgtctcaaaaaaaaaagaaaaaaacaattgaattgcaaccccctacctcacaccatatacccaaatctagtttggggtggatcacagacctaatgtaaaaactcaaaacataaagttcatagagcaagcagggaatgtttctatgaccttgacataggcaagatttcttaagaccaaaaaaaaaaaaactactaaccataaaagaaaaatttgatatattgcatcatcacaataggtcttggc

SEQ ID NO: 12377 - DNA, 17625 bp, Human
tgcagtggcgtgatctcgactcactgcaacctctgcctcccaggctcaagtgattctcgtgcctcagcctcctgagtagctgggattacaggcacctgccaccatgcctggctaaactttggatttgtagtagagacgggggtttctccatgttggccaggttggtctcgaactcctgacctcaagtgattcacctgcctcacttagtcacaggatgagctagggttggcacaagatacaggtcacaaagtccctgctgataaaataggatgcggtaaaggagctggccaaaactcaccaaaaccaagatggcgacctctggtaggtctcactgctcattatacgctaattataatgcattagcatgttaaaaaaaaaacaactcccaccagcgtcatgacagttcacaaatgcaatggcaacgtccagagaagttaccctatagtccaaaaagcggaggaaccgttagttctaggaaatccctgccccttttctggagaactcttgaatgatccaccccttgtttagcatacaatcaagaaataactataagtacacttagtcgagaagccatactgctgctctgtctacgaagaagccattcttttttttctttacttctctattaaacgtgctttcactttatagactctccccaaattctttcttgcatgaggtccaaaaaccctctcttggggtctggattgggagccctttctgtaacagtactaaaggtgtgtgtgtagcttaaggtgtttttcagaacagtatttctttgctgactcatggccactccataaaatctgtgttaaaggtgaggtttttcccagaacctaatttttttctgacttcttggattgggatgatgacttcggcttttctcggaaggccttggtcacaccgctggccgatgaaacaaggaattgtgcacactgggtctcagctctctgcgttttgaatatttctgcattagtgactggcttgggtccagtctccaccaagaagccacttatgacccttggacaagtctttattcctttttaagtaagcttctggattctgccggtcctgtttggggtccctggggctctttgagacaggaacgttacagagcagttgaaggagaatagaaacttccaggctgcagttctgtctaacaaaaggaaactgttgaaatagctgcacaagctatgggctaagaccctgaaaaaccagggtgtgggtcaacctggctaaaaccaactggacccaacgtggtgtggctttgacctaggcttcacctaggactcattaacatactaagtcacacacccaccggcaccacaacaattccgggaacacccatatttggtgtaaaaatgggtggcaccacagttctgacaagtctccaccttattccagaaacctttgtgcatattccatttctcaaagaaacccataaagatggaaaccccaagccccattgtgtggccctcttttgagtccgccctttcttcagtgtgtactttgcagtaaacctctgtactttcacgactttccgacttgttcttgaattccttcgtgaggtggtgaaaccacctttgaaaacttatgacagaggcagtaaaagagatacacatgtggaaaggaacccagtctggggctaggccccgcccccctcctgcgggcagcccaatcatacccaggcccgccgcgctagtctccgcctctcggtgctgcctcttccgggcctcaggttcttccccatgcccacgcccctctttcgcgtcgccgtatccgaggtcgcgccaggccctggagtccccagtctccgcgtgctggccaatcagaccctgcctcgccccctcgcctgggagtctccgccctccacgctctgcccagtcaggctctgtcccgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcgggtaagcgcggcgggcacgtgggcggctgctccctccccgcctgggctgcttgtcccgggcccagcgggacacggaggacgccggggcaccgctcctgagccaccggggcggagcgagcgcggaccctgcccccttcttatttctgttgggatccctggctctgcggccgcttctcccccttaagtagcgggaggacccgcgagtagcctttgccctagggattgcatgcagccgggagggtaggcctgcgggacaccgaggcgggggtggcccggcgggtccggcgggcaggtcggccgcttgctgcagaagccaggcatgtgtcgcttaagcgtctcggtggccttaagtttatctcccatctgcgtgcatcgttgagaccccaaatggggaggcctttagtttactaaatggaccgttactgagaactccgaagtaaaattaaaacagaagcgcttattaaaattaaagcaccaggcagggcgcgttggctcatgccggagggcggatcacgaggtcaggagatcgagactatcctggctaacacggtgaaatcccatctctactaaaagtacaaaaaattagccaggcgtggcgcatgcgcatgtaatcccagctactcgggaggctgaggcaggagaatcgcttgaacctgggaggcagaggttgcagtgagccgagatcgcgccactgcactccagcctgggcgacagagcaaaactcccccggggggggggggttattttttaaaattaaagcgccagatctagatttttttactagataaaacaatcataactttgaagattcagctatttccccaaaacaagtaagataaagtcttctggactcaacagaagttctgctaaagtttgtattggatcattcatgtgtgtgcttgctgaaatgagccctaactcaaacggacttgaaataactgggaaacctgcccatgaatgtttcggccatttgtgctacttcagcacaattattgcaggggaaaaacaattttctttttttttttttttctttttattgagacggagcctcgctctgtcgcccaggctggagtgcagcggcgtgatctcggctcactgcaagcgccacctcccagattcaagcgattctcttgcctcagcctcccgagtagctgggttcactggcgcccgtcaccacctccagctgagttttgtatttttagtagagacagggtttcgccacgttaggatggtctcaaactcctgacctcaagtgatccacccgcctcggcctcccaaagtgctgagattacagtcgtgcgtcaccgcgccaggccaacaattttctttacgcccaaatgtttgagacactgactgctcctctgcttcgattgcgtagatcagtgatggctcttgtctcattagctcattgttttagaaacctgtttggagctggaatggttgacaaatttattccaaaatttgtagcataaagatttacttatgctgtcttgctaatagtctgttcgctctgtttctgatagggatccctacatcactaatttgaatacaaaggtaaagcatttctcagataagaatttagtttcaagtctgtggttttcgttccttttttttttcttcttttttgagaatggagtctcgctctgtcgcccaggctggcatccagtggcaggatcttggctcactgcaaccttcgcctcccgggttcaaacacttctcctgcctcagcctgtggagtagctggacgacaagagcacacctccatctcaaaaaaaaaaagagaagaaaaattgactaatactaatataaaatattttatctgactagtgacattgaaaaaggaaaatgcaaaattttcataaattgctcacaactcctaattttccgaggccaaaaaccacctttttcaaggcccagttagaaagtaattattgtccaggcacggtggctcatgcctttaatcccagcactttgggaggctgaggcaggcggatcacctgaggtcaggagttcaagaccagcctggccaacatggtgaaaccctgtctctaccaaaaatacaaaaaattagccgggcgtggtggcacgtgcttgtaatcccagctccttgggaggatgaggccgaatcacttgaacccgggaggcagaggttgcagtgagcctagattgcaccactacactccagcttgggcgacagagtgagactctgtctcaaaaaaagaaagtaattatttacctaatctatccacttcttcctgtcgggccaggggttaaaggagaattgtactaatcattgcctttagcctaaacagcatgcttagtaaaataaagacttaggtctttgaatcactgcaacctctgcctcccaggttcaagtgattctcctgcctcagcctcccgggtagctgggattataggtgcccgccaccatacccggccaattttttgtattttagtagagacggggtttcaccatgttggccagggtggtcttgaactcctgatctcaggtgatctgcctgcctcggcctcccaaagtgctgggattacaggcgagagccactgctgttggccaggactgaggggtaacattacctgtaatgttgccgtctccctctaaacttggggccaacaattttctttacacccaaatgtttgagacactaactgctccttgttaaggagaattgtactaattacaattagtaattgctcggttgctaaaatgagggtcacagcagccttactcctaaaattatcttcacaggtaggcaagatggcaaggtcaaagaaggtagtctcaggtggtgtttatagttgtccagtgcttactttgaaaaggtgttttagcttcaaactgctcataattggcatataaccggcgatttgtagcagagtgagagaattaagtgttaaagacaaataactatatactatctattttcctcagaatcctcttaataaactttaaaaaatcacgtcattctgcaactttttttttttttttttggagatgaagtttcgctagtcgcccaggcaatggtgcaatctcggctcactggaatctccgcctcccaggttcaagtgattctcctgcctcagcctcccaagtagctaggattataggcgtgtaccactacacctggctaatttttgtatttttagtagggacttggtttcaccatgctggccaggctggtcttgacctccttacgtcaggtgatccgcccgccttggcctcccaaagtgctgggattacaggcatgagccactgtgcccggcctgcaacatgataatttaaggggaaaaatatatatatttttctcccaaagtgttgagattacaggcatgagccaccacgcccagggattttttttgtttgttttttttgagactgagtcttgctctgttgctcaggctggagtgcagtggcgtgatctcagctcactgcaacctctgcctcctgggttcaagcaattctcatgcctcagcttcccaagtcgctggcattacaggagtgtgccaccacacctggctaatttttgtatttttttagtagagatgtggtttcactatgctggccaggctggtctcaaaccccggacctcaggtgatccacccgcctcggcctcccaaagtgctgggattacacgcatgagtcactgtgcctggcctgcgacatgataatttaaggaaaaaaaaaattatttcattccttcagcttttgagtgcttgctatgtggcaagcactgtatttaaaattgggaaaacaaatgaaaataagataaaccttgctgtttcttggtgggtacacagcctacttcctggggagactgacagatgatctctagtatgttcagcaccgtgtgtgtgctgggggatagtggtacagggtgccgtaagagcatgttggctggcctaagaacctagacttggttagacaagcctttgggcaggaacggacttctgaatctagaccggaagtagttagtaaagatggtagggagagtctttcagtcaaaacacagtgtacacatcttaaactttcttacctgaacgtcagagtgacctgaaacattcagttctttgaagtggaatgaagcaaaataaatttcttagtgacacattttttgacttcttccactgaaggggtatgaactttagaaagtttcataattaaggggaaaagaaagcaatattgaattatatacttggctaggcacggtggctcacacactattatcccagcactgtgagaggttgaggtgggaggatcatgagctcaggaatttgagaccagtctggacaacatagacccccccatctctacaaaaataaaaaataaaaataataattatacactctacttacgttgtgctgcgtatcagagctgtaaccaaagcaattgaatgctgttttaagtactactatcctttgggtaaggggtaaaatgagccagtgaggcctctttaaaacagtatttgagttaaccatttttctatgaacttacgttgcattgtttttagaaaaatacttggtgtcagaatatgaactgtatttaatatagcatatgctttttaaaaaatattattctctaaggcaagtacttttaactttatatcctaaataactctttttactcttgaacattggccggtccttctttcaggattccctgaatcgtttgaccgtatctttagagaagtgctcagtaagtcgagggctgaacctgtccagtgagtggtgagcagagcttgattctccaccaacccatggcttagctctgagaagactgttgagttgtgatcttaattttcttctttaagcgatggtagtgctatcttcaaggttaggcttgaatttgattaaagtagaattttaagaacttagtcaaattatagttgttccaggaggtcagtttcattcctgtaaaattttactttgtaacccaagctgcactgaagctctcttaggtcaactctgcctaaagaggcacctgattattactgttatttttttttttaggttaaatcatttcttatatgagccatctttatgctgcctccctaaacctcatcaccccaaatttgtcttcagaggcacagatttttttttctgcaagacagaccagtaatagttaagtatacatttgaaatatgctccaaaattttcttttgtgatttaggctaagtaatgttaaagcagataatccaatctccaaaagatgcacaaggtgttcagatgaagccatctttgcttaaatggtactgctgtttaaatgcgtcatctctatacatgatcttcattctttcctgagccatgcactatttaaaggtagtgtcaacaggtcaaacagaaattctgggaaagtcttttgaaagcaatggtaatgaaaagtgcttcttaagaagtaatgctactgcttttctgaaatgttggtcttctgttttagtgcgtaaattcacagagaaacacgaatgggtaacaacagaaaatggcattggaacagtgggaatcagcaattttgcacaggtattggattatattgaaatatttgtcccagtgtgctcttgcatgatttgctttatctctacctttttaaaagtgtttaggctgcgtgaggtggctcatgcctgtaatcccaacactttgggaggctgaggcaggaggattgcttgaggccaggagttcaagaccagcctggtcaacaaagtgagaccccgtctctaccaaaagttaaaaaaaaaaattagcctggcatggttgctcatgcctgtggtcccagctactcaggaggctaaggcaggagggtcgctggagcccaggaggttgaggctgcagtgaaccatgatcatgtcactgcaaaatacaaaaattagctggtcttggtggtgcacacctgtaatcccagctcgtcaggaggctgagacagaagaatcacttgaacctgggaggcagaagttgcagtaagccgagattgcaccactgcactctagcctgggtgacagagtgagactccatctccaaaaaaaaaaagaaagaaagaaagtaagaaaaccaaccagagttgaattaagtaaaacataatttagttagggcattatgtggtgttttaagagatgttgcaagcttaacactgaaagtaggaaacatgtcctattcaagaaggaaatgtgtgtgttttgtactgggcaattaaggaaagaggaaaaagaagagcagggtgttgccaccattttgtgggtccagtgatacacacgtgaccaggaggacgggaagaaagaaaacctcaataggcacagatgacacaaagggaaggcttttattcagcccatcttttctctgtaaattcccctcaattccatatggcgatactgtttaagagaaaatgagaagccaaatactagcgtgttcagtgattttcaactggatgtatgtattgggtgaggcggggaaggggggatgttaactgatgggaatgcactcgtgtcacttaatgatggagctatgttctgataactgcctcctcggggattgcgtccttctgtgagcctcctagggtgcccttacacacacctagacggtacagcctattacacaccttggctgtatggtacagcctttgctcctgggctacaaacctgtacagcatgttactgtactgaatactgtaggcaatcgtaacacacttggcctatcaaaacacagaaaaggtacagtaaaaatatggcataggttgagcatctctaatccctgaaatactccaaaaatctgaaactttttgagcaccaacgtgactcttaaagaaaatgctcattggagcgttttggattccagaatcttggatgaggagtgctcatgtattaagtataatgcaagtattccaaaatctgaaatccaaaacacttctgctcccaagcattttggacaagtgatactaactatattataatttcatgggaccactgtcatatatgtggtctgttgttgaccaaaatgccattaggcggcacgtgactgtacaaaattcctcagacatgtaagatgcttgtgtgttgataatcacaattatatcttccttggcatctctgtatacctactatgaggcccagtgttggatagtttttgagatgttgtgtaagatgtcgtccttacctcctagagtttatttgtgaggggaattacctacatgagaatgacttgcaaacattacatgatggcatcggaacggtggggttgtaattcacttacctgatggagagaccacttctttctggagtcagggacttcagggagtacaaggtgtgaggactatgatttgtagaatcagtgagcaggatttcagcaaatgctttgggggcaatggtgtacataaaactacagaggtggaagaacaccaaatatgttcatgcccagaagagctagcagtgtttgccgggcgcagtggctcacacctgtaatcctagcactttggaaggccgaggcaagttgattatctgaggtcaaaagttcaagaccagctggccaacatggtgaaactgcatctctagcaaaaaattttaaaaaattaaccaggcatggtggtgggcacctgtaatcccagctacttgggaggctgaggcaggagaatcgcttgaacctgggaggcagaggttgcagtgagctgagatcaggccactgcactccagcctgggcaacaagagagaaactctgtctcaaaaccaaataaaacaaagagctagcagtcttgtgtggggcaggaggcttgtgttaggttgctaaagcctgtgagccagatctggctggcggctggtctcttgcagctcctgagttgagaatagttttttaaaatcattttattttacttagttttggagaacagggtcttgctatattgccaaggcaggtctcaaactcctgggctcaagctatcctcccacctctgcctccctaagagctgggattacaggcatgagccaccgcacccagccatttatttttattcttgacatggagtcttgctctgtcgccaaggctggagtatacaggtgcaatctcaactcactgcaacctctgcctcccagatttaagtgattctcctgcctcagcctcctgagtagctgggattgcaagtgcctgccaccacacccagctaatttttgtatttttattagagactgggtttcaccatgtcaaccaggctggtctcgaacttctgacctcatgtgataacacccactttgggcctttcaaagtgctgggattacaggcgtgaactaccacacctgactgagagtagtttttacatgtttaaaggattttaaggaaaactcaagaatgtagcccctccagtataaaatatatactaaatcttcattataggggattcagtgtttggcttattctgtttactggagggtttagttataacttcttagagatttttggttttgtcttgttttatttaggaagcgttgggagatgttgtttattgtagtctccctgaagttgggacaaaattgaacaaacaaggtgagtgttcttaggatcttagaatgatccatgccatgaattttgtttacattgaatagtaatttgtttgtaccctggattaattagagtgcttttttttttttggagacagtcttgctttgtcacccaggctggagtgcagtggcaccatctcggcccactgtaacctctgcctcctgggttaaagcgattcttgtgtctcaggcacgtgccaccacgcccagctaatttttgtattgtagagacagagtttccccatgttggcaaggctgttctcgaactcctgacctcgagtgatccgcccgccttggcctcccaaaatgctgagattacaagtgtgagccaccgtgcccagccaattagagtgcttttgacccaagtattaggttggtgcaaaagtaattgctactcagaggctgagacaggagaattgctggaacttgggaggcggaggttgcagtgagccgagatcccatcactgtactccagcctgggcaacagagcaagactccgtttttttttatagagagaaaaaaagtctattaatatcgatatgttagataatatccttaaactaatgaatacccttttaagacattctgctaaaggtagttttttaacttgatgtaaaatctacatacagtgaaatgcatggaccagaagtgtacaattcagtgagttttaacaaatgtatacacttaaataaaccttcctagtcaaatagatgacctcttctctcgtttctacaccataggtttattttgcctattctttatatgaaaggaatcacacagtgtgtgttacgtttggctgcttttgggatttaccaagcttcttgaatctgtagattgaattttttttcgattaaatttggagacttcttattttagtcatgatttctttctcttcccacttcattcctttttccttctctgatttgagacatgttcgtcatatcacttgatattgtcctatagggtccctaagactgttaacttttcagccttttttaaactgttctttttttttacttcttatttttttgagacggagtcttgctctgttgcccaggctggaatgcgatggtgcgacattggctcactgcaacctccgcctcctaggttcaagcagttctcctttttcagccacccaagtagctgggagtacaggcatgcacaaccacaccaggctaattttttaaattaattaatttatttatttcgaggttttggtagaggcggggtttcaccatgttggccaggctggtcttgaactcgtgacctcaagtgatctacccgccttggcttcccaaagtgttgggattacaggcatgagccgccgttcctggccagtagttcagagttcataattgtgttttttttgtttttgagacggagtctcacactgtcaccaaggctggactgcaatggcatggtctcggctcactgcaacctccacctcccgggttcaagtgattctcctgcctcagtctcccaagtagctgggattataggcgcccaccaccacgcccggctaatttttttgtattttagtagagaccatgttggctaggctggtttcaaactactgacctcaggtgatcttcctgccttggtcttccaaagtgctggaattacaggcatgagccaccacgcctggcccagagcttataattgttatctgatacagggtacttcactgtcactggaacattctaaagttttcattttgtctttttctgagccacagctaagttgcaagaacatggagttttactgaacctacacacatctggcattcaggcacatcaccatttgttatttactgtgtccaggacacacagataggtccactttattgagacaatatatacccttctcgtggttattatagcctgacaaaacttatggttttatttttaattaaagaaatgtaggccaggcacggtggctcacggttataatcccagcactttgggaggctgaggcgggttgatcacgaggtcaggagttcaagaccagcttggccaacacagtgaaacgctgtctctactaaaaatacaaaaattagctgggcgtggtggtgcgcgcctgtaatcctagctacttgggaggctgaggcaggagaatggcttgaacccgggaggcagaggtggcagtgagcctagaacacaccattgtactgtagcctggtgacagagcgagactccgtctcaaaaaaaaaaaaaaaaaaagagccaggtgcagtggcttatgcctataatcccagcactttgggaggccgaggcgggcggatcacgacatcaggagattgagaccatcctagctaacacggtgaaaccccgtctctactacaaatacaaaaaattagacgggcgtggtggcaggtgggcgcctgtagtcccagctactcgggaggctgaggcaggagaatggcatgaacccttgggaggtggagcttgcagtgacgtgagattgcgccactgcactccagcctgggcaacagagcgagactccatctcaaaaaaaaaaaaaaaagaaatttggaattttaaaatcatagctatatgacaggaatctactttttcgtattttatgttttcaagtaactgacttttaacatttcatgttttctttaattttttttccacttagatgagtttggtgctttggaaagtgtgaaagctgctagtgaactctattctcctttatcaggagaagtaactgaaattaatgaagctcttgcagaaaatccaggacttgtaaacaaatcttgttatgaagatggtaagctgttgctagaaatttctcaaggaattactactacagtaaatattttatctagaatttaaagcaagtttagctgattgtgacttcatctttttctacttcttggtactaaatagagatgttctgctttaaaagaaaaacagaggttagttgaatacttaaagttatgtttaagatttctggctaggcgcagtggctcgcgcctgtgatcccagcactttgggaggccaaggtgggtggattgctttagtccaggagttggagaccagcctgggcaacatggtgaaactctgtctctatagaaatacaaaaattagctggctgtggtggaatgtgcctgtagtctcagttactagggaggctgaggtgggagaattgcttgaacctgggaggtcaaggctgcagtctatagtgagccaagatcgcaccactccactccagcctgagtgacagagcgagaccttctcaaaaaaagaaaaaaaaatctctgatgataaaagcattaccttattttgcaggttcttgatatcagttgtagattctttggttttggtgtaaacatctgcaaagtatttactttttcagacataaagcagccactcatattgtgtgacatgggaggtaaaaaaatatatattttgcattaatttttggttttctcacattttcacccttataatctaatcaggtaagctaacagcaattttctctattttgtagatgaatagaggctccaaaggatttatctgtcagggtctcatggctgataaatggcaaagctaggattaggttgtagttctcttttgtctgtcacctagcccttctaattactactgctttctaatcccgttaacctcagtagttagtgttccatttgttaaagacatacctggtcttgtgtatttggatcatatatttaaggacttatttttattatttttttgagacagagtctccctctgtcgcccaggctggagtgcagtggcgtgatctcggtgcactgcaacctccccttctcgggttcaagcacttcttctgcctcagcttcccagtagctgggatcaagggcaactgccaccacgcccagctaatttttgtggttttggtagagatggggttccactatgttggccaggctggtctagagctcctagcctcaagtgatttgcttgccttcgcttcccaaagtactgggattacaggcatgagccaccgtgcccggcccttaaagatttaaatgtcattttctgatgcttattacaacctaagagttcttaatttattatggtggaatctattctagccataattattttcatttgttatatacaagtattttaattcttaaggctaaaatttaaagttctatgaacaaataatgtatggtttttgtaaagaatacaagattgaggcgctcagaaatttattttacgttttggatgaatttgactttttaaaaagttaatgtggaatataaggttgtcttttggttgcaggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatggactctgatagtattctttgcagcttaagcatatttagagtgccaaaagttatttccaagtagctaatacacagcatacgctaaccaactgtaatatgctgataatattggggtggggggtctatatgcacatgcaaatatatatatacatacacacagagcaagaggagataaactcctgtatcattttctcagttactagaggaaaagagaagtattcatatagtaccaccttctggtggtgaataaacagcaaatataaggacttagcaaaagtaggtaggtaaataacatacaaatctttcctgctcctcagctgaagaaacttcattccaagcctctgccagtagccatatcactgctgaactatatctttgtacccttaaatcttaagtattggccaggtgtggtggctcacgcctgtaatcctaccactttgggaggctaaggtgggtggatctcttgagcccaggagtttgagaccagcctgggcaacatggtgaaaccccgtctctacaaaaatataaaaattagcctggcatggtggcatgtgcctctggtcccagctatttgggagtcaggtagaatcactttgtgtctgggaggtcaaggctgcagtgagccaagatcacaccactgtactccagcctgagtgacagtgagaacgcatctcaaaaaaaaaaaagtatccaaggtatcctggatgattgtctatattgcgtaattgtcaatcatgttaattgatctgtctgctttgaaaatagatggggatgagtaataattacatagatttaccctttagttttgaaagttctctagacacatcgattactaccatcatttcacaggtatgaaaggtgataggataagaaatttgttaaatagttgggtggtcgtggtaatgattttcatatttcctggtctactcttaatcagtcccttagcaaattttactataaaaatatttaaatgggacaggcgcggtggctcacgcttgtaatcccagcactttgggaggccgaggcaggcggatcacgaggtcaggagatcgagaccatcctggctaacacggtgaaaccccgtctctactcaaaatacaaaaaaattagccgggcatggtggcgggcgcctgtagtcccaggtacttgggaggctgaggcagaagaatggcatgaaccccacatgcggagcctgcagtgagccaagatgatgccatgcactccagcctgggcaacagagcgagactccgtctcaaaaaaaaaaaaaaaattttaatgggaatctcagggaagagggggaggttgaatgttctaaataaaggtgggaagcaaaagtggccattctagagtatgaaagtccgtgagtggttatagtctctgaagaaggtgggcagttttttatttttcccttttcctgccaaagacacacataacttgctctgtaacaacccctcttttttcaaagagcagaacatttggcaacttgctcttccactatttagaacacagagccaaatccactgtcattgatgtcacagtgctgccaaaaatacaggctttgaatggccctccaaattgactgaatccagggaatttaattttcatgacctcatat
